United States Patent 9,487,797 (GENOMIC PLANT SEQUENCES AND USES THEREOF) - sequence listing, part 5

SEQ ID NO: 8697 - DNA, 781 bp, Oryza sativa
taagtgttggtggagaagacgaggtcacgcatcgggaatatatatacccctagatctttagtcccccggttgatgagaacaaccaggagtaaagatatctttactcccggttgttctcatcaatcgggactaaagatattttcccgctatttcgaaattctttttaaacccggttagggttaagaactgggactactaataagcgcactgaatattaatttccattacatatgtgtttctaaaatagaaaataatgcattaaaattatttaatgtagaaaaattaatgataattacttcgaaaaattattgttgtatgtaataaattaagtggataaaacgtaataaacaaatataagatttaaaattaataaaaattctaataatcatatatacttagcatatgaatgatattaaattgttaaaaactctaattaacatatgtatatacatacgccatgcatgatttaaaattaataaaaattgtaataatcatatataattagcatatgaatgatattaaattaattgttaaaaactctaattaacatatgtaaatgccacatgcatgatttaaaatttttaaaaattcgaatagtcatatataattagcatatgaatgatagtaattaattgttaaaaactctaattaacatatgaaaatgccacctgcgtgatttaaaacttttaaaaattgtaattatcgcatataactagcagcatatacatgatttaaaattgttaaaacctctaataatcgtgcgtaattaacatatgccata

SEQ ID NO: 8698 - DNA, 1501 bp, Oryza sativa
atatgctaagactagattaacaaagacatatgataaataggtaggcaaaaatatcatccaaaccagagcaatccaataggtcgaatgtactgatgcaaccttaaatgacgccgacatagacgatacaattgcatggaccgacagaacattggacttacctcttagccagagatcgaacaccgatgcaaccccacgtcaggtgccaaatcccgccggacgataaaataaagtagaaaagataaaaggtggcgatgtgccgaattgtattgatcgtaaagataaattacatagaccccgggtgtacatatttatacccatgggttgatacaagtccttatcggacaagaaagaaattttcctaaatataaaaggaaaagataaagtccttataggacactaaacacactttcctaaagataaaaggaaactaacaaactattcctaattagtagataacttaccatgccgtattctctttgaactcggtctcttctagataagcttcctttagtagatcaatttctttaaccgaatatagcaagaatccgacaactgacgacttggcaactctcatcggctaatctcagaactttgaagccaatgctgactctaagccgatgattactccgggcttaccaaatttcactgttaacactcttgtgctaagaaaatagattatatctttgtcatccaaatttcctattagcctcaaacaattctttgaaacccatgccatatattttgaggctaaaaccctacttatccttctccaattatcttcttcccaccttcctatttacacattcaatttcattcatatatcccttaccctttcatttgagtgcatcaaataaattccattatatgctacctctaaaatattgcactcaaataattaggaaatctctctttggaaattatctccaaaataaattcatctcaaaggttagccacttaaatttcttccaaatattaatttggatttaaattccatccctcaattccctacacaaattagaaagccttcctattcatttgggcggaattttctctctcttccttcggcccagaccggcccaagtcggcccagcccctcccacccaagccgactccctgcttctcctcccatgggcgcttccaggcgccgccaccgtgcgccattacctgccgccgtgcacgactcagctaccgccgccgccatcttgctgtcgacgcgaaggaaccgccacccgacgtcagctacacttcattccgccgacgtcagcaacagggacgaaccgccatcgtcggccgatcagaggacagagccggcgccgtcattcttttctccacgtcgctgcagccgtgtcctcatcgaccttctcctctgaaccgccatcagccaccgcctctcgccgcctataaatataaggcgagccctccccttttctccacacatcaacagagcctcgagctccctttctctctctccatccatggccgatcgtcgacgccgtcggtc

SEQ ID NO: 8699 - DNA, 1501 bp, Oryza sativa
atgggtcaatacgttctgctaggggccgctgttgacgcgtgaactgaaaaggagttttcgggttacagccgagtatacataaacctacagggtcgcacgcttaatgggccggaagaaggggattggatggagatccaatatgagcttaattcgcatagggatccgaatagaagtcctatgggccttggaggcccgagtgatggatcctatatattcgtgaggggtgtgaccagcggaggcattgcatcacgtgagaaactctagccgtcacttccctccccgagcaaaaccctagccgcgcgcaggtgctagcacatctgtgtgtggcgttctgtctctgtatgtgtggataccagtagaggcaccgctggtttacggtgctgatcggcgtgggagtacggcgagaagaacgcacgaggaggagaaggtcgagccggtgcgattgactacttcctctacatcgacgcgcgctacttcgcgagagttccttctacttctcagcgtcttcttccgctgcgcagcgcatcgagtggtaacgatttatgatctaatacttgcatggttcctggtttacgcaatagaaaattttgatttatgctatcgtagcctacgcgtatcccaacagtggtatcagagccgccttgtatagtttatgatctagatcattgcatataattgatatgcaggtgtagtagatgagatctattatgttgtatatgagttcttaggtgatcggaacatgagatgagctaatagccgcatgggttgatgagatcaatcggtatgtgtgttggtgacttcactggaatgtctagtactcaccaaggccgagcgcgattgtgttcatcggatagtccgatgtccactggaaccacacgccaatgagaaaaacgagccaatgagattgactcggtttcggcataatttgattacgccgttaaggttttcacatagcgggaccgccgtgtgcattgccccttagatttcgcttggggctttatatctatcttactttattcctattatatatttgatatgacatggtaggatagattccctcagaaaaattatgtttaatttatgctcttccaataattgcacctattatggtttgccatagcaaagtgtcactttttatcatgataaaataggatagatgtcagacatctatatgcggagattattggtttacttgacaaagttatcaaaacagttttggaccttggggcataggttgggttggacatggagatatcaccccaacagcacaagagtcacatatgatgtgattagcaaggtgttggttacctattttgatagttgtctagttgtgatgccaaagctcattagacactaataaaatgaggatcttgactcactatgttactagagggaattttgtttcacaatacatagtggaagtatcttttgttaaattgtttaatgaaaggttaaatgtaaacatggtgctgattttgcatacatatatttctattgtaga

SEQ ID NO: 8700 - DNA, 1501 bp, Oryza sativa; identical to SEQ ID NO: 3159

SEQ ID NO: 8701 - DNA, 1422 bp, Oryza sativa
accaacgggcatctcgaccttgatgagagaggtaaaccggtagatttaaagctttatcgttctatgattggtagcttgctttaccttaccgcatctaggccggatatcatgtttagtgttagaatgtgtgctcagtttcaagccgctcctaaggagtgtcacttaatggccgtgaaaaggattctaagatatttaaagcattcctcaactactggcttgtggtacccaaaaggtgctaagtttaagctagttggctattccgattcggattatgccggttgcaaagtggatagaaagagcacatccggtagttgccaaatgcttggtagatcccttgtgtcatggtcatccaagaaacaaaactccgtagccctctctaccaccgatgcggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatatcgacatacaccatcacttcctaagagaccatgttgccaagtgacatagtcattagccacataagaaccgaggatcaactagccgacatctttaccaagcctcttgatgaaacccgcttttgcaaattgaggaatgagttaaatgtcgtagaattctccaatgtggcttgagatagtgcaccatggttgcttcttttgcatattgtatatttgctctcatttgctcttttgttttggatttgttgccatttggttcttcattgcgaaaatggagcatgtcacattaagggggagttttgcactcttgtatgtgctctacttccctttatatgtgagcaaatcaactagtggtgctagtagtattttcaaaatgcccaagtcaacataagtcaaaacttttgcaaaatcaatgtaatttgaaaactatctcttggaaaatatttcaaaaggtttcctatatgttttccaagcctcacattgcaagaaaaatgatttttgaatgaaaatgccagtttggccctcttttgaagaaactagattcttagttttggccaaaatgagatttatccccaaaatgagattgagaaggaatttgagaaaagtttcaaaacaaagttggtagagaagaagatttgaaatgtttttggtattcaaacctttttcaaaaaccaaatcattcaaaagttatttgaaaaccaatttggcccaaaaacccctatagaccataaaaggtcacctcctagcacttaagtgagttttgttgcaaatcatcgtaatcttcaaatattatgggtgtttagcaatatttaaactcacacatttcaaaaattgctccaaaaatcaattttttattgaattttattgtgtggagg

SEQ ID NO: 8702 - DNA, 1501 bp, Oryza sativa
tcgaagcggacgtctcaacgacggctctctttcccttcgcatcaatcagcggcgatgcaaccggctgacgcggaggactgccgaatactttcgccgcggccgtcacgattctttctgcagaggccgaagcctcagcggcggtactaccgcccgctctagcggcgccgagtggaggaacaggggcggccgaaagatccaagatgcggccagcgggcgaagtcggagtcccgtcagaggactcatcgtcgctaaaaacgcgagcgacatcgatgagtcctttcttcttagccaccttttttacaggacctcccttcgccgctgtgcccgaagagaatgcaaccagggccttcgccccctctaagtctttctggcgaaggggggagctattcgactccaccccggtctcgttatggccaggactcggagtgggggtatagccgggagtctcagcgcggcccccgactgcctcgcccgtggccttctcgaccacgatctccacctcctcttcttcccctcctcctcttcgccgtcatgttcttcggcatcctcctcgtcatcagcatcagagtccgacgaagcaggagccctacgcttcctaggggcaaacgttaaagttcacgctcccgaacaccgtcttcttcgttccagccggagtaaccagcgtcttcgagttcacggcggcaaagaatatggcgccgaagagggtagcgctgggttcgaacccggaagtccggcatgcccagtcgaagaccgagatcagaaccagcgccgacgggctcaactgtgggagttccacctagaagaggcgaaggatctccggcaacagcatgttgcatggaaaccgtagcccagcctcgaaaaagacagcaaaaaccaccgtccgattctctgcaggtttcggcaccacggctttccctggggcgaaagcctgcccctcaaccaacgccccagagctgaccagcttcgccagctcctcgtcgtccataagagagacccccaaaaaggaggtgttgtcgtcgacccggccagggtccggtccaaccgcctgaacagggtttggtttgcgaggggccatggcgaaaggtgtgtgggcggtggcggaacaagagggtaggcaaagcacctacgagttcaagagacacagcgaaaggaagtaacgggagaggagagcgcatgcagtaaaaatggcgagtgcggcggtgaaaaagaaaggggtgggaatatatagcccaccgggccgacgtttcgcctacccgccaatcataaggcgccacgtagcgcaagggtaggcgtaaaggtaaaatctcatcatccaaacagcacagtaaaaggcccaatactgttcccttccggcccggtacaaataagaatattttatttgcaggaacagtgtaggtttcggcagaagcatcggtcgaaagggggcgccacatacataccacatggtttgcacggtctcggccgaagctccactctcacccttgcctgtgaggggctcgga

SEQ ID NO: 8703 - DNA, 1192 bp, Oryza sativa
ggctgccagcccgagaagtagaaagggtggagggagaggaaaagaaggatgggccaaaagatggggatttcagcccgaaagaatggtaacttctaggaattttgtatggataaatttgaataggattcaaaggagatgaaaattaaaaagaaatagttgtggacttttgaactttggcaaagaaaattaaataggatttcaaggagatgaaaactaagggagtttgtttttggactctttggatgttgacaaagaattcaaatagggtttccaggatactaaagagaattggaaatttatattgaagcactcaaataggaaggaaaggaaatgtaaatggcatggtttatgattttggataaatttttatgaaggtggtaggaaatagatggaggaaaataaataggactttagccccaaaatcactttttgtacatgtgctttgattggctatttatgcgtgtatgtatcccactcatacaaaagtatgtggtagacacaaatgacaccagacggtataaattcggtgtgccctacagattcgtttggagccacatttgaaaatgatcaagcgacacagacatacaatgatttctttggacagtcagaatgaacgcgacatgaattcacaccgacaaaaaaacactaattcgatggcttgatggttacatcggggaatcagaactattatatatatatatatatatatctaccgaacgcatgcggccgaagcttaattcaatccaggacgatgctagaagcctataggaactgccagtgaaaactcatcgtcgtactgtaatatcgcattgttagacacgaagtcacttatctggaaagcattggttcaatcgactaactacacgttaaatgtgatcttctttattagttagatttagccatttttttcctcgtgtagttatgtgtgcattaatggtttagccaatttgtgaattcaccaccctctcggctaatggtctagtttttaccatcattttacaaacttattttttttctctgtccacatcgaatatagatcaaaatctatcgactctctcggctcgtacgccgtggcacgcctatatatagagcaaaatttatgttccaattaccttacaagtacacatcaaagaatcttggtataatcaacaagtactctcacgtagctcagtggcttagtagctacttaggg

SEQ ID NO: 8704 - DNA, 1501 bp, Oryza sativa
tactgcataaacacgtggtaacgtgtaattgtcgtgcaataacacttttacttttgtgcagacttttgtgcagtaacaagtatatggttagctctaagacttttaacccatatatttttgtttcaattcctaaattattgcaattcaccacaatattacggtcaaaagtgcaataacgtcatatacatgcagtaacactatattggagggaggagaccaatttttttgagaagagggaggaagaacggttcttgaggaggggagtacgtagatgcattttaaagtttaatcctccatatgcagtaacactatagcatcatggtggaaacggttttaaaaaataatacatatcttgtgagatattgcttttcaaatattgacattttgaactttagccctccacatgcagtaacagaatgtgtaatttatagtaacaagggtatatacatgcagtaacatggttttaccaaatgtataaaattgttcaaaacactcctacatcaatcagaccttgctcaaagccacctacaaactttacctatggctcacctattcgatcttcatctcgtaaaaatgacatagtaacactgcatttatcatgcagtaacatagctacttagaagtggtaacatgcacctattatgtagtaacacttctacttatgtgtagtaacaaatatatggttagcatgtgaggctttaacccatatatttttgtttcaattcctactttatgtagtaatactattcaagaaatgcaagacactttgttactgcaaagcttattgtctttactagactcttatagtaacgttgtgatagaactgtagtaacgtacagtagtaacaagtaatgctattgtattactacttgtggagagtcaaattccaaaaagaaaagcttttaagaacaatatctttgatgtcatgtatggttttttaaaattgtttgcaccatgatgctagaaaaaaatacttatcaaaagtagatccatcatgactatatttcaactatatttgagcgttgttactgcacgtaaaacatagtgttactacacggtgaccgtcgcgttactgcacagtttcgcgagacgagagctgagaagagatgggtggtgaggggagttagtaggcgggtttgactgagctttgaccggcgggaggggctgtgaccggcgtttgaccgcagtgagaggtggtttttgggccttgaaaagaatggggaggtgggtgtggcccttgagtgtgtgtatatatatatatatatatatatatatatatatatatatatgaagcctatatactactcccgagagtagctactcctgcaatagacatccaacacgtgtcccacttaccgggttcgggtcctgtatcactcaccaaaagcagaaagtattcactgacctataggcggcagaaattaaaataaaatattaaatttgaagttttgaaaaaaaaaatcaatcaactgcacgagctttatccggtgcattttctgca

SEQ ID NO: 8705 - DNA, 440 bp, Oryza sativa
ctttatgcctcctttatgctttattcagtttggatgccctctaggacagcatcccattcaaagttcagattttagactaggagggtgcagcaataggctagcagccagctatggctatatatatatgtatccaacctccctcgggtaggtatggcttttgtgtttagtgaatgaagaaaaccacaaaatcgccccatctcgagtgccatcctcttctcaatgagagtaaccattgaaattctaacagcactacgatttacaagctcaatttacagttccctgatccccattcaagtgcaaaccttatctgtaaatggctgtattttgaacttccatatgataccgttttcccatacagctttttcagaattagaagctttatattgatctgaaaacttccaaattgcatagactttgaacatcatttccttgatcacagg

SEQ ID NO: 8706 - DNA, 1501 bp, Oryza sativa
attctcctcaaaggattctatcttaaaatatatatatatatatatatatatatatatatatatatatatatatatatatatatatatatatatatatatatatataaaagagagagaggacggctcttcagtacacctaggtgtatgtactcctcctttttaatggattatccattagcaaatcactgcatgcatgtgcacagttgctcaccggatttggtgcacatttgaacgagagcgttggcatgcaattgctttcacccctcccctagaataactattctacacccccctctccctcaactcccgatccagcccagcccacccctccttccccccagtccccacgcgcgcccccctccctcccggtgaccccaccctgtcctggcgcgcgtcccctcctccctccattagctccctcccggttcccagcgaccccacggccccacccactcccggcgcgcgcgccttacctccttcctctcgatctctcgcccgatctctccttcctctcgatctctccctgatctctccctcctttttttcttctccctcccttctcttatttttcctcctattcttttcttttcttcttctccctcccttctcttatttttcctcctattcttttcttttttagaaaaaataaaaataaattgctgaattcaagactagaacccatgatctcatggttcataacaaactctcctaatcaattcaccttacaacactttgtgatttaagatcattgttttctttctctatatatctactcaaattttatgaacacaaacccgttatgttattgtaggaaatcataccttgttattatgattcggtagtaacattattgtagaactgcagtaacacgatacattactgtgaaaattataggccgttactgcaaaattcataggtcgttactgcactttttgcagtaacatcatgatgaaattgcagtaacagagaacatatggtatactactacagtaccactacttgcgcatagctaaatttttaaatctcaatcttatacaaaatacaagtgctaaaaaagtgtatttgcatggtcacaagttaacacaagtgctaaaagtacttctctttatccatacaaagatacaaagatacgtagtagcaagcttagtacaagtgaacttttagaattgaagtctttaaacaataatatctctcacatcgtaaattattttttagaaccgttttcaccataatgctttaaaatgatgttacaacgagacaatagtcctattactacacgatgatcgagacaaaaatgcttttataacgttgttactacggaaagtagtcgtgttactgcatattgatcgtcgcgttactacgccgttccaacgagacgagaactgaaaaaaagtaaatctcaatctttaaatagcaatatctctcacgttatatagtatttttctaatccatctgcactatgatgttcgtaaaaaaatacttaacaaaactagatccatca

SEQ ID NO: 8707 - DNA, 1501 bp, Oryza sativa
ctatcacgcccagaaattcacgaaccagaatttctgagctgaatgtgcattaaacccctgtccaggaccagcaagtgtacacaaacgataattgttgacatacagatccacgtcttacaagaatataaaagattacaaatgcagcggaaaaagtaaaagcgagctaagcctgaagacttgactcctgcagcgggcgactccattccacaggcaatccttgacagcagcaacaaaaccaacctcaacgagacagctccaactaggaagatcttcagctctggtgagggggaaaagagagcaagactgagtactacccactatactcagcaagtcataccggaagaggaggtatgatgcaggatatatccaagggaggctaaaggttcttttgcataaagctagcatttaaaagcagtagttgaaagcagtaaaacagttgtagtaattaatcaatattaaccaatcactgtccaacgctaccccacattgcaacaggcccaaccaatcacctgaactacaccagttcaattagctaactaggggtgagactaatcacggtgaatctggtcgaccgcccataaccgcgggcacggctattcgaatagttttactctgattagaggtgtacaactgtacccacaagacatgttcccgtgcgccgacatgccaccacgacataccggaaagaggccgtgacaggacccttcgcataaccccctctaaccgatcgcaccacaccacaaggttcgcccccgtcctcagcaggcaacgggcagcccccctctcgtgccacggtgaatccggaagccgatcaaccaaacaccccggccgacccaactccatcacgcccaccctaacctgggtacgtcggctagaggaaagctacacaacaagcccagccattgcccacgctggcttgtggtaagtacaataagttcttccagggcatcccgcgaaccggtccttaatcgccatgggcacgactagcaaaaccatgcacccacagcccaccatgtagtgtattttaattaactaacaccattgcggtggcactaatccaaagctatgccaataatcaaactctatgcattaatgtgttttcctcttttgtgtactagttgaactaagcatggctaagcatttcctaaaccaacatctaatcattttaatacccaagttatcaatggcatgaggtgaacaatatatggctgggtagtaggacccatcgcacatgatattgtaaaacaatgcaacatttaatagaaatgcgggacatttgtaaattgggaacaatatgatcaactgtaatgcatgacttgccttgttctcgcactgacgagatcacaacaacgtcttcgagggatcgcggatcgacaaaacggctgaaatctatgcgacaaacaaagcacacaagcaaaacaggctataagactactaaaaaaagaaaacaaaaccatttttaatggatttattctactttcacccctgctatcctagagaa

SEQ ID NO: 8708 - DNA, 1224 bp, Oryza sativa
agcgccttcatgccaatccgatttgggtgatcttggacttcgttgaaagcttatctcgctacctttcaaacacatccagtctcatgtccaaattcatctcgagtcaacgggaatcgccaaaataagacagtgctgttgctaaaaccgaacttgggccttgggccttgtaatagactaggcccatctcggaagtgtctccctccacctccacgaattagcaattaaccctagctttatttttctttataaatagctttgtacatcctaaaaccatttgggttttacttagttgaattttgccaagtgccattcaccttgtctctagtcctcgctcgattagtcggggactattgattcagagccccaaatagttggtgtgttgatttgccgggtcgattggatctaccacttcaatcgcaactattactttgtgcttaatcacctattcgcaatatttagattgcatcttatcttgttcttgcagtgttctctcgtttgcattgcagggatcatcaaccgcgtgtcacggttggtacgacatcgtttgtggtgtagcgattgcatggcgtcctggacttgttctggttggtagccacgtcgcaaacgtcgcactcgatcaaagcaagagttatcccctcatcagaagatcgggccaggagagagagcgtcatcagataattctcacaagataaatctagattactcaagaagaatattatattgaattcatagtaataaacagaataaaagaaataggagaagattaccgacaactccggaatccttccgacttcttctactctactctcttcctattctagtattaaatatagtacaatagagcctcttataattcaactcaagcttgaaagtgtgtgtgagagtgaatgaagtgaggtccttttataggacagttatgacggttgtgagaaggggaaatgtccgaactgccccgcaaccgtcattgggagaacgtctggagcgtccacgccaaaccccaggatcaacggcgatcagggaggtccggctggccaccgaattttttctaggcccgcaaaaacctattctaagcacaaaactgacaactatgcagggttttaagcatgcattagatgagatcatcatggttcataatcgattaattcaataacatccacttcttcgtcaacagtttcatttggctcaaggaaaatttttaagcgttgatcgtttaccttaaatatg

SEQ ID NO: 8709 - DNA, 1501 bp, Oryza sativa
ttatccccaccatgtgcggccgctgcgaaggaggagaagccagtggtggtgctgccaccagcggcggcgccaggggaggcgccctccgcggacgcggcagcgttcgtccgctcctgctgcgacaccgccctgcaggccgaccgcgacggctccagcttctgctactaccatctcctcccctacgctgccttcttcgagggcaaccaggtgaaggtcgccgaggtggccgccaccatcctgagcaccaacctctgggtctacgtcgaccaattgcgcaaggtccagggaggggccggcaagggggacccgaacctgaacgcctgcgtcgatgacttcagcgtagccgccggcgagaacatcaccagggaggcgctgcagagcctcggccgcctcgccgccgccggaaatggcaagcgcagcaaggaggatctggagaatgcgcaaaagtggatcaaaggggtggagaaaccctacaacggtgggatcgggaaagcatccggttgcgagataggttacctgttcacttatagcgatgatctccccgcccagaaaacccttggatatactttcgacacagctagctccctcatcaatcacataaagctttaataatctagctatatatatagccttccatgcatgctctctagctacctactaagtggaagtacattattttatttattatacttgttgttaattcccatgatcgattagtggtgttgtccacgatttttggtaacattgtttttctcaattttctatttcatatattcccaactctcaattctacattatatatcattttttcattcaacttcatacatacaattcctcagttctttcttatatataggccttacgctaaatttcttttggatacacaccaccgtcgattatatcgtgcatacttttgtatttcaattaattaattgtgatacttgcttcccacacattgatcgcatgcacgccacatttgtaacattgttatcaaatttcggaaataaatttatctatcgtgtgaattatttcagcttgcatgaatctttctttttattttaagcaacctttttctggtcaaaacaaactacacaaaaagatgacaaccaaaatatgttgatatattattaggagtatcctgattcacaccaatgctaaaacaaaaacataaaattacaatagaaaaatgtaagtaaacatcaaggctagagctaggcatttaatgctaaaaataaatgtcaatgtgtagctgtgtgaaccaaaatagaaaagagaaaacagatagttagttattgatcgtccttgttcctgtagagaaacttgtggagagtatgcgtaccgggtaccgacacggcctccatattcgactagagataggagtgggccggatccatctattatgtactagagtgggctgtctggcttgttttctactttgtaaccctgccccccaacctatataaggcgggcaatgagcccctacaagggcatcagcacggat

SEQ ID NO: 8710 - DNA, 744 bp, Oryza sativa
aaaaataaatccatccatgctttatatttaggaaattttatttcccacatttaacttcacttgttaattaatgtacatttaatataaattttaataataatttattaaataatttataaatcctaatacgaaaatcaggatgtgacaaagaccgctggaagaaatcacaagaagaaagatagggacttgactcctacaaatgaagggatccatcttacacgcagagtggagattatgggtagttgggtaccacatacccacatggcacgtatatccgactggttataggggataggttgtacagatagaatatagaatatgtttaggaaaggactcgggaattatgttaacttgtatgtcaaggaaatatccagtagtcctagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattcccccgctgtataaacctttgcctcctacgtcctaacctatccacttttccagcttgattgctaccccttttagtattgccagaatcttgttttgacagttggcgcgtcaggtaggggttgcaccatgtttttcgccgactagtgcgatgggattcgttccgggcatcaccgacttcgctttccctcccgggcaga

SEQ ID NO: 8711 - DNA, 1501 bp, Oryza sativa
ttgacagttggcgcgtcaggtaggggttgcaccatgtttttcgccgactagtgcgatgggattcgttccgggcatcaccgacttcgctttccctcccgggcagacgtgctggttcggcggcccatggacctcatcagccacccgtacatgcatgcaaagaagacatcgtacgacagatcaatccatgattataaatcaagctaataatattatatagattgtgaaagaagttcttctgtatatgtgcagaatgaaggatcccttaaagcaaattgtttttgattggttgcaagctttatagttttatttagttccttcgactgtaactttgtaaatattttttgagttatataaaattacactgctcggcaaagccctggcagtatttcaggtcaaaaaagatttcatatagattgaaacgacaaaccaatcgacgtcagagattagaatcatcgatctcattgagattgccctcgagcaaaaacaatgcctttgattcctgaagttgtttccatcgcacttcttgatggataattcgacgcttcccctacctgtcgcgccaactgtttaaactggaattcggcaacatgaaaaagagtatcgcacgagacataaaagtggatggatgcgaagacaagaatttagacaggttcaggccctctcgatgagaggtaaaaccctacacctgtttggggatttgtatccgccaggtggatattgatctgatgatctgattgtggttatccgtgctgatgcccttgtaggggctcattgcccgccttatataggttggggggcagggttacaaagtagaaaacaagccagacagcccactctagtacataatagatggatccggcccactcctatctctagtcgaatatggaggccgtgtcggtacccggtacgcatactctccacaagtttctctacaggaacaaggacgatcaataactaactatctgttttctcttttctattttggttcacacagctacacattgacatttatttttagcattaaatgcctagctctagccttgatgtttacttacatttttctattgtaattttatgtttttgttttagcattggtgtgaatcaggatactcctaataatatatcaacatattttggttgtcatctttttgtgtagtttgttttgaccagaaaaaggttgcttaaaataaaaagaaagattcatgcaagctgaaataattcacacgatagataaatttatttccgaaatttgataacaatgttacaaatgtggcgtgcatgcgatcaatgtgtgggaagcaagtatcacaattaattaattgaaatacaaaagtatgcacgatataatcgacggtggtgtgtatccaaaagaaatttagcgtaaggcctatatataagaaagaactgaggaattgtatgtatgaagttgaatgaaaaaatgatatataatgtagaattgagagttgggaatatatgaaatagaaaattgagaaaaacaatg

SEQ ID NO: 8712 - DNA, 1501 bp, Oryza sativa
tttctcggagtagcaaatcaaaaattttgtcagctttggtgatatcaaagtcatacttctcctctttcccgggactctttacccattggcatggtataaccttttttgctccttacccattcggctgcagctatttcagaatcatcttcttcgtcatccgacccatacatatatggacaaacgtgattaactttctttgagcttttcctgacttccgccgacctatgctcaagcaaggttaccttctgtatcagatgcgataagctatcgaagtcttcggatgaaaatttctccctgattggaggaatcataccctggaaggccaaatcggctaactgagcatcagtcagactcaagctaaagcacttgttccgcatctctctgaacctctgaatatactcgtgcacaggctcatcatgccgctgcttgatcgctgtcaggtcggataacttcatctcatggaccccactgtagaaatagctgtggaattgcttctccaaatcggcccaactattgatcgacccatatggcaaagaggaaaaccaagtaaaagctgatccggacagagataaccggaacaacctaactctcaaggtgtctacagccgatgcttcaccgcactgagcaaggaatcggctgatgtgctcataagtcgacacgccctcttgtctcgaaaacttggagaaatctagaactttaaaccgattgggaagaggaactctttcaaaccactcagggtaaggctgccaatacaaacttccagtttcttttggtttaagtccgaattgctccctcattacatcggcgatgtcacgtcctgataaattcatcccgaaataaaaatcattttctaaaaggaataatagaattaattaaaatttgaaaagaaattggcaaacactaaaatacgtacaagaaaatttcgaatgtggcccggagaatttttgttaaattctccttggtctaaaatgagccctcaaattttacttgaattttcagagcactggaaatatttattaagcaacaacaactatgatcaaagtttattaaaaagaaaacttaaaaataatcctccttcctcctttgggccaagcccagcccaaagtctccctctcctccctctctttccctcctctcccgggcctctcctcctcctcccggcccacctcttccctccccctcccggcccagctccctcccctcccctctctctcccgggcctgcctctccctcctctcctcctgggccgcctccgggcccaagccgagcggcgccctcccacccgtgccgcgcacgtgcgtgcgctgaccgcgcgcctggccgcgtggggcccacgcgccggtcgtcttcctcctcccgcacggcctcttctctctcccgtgcaaacctagcgccgttcctcctccaaatccgccccaatcaagccggctctttccaaattaattggggggttttaatccccattgattcctcttcaattccccccaatttcccccttgaa

SEQ ID NO: 8713 - DNA, 1297 bp, Oryza sativa
cggtgaccggaggcggcgaagccacgcgcgaccggcggcgcacgcggccggcggaggcggcgaagccggccgcgcggggccgctgacgcgacgaagccgcatacggccggcggaagcgcaaagtggccgcggctcgagccgctcgtggccggtggaggcggcggatgcgcacgcggcatcgctatacgttagccggcggaggagtccgagccgtgcgtcaggtgcggagctgcgcgtggccgcggaggcgacggaccgcacgcggtcgcgacgtcgactcggcggggtcgcgggcagccagtggagggtgtcggagactcggagccgcacgcgaccggcggagtcgcgcgtggcctcggaggtgatggagcctcgcgacgctccacgcattgccggaggaggcggcggagccgcggctcggcactgaggcggactgccgcgtcggccggagcttcgcagcgctcgcggagtagcgcgtggaggctgccgctcgctgcttgctacgggtttatgttagtgatatgtcctagaggcaatcataaagatgattgtatcacatactatgtttacatatttatccgacattattcctggaaatagataactcattattggttaatctatatgtgattctttcatgggactctttatgttgtttgttactatttctaaaggattctgatcaaatatcatatgtggaacaaatatgtttatatgatcagcatatatattaattgatgatcatgtctcatggatcatggtatagagataccaaattaataatatggacacatgttggtgaacatgttgttggatagacccaacatgagacactgcaagagccatatgtattgtgtcatcagtgatctcatttagtgttgctgttgaatccttagacctgagattatcatggttcacaacatgtgtagtacactggtggagaagtgctttttagtcccggtttgtaaccccccttagtcccggttttaaaaccggaactaccaatccgggactaaaaatcgctatctttagtcctggttcaaccgcgtaatctatctatctaatctctttctttttcgttcacgtccggttggtgttatcaaccgggactaaagaaagggaactttagtcccggttggtgagggaagcggcagtaagatggtccccttttctttttttttcttttttattttctcccgaattgagtgggatatatcccaaatcaaacccaaatccccaaatcaaagtaacatcccaaatcttaaagttacttatacatacaattcaaatatatcac

SEQ ID NO: 8714 - DNA, 1501 bp, Oryza sativa
ttcgtccggatttgctcccgcgatcctcgccggcgcatcaatggcggccgagatttccgcggccgattccttcccctccggccgctctctccccctcccgacgctatataatcgctccccgtgcctctctcctccgtttccgccactcgccgcactctctccccgtcggattcgagctcgcgccgttgtcctccctctccgccgtcgccgccgagctccggttcgccgccgtcgtcgccccggacctcctcccgcttcggcatcgcctccttcggcttcgccgcgttctcgtcgacctcgtccgctcctccgtttcgcccgccgaccgccggagcatcgccgtcctcgtcgacccgagccgcgccgccgcctctctccgcttcggtcgccgttcccgtcgtcgccgtcgacccggggtgagccgaggaccgccgcttcgcttccctcttctctccttctctctcggccgccgctccgccgtacctatggccgccgccggcgaccataggggcacgggcgcgccgcctcccgtcggctgtgccggcgtggccgccttcgggcgcgccccgcggctgccgtgtggggcccggctgtcagccgcccacgcccttaggtgcggctgacgcgtgggacccacggtgccggccggtgcgagcccgggtgcgcccggtccaccgtgggccgtggggctgccgcgtgggccccacccccgtggatccggcccgcgtgccccttccctcggctgacgcaataaatacattttaaattaaaaatttaaatgaagaaattcgcaaatattcatttaaagagcatataaacttcaaatggccataacttggccatttgaactcagaattggaccgttcaagtctctaatttttccttaagaagtcaagaacccatttttgtgctttgttcctgcttgttatatggagtttattagagtaaaagccttttttttctttccgttggtcgtctagacgctgcagctttggaagatccgctcttcgtggaggttgaagccgacgtttgggaaagcgagcaaggcaagtcacatcatccttgaacatattgaatcccattttataaaattattttgatttaaattattgcattatcgctttatttaaattcccgcgttatcactgttttattcagccatgcctatttacctttgttatgaccttattattattgctattgttattattattaccttgttcaccctagaataaacaaaactccaactagtgggcactccactcatggtaccactagtatgaatttaggtagatgcttcgctggttaattaggcaacattaggtggttttacaactttagactttgggaatattcatatcacctggacactatggaatggttggattattgtggaattggattcacacctccccctctattcaaaaccctcaaaatggttttaggctgggctcggggtgcatggttttgatggtagcacctcggccatataaggaccggt

SEQ ID NO: 8715 - DNA, 373 bp, Oryza sativa
tgggtaccacatacccacatggcacgtatatccgactggttataggtgatagcttgtacagatagaatatgtttaggaaatgactcgggaattatgttaacttgtatgtcaagaaaatatccaatagtgccagttagttacagttgtaatacatattcgttagcctagtacgtaagccatatgggctgtacattgtaatcttggctcctccccctatataaggtcgggtccaagtgtacctaggggcataacttttctcccagatcatcagatcaataatacactcggtggaataattccccggctgtataaacctttgcctcctacgtcctaacctatccacttttccagcttgattgctaccccttttagt

SEQ ID NO: 8716 - DNA, 1501 bp, Oryza sativa
aggcgctcaatgatgcaatggatgctggaacggtctcaagtacaaccgtcttggtcaggaacacgatgtcggctttgttggcgtcccacttgatatcgaagcccaacatcgaacacttggcgtgcgtctccttggaatagtcagtggtgggaattttggtggtgctggttgcaccattatcagctaccaacttcatggaggccatggcagtggcggcacatttgaccaccgcaaccacggtgagattgggctcgatgtcgggactagagcatttcgtcgaacatgtggtgggcgtcacctttgactgctctttcttaattgacgctggcaagtcttttgccttcttcccaacttccggtgtgcatgcttcaaccacatctatgagagaccgtatatcagctctagttctccgatcagcctcctctcgcctcagctcatactcctctattgtcacaccctgtagttctccaactaagcctaaaagtgaattaataagagaccctaagaaaataccggtgcaaagcaagagtaaaccctattaaatcaatgcaaacaataatcggaattggcatgtggaatttttcttgagttctacaagtcgaaattcactaacaggatttttagtggaattttgagagctctcgaaataattttaactatttaaaattgagcttgcaatattttaaatcccagggaaattcttttcctccttttcctcttcttgggccgtcggcccagtccaccccgccatgcgcgccctcctccttgtgggccgcccaagccgcccctccctctctccccgggacgccgacaggtgggccccacctgttggacccgtccccttcctccagccggcgccgccgcgcctgcaaccgccgccgcgcccacgcctccgccttctccgggccacgtcagccacgtccgcgcgtgcgccgcatctcccgcacccacttctcccctctcactcccatccgcgcccgcgccccgcgcccgagatggccgggattcgattttcgaatcccgcctctctctcctcccccactccccacgttggccggcgaaatcccgccccttccggccacatccggggctcccctcccctatttaggcttccccgtcaccccctctcgctttttccccatctcgccgaactccctcgtgctccccatcgctcccgcgccgtgcaaccacccgccaccgccgtttccgctactccggccgccgctagccgccgctagggtcgccgccgcgccgcgccgtcaccgccgtcgggttcgcgaggctaagctctaccccggccgctccttccccgtcgagtttcgtcgccggaattcgcaccccctcgcgctctggtgagttcaaccgctatcgccgccttcggccatgaatgccggtcgccgtggttcatctccctctctctaatctctctctcttccttccttagggcaccccgaaacccgtccgccggttgccgtcgtcctcccgtggcttgcagccgccg

SEQ ID NO: 8717 - DNA, 1501 bp, Oryza sativa
tagacgatattacactagtggagaagtgctttttagtcccggttcgcaacccccctatagtcccggttttcaaaccgggactaccaatctatctttagtcccggttcaaatacccgggactaaacatcgatatttagtttcggttagtaacaccaaccgagactaaagagagggttggggcagtgagatggtcccctttttctttttttttctttttcattttctcccaaatcaaacccccaatccaaaactcaaagtaacatctcaaatctacatcacaaatcaaagttacttatacacacaaattaaatacatcacaaatcctataaaaattacaaacaaatcaaatacatcgcagatccatacaaatatgcaatgaatcacaaaattattcatccaaaagtacatcagtgaaatcacaaataattaaaaaaaacaatacgggctgccgctgccgccggccgcctgcccgccgctgctgtgcgcggcccaccggccgccaccagcggccccgccggccgcctgcccgccgccgaggggcgcggcctcaccggccgccgcacggccgcctcgctccgccaccgccgcacggccgtcaccgcccgaccggctcccggatggccgccgcctcccgtccgccgcacggccgcctgtcgcgcggccacctcgctccgccgcccgaccggctgccgcacggccgccgccacccatccaccgcacgggcgcctgctgtgcggccggctacctccgtcgccgccgcccggcccgcagcagagaggagaagaatcggaggaggcggggaggggaatcggaggagaggggaagggggaggaaggggagatgaaggagaggaggctggtataccgaggaattaaacaatggaaaaggagagggagtcttaaaatgaaggagagaaaaaaggggaggggtaccgggtaccgaggagagggtagcggcatgcgcgcggctcggcagttcattttttgtcccggtttgtataaacaaccgggactaaaaatagatctttagtcccggttgtttataccaactgggactaaagataattggagcttgactccacccaccaacttctttgaaccgggactaaaaatgatctttagtaccaattgagactaaagatcaaaaattttttaactgggactaaaaatgatctttagtcccggtttttattgcatccgggactattgtggaatttggtcgaccgaccaaagatggtttctccaccagtgttaagatgaagcaagctaatgtaaaggtataaaataacggatccataaatttaaatatagtgctacatgagattacacagtgccacgtgatgacctaagagcgcttatggaagcaccatgtgactatatttatagagtaataaattttattttttatagtatagaagatcttattttaaaaagaccgtctattttttttccgatggttataacatcgtacatatattttcctttaaggctttatagcattt

SEQ ID NO: 8718 - DNA, 1438 bp, Oryza sativa
aattgtatttttatacggactcgaaactctacttttaattttattatgtttattccgaattttagttagttttaaattcctatatggactctatactatacttctaatattcattattttttaattccgaatttctattttttttcataattgtatttctatatgggctctataatctacttctaatattccttatttttaattccgaatttctattatttcctaattgtaatttctattatttcctaattgtatttctatatggactctatactctacttctaatattccttattccttatttttaattccgaatttcaattatttcctaattgtatttctatatggactctagtatgctcttctaatatttcttattttttaattcccaatttcaattatttctaaattgtatttctatatggactctagtctcttcttctaatattccttatttttaattccgaatttcaactatttctaaattgtatttctatatggactctgctttttctttttctccgattaatgtgagaatttctaggacgcgactacacgtcggtcgcccgatggagagcaggggaaatcaggcgctgacgtcagcatgacatcagcgcccgatttacgtgcaaaactattttaaactgatttttctcttaaattacttatccaaatcatgatccgattgtaccattaaattcgttgcaattaaatcttcaaaacaagaccacacatggatatattctgacggaattttttttaacttattattgaattatttttaaatgtttcacgatgttacaccaggtataccggaattgtttcactaagtagatcgaaaatgtttcactcggttaaatcaggtgttgtttcaccttatataaaaacaatatttcagcaaatagcgaaataatatttcagttcactacaacattagatatatacatagtgaaacattgtgagtacactaggtgaaacatttttcggtggaacaaaaaataaaccaaatttccttaatagggggttccaaaatatgtgggttattttgttgcaatggaatgtttcgttcactgcaacattagatctatacatagtgaaacattgtgagtacattaggtgaaacatttttggtgcaacaaaaaataaaccaaattcccttaatagagggtttacaaaatatgtgtttgatttgttgcaggtgggggcaggtaatgtggtggggcctaacaatatcactgcgcgcgggggcggggccgcgggggagcgcccgatctttttgctcccccgtcggtcgaccgacgaagagcattatcggaatttctaggccatgaaagcgaacgtagaggctcttttttctattcctttaataataggaaaaaatacgaattaccccacccccgaacttttgcggtcgtccgaattaccccccccccccgaa

SEQ ID NO: 8719 - DNA, 249 bp, Oryza sativa
atagtctatagagcaaaaacgagacaatgcatgagagagttatagatactcatgtagccatactattgtggtggtttactattaatctagtctattgctaagatgtatatgttttatagatagcaccttactttaccattgcgggtgctcttaaggtaggagacgacgagcacattcgtgagagcggagaaccccagcctcgccatgggttttgtcgattcgctagccgctcaaactcctccccctaga

SEQ ID NO: 8720 - DNA, 1501 bp, Oryza sativa
tgttagttgtagagaaaaatggtatttatacccttagtggttattgtatttttgcccctatttttttttccagattgtgtgattctgtacctattgactattgtgtgaccgtgactgtgagaggaggaagctaagccagattcgggcgcttcttctatgtgtgcctgtgtggtgagagaggccgaggctcccgatgcaacggcatggctgagaggcggtggatcggaggtcttgctggcagccgccgggatggaggagttgctcttcgtcgccgtccgcatgtcttcacgctgcctcaccagatctggcggcaacacgaaccggcgccaccggatcctctctatgctccaaccatgccatatctgcatggcggcaatacgagggagaggacggagacggcggcgccagaggtcttgccgggggcggtagggatggaggatgcgccgccgctggatccccttctcttttctctcgacatgcgctttggctctttgccaccgcgtgaaagccctgcagccgccgcccccaccgcgtggaagccccgccggagcgccgcgcacgcccgcccgtccttgctgccgctggcgcgcgcgcctacatgtcctcaacggcgctgccgcgccgcgtgcccgccctcgccgccgctgccctgccacgcgccgccgataggttaggatttcaggttgggaggagagggattcaatccctatccattcacttagggtacaagggtaaattaatattttataaaacctttttttaatttttttatttctttaacacaaaacgtgggacccactaaacggctgttagaagtgggggtaaacgacttgttcagatttaaaaagtgtgaataaaactgtaaaccctaaaatttacgggtaaaacagtagttaggtttaaaagtaagggcatagatgtaattgttcaaaaagaaaaatgaaaacgaaaatgaatcaacttgtgatgggccagacacaggtgctacttctacccatgaggccatgacgaaatgacgattgacatgatgaacaacctttggttactccaaggggctactactagatcttccaggaattctaggtagcaatggggtgtgtcccccagccccactacttgagaattgatatttgcaatctggttgttattaaaatcgggattaaaaatcaaactaattggactgtaaatcaacagaattgatcgatgccacgcataattgaagaccacgatgcacggctcgatcctagccattaatgaatatagaaaatgctagaatgacttatattgtaaaacggaggaagtatattatatatatcttccatatcctatagtttcttatttccttcatttcacaatgtaagttattatagcattttttatatttatatttgatgttaatgaatctattctggaacggatggagtactattttgttatactggtacttagcatgctattgggttcaaatatcattccgctagggatctaatcagctactaga

SEQ ID NO: 8721 - DNA, 1501 bp, Oryza sativa
tagactggcaggaggaggagaagccgaggctgcagaaggagatcgacacgtgggccctggtttttatttcttttcttgggactgattgtgggttttgctattttttatatatttttttctaattgttatgccacgtagataccacatcagatgaataccaagtcagtgcaccacttgggtgccacgtccgccgaaatcgctatccaaaattgccttgagattatttgtcctagttttggaaatagaggaatgtgttatacctgattttatacttgaggaatgtgatccaaacttgaccctcagataagggaccaaagatgatttcaaatcgaaagtcattatcaacgagtccgcatttgccagtacggtatatatattttacactaaagttacttcaagaaagtaccatttacgctatatgctgaaacacaccatgaaagtaatatttagttctatatcatgacggaattacttacccaagtgacaacaaatctactactactgtatagtaccttagggcagatgtcagcatctgaaagaagatatcacacgatacttttaactagagaaagagacaacggagatagaagattgttgctgtgtgagttgattatatattgtctaaatataacatgaaaagattatgtgacatcttttcttactattttcaaaaaaaaatatgtgtgcgcactgtacatgccacataactttaaatagtcgcgaaattgcctcctaataaactcttaaagaaagaaacaatgactagcaacatctctgacaatcctattaaaaacatccacatatacgtgatatttatgagcaccaaggacttcatcactacactactggcgctttctaaggttgtccgaactattattcatgctctggtacgtgcctttttttagatacaatggaacaaacatatagtatcaaatacacgtcgggaaccaacaatttgacaatgaaaacaacatgattttgttccttgtaggaaaaaaaagagctagcagcacgaagtgaatgtaagtcaactgattaggttttttatgatggaacaagcccaccaagttacaaattttagatttgacatcgatactctatttacggctaattattttttagcggtagatggcgtatctctcgacaatgatgtgtcgactttatcaaaatatacctcctcagtcttttagaagtgctcatatgtgttgtgagtgcacttgtactgtctttcgaaggaaaaaaggagctagcagcattttattttcgctcgatattgtgtgcagtacctcaagaaattacaggtgcaattctattagcaagtacaagtaaaagatttggagtactagagttgctaagcaggcccaaagagtccaagtaagcactctccaaggcccaaggataggcccacagcccaaaccaagatacgaatatatttcagggtgctatttgcaaatttcttccactctattcatccctccaacactaacctcgacggcggcgg

SEQ ID NO: 8722 - DNA, 1501 bp, Oryza sativa
gacggaaaagttggaagtttgtgtgtgtaaaaaagttcgatttgacggaaaagttaaaaatttaaagaaaaatgttggaatttaaacatggaagttgctataagattcggattttatcttcatttctgttagcatatttttcaaattactagacggtgtgttctgtaaaaaaacattctatatataagttgctttgaaatatcaaatatatctatttatcaaattattataattaaaacttaattaatcatgcgtcaacacctttctcattttacgtgcgcgaacctaacctttctcattctacatgagccaacttaatcatcaacttcatcggtttcaaacaccacggtgtacaaattgcaaattagacacctgatatttgtgagtatgacacgtgggacccaggtccattaaccagtggcacgtgtactgcccattttctccgcatcgctaggtgggtccggtggttcagcatcaatggttaattaactgtcaccgctttcttaccgtcactagctataggacaagtggctaagctaacctaagcacgacaataattaactagatttttcacaatttggagcttttaaaatactttttttttgcaaataaacccctgaaaaaacttgtcctaaaaattgtctatttggacgccagagtcgctggtgccgtcctcttgtcccccacccctcctagaaaaattttaattagtgtagaggagagagatgtacaacttttttttatctttttgatatatttttacacttaggagcacataacaaccaaccatagaaaatagacgaaatatgtaacttgtagaattttttaaagctctgtcgaaaagtttctcgcctcgaaaacacaatcttacaagcggaatttggagattataatttcatcgaacacggatgtaactttttctgtagatgtccgtggttatattattttcctgattctgagtatgaaaaaattgcgcctgttttaagaaatgacacccaaatataactaataaaatacaaaccctaacttttttataggatgtaaaagatgtaaaaaaaaggctcaagagtgttcgaaatctaatctaccttttttttactatatgaaaaaccaaaacgaagagcagggagagagcgcggggagtgggggggggacttttcagcagagctttgtaaaattctacaagtcacatattttatccatttaagtttaatttttctatggttggttcttgtgtgctcctaagtgtgaaaaaaaaatatcaaaagaaaatgagagaaagaaaattggggtgggggaggggggcggcgccaaccacattggcgcgctccccctgccacctcagcgccgccccgccacagtggaaggaggctggcgccagtgactctggcgtcaaaaaatgattattttttggataagtttttttagtgactatttgcgaaataagttttttaaaaggactaaattgtgaaaaatccagcaataattaatggagaagggg

SEQ ID NO: 8723 - DNA, 1501 bp, Oryza sativa
acgacaccttgttgttagatagagtaataataagaaataatggccctcttttaaagactactccctccatcccaaaaagaaacaaaccctggatttccgtgtccaacgtttgactgtccgtcttatatgaaattttttttataattagtattttcattgttgttaaatgataaaacatgattaatactttatgcgtgactcatctttttaatttttttcatattttttttaaataaaacagatggacaaactggacacgaaaacccagggtttcaaataagacgcatgcatgacgttcgaatatgtaactggttccagacttccagctccagccaaccacttgtcgctcacgtccgtccgtgccggttgtttgcttaatactccatcgatcgtcccagtccgaccgatcgcgcgagcaaagcctcctcctctccctgcggcgctgcatgcacgcccgtgtggggcacgaccactgcgtgcatgttacccggcggccggccagcttgccgtgctggccggccgcgtaccctagctgcttgtgagcccgtctcgagcgcgtatgagtagcggttgcttgaccgaccaatcaagtttatgtggaaacacgggggatgtttagaaggtatagttgctccaagtttcgtgcagctataggtgtcaaaatttaaggagggatgccccgatacatacgcgcatgcttatgcatgagaattttttttccttgtattgcatctaattaatactcaatccgtttctaaatgtttgacaccgttaactttttagcacacgcttgaccgttcgtcttagtcaaaaaatttatgaaatatgtaaaactatatgtatacataaaagtatatttaacaatgaattaaatgatatgaaaagaattaataattacttaattttttaataagacgaatagtaaaacatgtttaaaaaaaatcaacggcgttaaatattaaatatttagaaacggagggagtaactcgtaatattcctccggtctcgactctcgaactcccaatcctattttgtatactgctagtgacgttttccgactcggccgtgcaggttcgggtcccaaaccgaactcgattcgttgtacatgcatgcacgtatgccggtgataggttacacggtttgatcgatcgatcacgtcgtcggccgcgcgcgctcgtatatattggatcgatgtggtgatagccttgcttggattagtggcgtcctccggccggccgctgtctcgttatatgcaccgggatatgtccgactcgtcgtacaaccgacgtactggccgggacaaaatgtccgactcgaactcgagcacatagcttgcagccctgcttggttccggcctagcccatggtctcaggcagaagactctcagcctatacttggatactagctagtgacgtttttcgtctcggccatgcaggggttcgggtcccaaaccgaactcgattctttgtacatgcatgttgggtcgatgtggccatctctc

SEQ ID NO: 8724 - DNA, 1501 bp, Oryza sativa
aatttctcgcacccgtagtcgcggccgaattgcccgcccggccgccgctgcagtgccccgcctgatacgtacttagattggacgcgcgcgcccctttttacaggtgtcgcttgcatttgggccaggtgcatcgtacgcacgcacgttacgttagtgctatccgtcgacacgaccgcttggactcccacgttaacttggactaccgtatatatatacacctcttccgatgatccgttcctataaggatctgtttggactttggaaagtattagattttgaaaagcgaatggtgtgaatccagctgataagaatcggaataattaagttaccaatttcttgcttctactttattttctgaattatgctgatatagctggttataatatggacaaaatgctgaattgtttggcagaaattttaattctgagagaaaattgagctgtccgaaacctcccaaacaaactctgagattgtttagcaaaaattaagattgaggtaaaagattctcccttggtcacctccttaattaaattttaaattgctcgattggattagcttgaaaatgtttggatttaatttccgtgtgtaatagtgaatactacgggaatctttatattgtgcataaatgcttatatttaagaacggagaaaatactgagggatcgatcatccaataaatcaagtcatggtcatcataatgcaatgtctcaacattgaccacaatttcagtatatatacttctctcttggttgatattacttatcgttctgaacaaacctattgtcaaacctgaaaaaactttaactataaaatataaaatagttatattagaaatataatgaccatatgtatagattggtcctaaaaactacttcaacaaaatcatatagttattgatatttctattatactataatgaaaaatagttatcaaagttactttttaagatcatgtcattgattgttcaaagcgataattattatcaaaccggtggggagcagtagattgttaattcatccctgaccaggggctaagtttgtgcggtcataaatgccaaaagtgcagggttagttagcgggggtgtcactgtcacggtaagaagtaatcacaatcgacatgtgacacaattaatccatctattgagaaccttctgatcatcaggatcgttcgtgtgaaccatccacatagccagctagtttggaccaatcgattcggcagtataaattgcagtgcttgacacgagaaattctgtcaaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgc

SEQ ID NO: 8725 - DNA, 1501 bp, Oryza sativa
ttgaagtttggatccaaactttggatctaaacacaaacttagttgcttctccgactttgcttacacacgtacgaacctccagtacaaaagtcaacaagaagacggcgtaaataatttttttaaaaaaccaacgatttagctcgctgcatgcgtacgcctgacggcctgaacgctaattaatcacgactgcgagaagtaaacaagatcctttcattttcttttcttttcccggttttttcttccccgcccccggacaagggccttctagccatttgtgttgtataaataaaactagtataataacccacgcaaattgcacggctagcataattatattctctcatataatagcatatatattttctcaatgtattattcaaatatattaaaatgataacataattttaaattttgtactaactttacaaaactactaatgtgtaatattcatattgtattttatatacgtgttagttattaattatttttaatatcaaattttagttatttgtaaattatattcctatatggactctagactcgtctttcaatatttcttttttaaaattccgaaattttcgttatctgtaaattatatttctatataaactctaggctcttctactaatattatttatttttaattttgaatttttattgtttccaattgtatctctatgtggactctaaacacatctttcaatattctttaatttttaatttcgaattcagttacttataaattgtattcctatattaactttagactcttcttcccctttttttaaaattttgaattttagttatttgtaaatagtatttttacatgaactctaaactctacttttaattttattatgtttatttcgaattttagttagttttaatttcttatatggactctatgctctacttctaatattccttatttttaattctgaatttctattattttttaattatatttctatatggactctatgctctacttctaatattcctggtttttaatcctgaatttctattatttcttaattgtatttctatatggactctattctcctcttctaatattccttattttattaattccaaatttcaaccatttctaattgtatttctatatggactctgttttcctttttctccgattaatatgagattttctaggtcgtgagagcgaacgtggaggctcctttttctattcctttaataagttaatagattcttctagccgtttgtttgtgttgtataaataaattttttctttcttttaatatattggcgtataattttttttgcgcgtttgtgaaagaagtattcaagatagagtatattttgccaggtcacatcgagatcggagtcaaatcctccggccacatcgatcgattaacgaccttaattccgatcgatcaagctaagatcgatcgttgtctctgtttgcggtggccaccgccggccaagtcgccggagatgagatgagagattatccagtccagtt

SEQ ID NO: 8726 - DNA, 1501 bp, Oryza sativa
ttaatttaaataatgtcaaacccttccctgttcaagcaaatatcctggaaatttctcgtagacgtggttttagcatacatgcaatcaaacttcaaaaatatataactatattaagaaaatatttatatatgatatgtaaaaattatattaataaaatcataatgaagaaaaatactctcacaattatattttcaataaatctcgtagataaaaatgattgattagaaagagtttcgatcacaactataaattttttagatgtttttaggggaaattcatgtgctgccgttatgaatttataatatatacttcgaaaaataaattttctaaaaaaatcacgaggataaaatttagtaaggtcagaaacttttttttaaaacatagtgtaaatgtaaacgctcacaacacgcacatactcacatttatgaatacacatatgcataacctacccctataaatatctccgaaagacctggttggcttataaatatctccgaaatttgacacatactcacatttatgaatacacatatgcataacatacgctcgctatgggtatcactgaatgaatagttagccgtaaatagaaacacatgtgtcaaatttagaacttgaatccaggtgagctagttccaccgcaaggaagctaactcattgagctacgctcacttcacggtaatgtcaaaaatatgggtgcgtgggctaaattacgtgaacctgtgtcaaatttgatttgacatgtgtatgtgggataaattacgtatgtgctgactctgacttgggctatatattgatgcaaagtttaacgatagaaaggccatggacaaccttggtggcaccgccaaacttatatattgccacgaatcgttcttctacattagcaatgacaaaatattattgcgaatgatccttgatagtaccaacggttcccagtatttgttgctatatctaagactcgttgcaatgattcaggtcgttgcaatacctaagacagctttgcaaaaatatcgtttcgtgttgctatatacaagagattcattttgcgacactacagttttgagttggaataacatagactcttttgcaacacatgatgtaactaataacaatgatttatattcattgtgacatggacaactcttgcaaccattataaaagcgccataatcacgtcgccctaattacaaagcaaatatatttgttgtgatatatctgacttattgcaacatgcgttgtatatattgcaacgttgcgatatatctcacgacgacggtgtgggttttgcgaggtgtggatgcagcggtgggcgacagcagatgactgcggcagggaggaccgacggcattgggcttcaggccatgggggatctggcgctggagagagcttgccgagcgaagatccgacggtcgggatcgatctagggtttccagaatgcttttttgataaaataaaatgcaccaaaaaatctttttgtgtgtcgtgtgtcgtaacgtgcccgctta

SEQ ID NO: 8727 - DNA, 1501 bp, Oryza sativa
ttctgttagcctctagtttcatgggaacttctatctgcaatttttgcagtagcgtgaatgcatttgctgaaacctcttcctggttacatccaatcatcaaataaatcattgccatagtcttttggggaattcgttgtgtaactttgtaagcaacgattgaacacaaaaagtgtactgagacttgcgtgcgggtgcgccacccacatgaatcaattttgctttgcttcaatttgctgcatatatgaatctgtacaagcctggctgcctggatcgaggccatggcggcagcagccttgtggcttgaggaggcggcctctatcggcgctctgcttgaagtaaacttccccggccaagtaacacggcgctgccggcgttcgagggcagtcgagagaagtctgggctctcgatttgggccgcagctggtgcctgatggacgctggacgtcgtttccggtagcgtccacggttggccgctatttgtgagagcgtccatacctggacgctgttagagatagcgtccttcctattttgtttaatagaagtaaacatttactaattatttaatttgatgattaatatttattataaataaaaaattggggacggagaaaagtaggcgaagagacgggacgtgagacagagagagagatgggtgggcagggggccgggatggataagaacgtgcggctcgggtcggttttacagggtatcggttttttagaaaaccggcacctataagatattataggtatctttttttttaaaataccatcacctattcctgttaccacaaaaatactagttcctaggtaggccccgcgccaactaaaaggtaccgaattttcaataaaaaccaccatctttctctgacaccagtataggtgcatgttctttttaaaaaccaacacctttttgatgataaaggtgccggttctttggattttggcgggcagatgggctcgtgggtggggaaaggcgctataggtaccgattttacctactctggcacctatagtgctgacagcgaattgatgttttgcagtagtgagatgttgtgtgtatatgggaggtaggatcaggtattattggtgtattatatatttatagataactattactccctccgttacagaatatatatagttttagagttggaaacggttattaagaaagtaggtagaattaaataagaaggggttgtgattggttgagaagtagagataggtaggaaaagtgaatggtggagggttgtgattgattgtaaagagaatgttggtggagaagctgttatattttagaacaaatcctaagtgctaaaagttattatattttaggatggagggagtatatgaattggctacaatattggttataaatgattttgagctagtaattgactatacataattaaacttgctatgatgaacccaaaacaaggttcattgttttgatacacccaatatacaactgatcactgaccaatcagtaataaaccaatgaac

SEQ ID NO: 8728 - DNA, 789 bp, Oryza sativa
gttgacagctgctcaaagtagcaaaagtgatctcctatgtatatacaaaaaatacaacttctcctgtagactaagttaaacaatctatgcatataacacaatttccaaataagtaatagcacagcagtatgttaatcttctccaaatggtaatatggaaaaatggattcagaccaagtaatctggttttctgaatatctcatttggcaaggcatgggaaaaaaacaaaacctagaaaacacaatcttataaatgttcttccagacaaaatcataggttgtagttttgtacaagcagttaagcgctacagacatgcaagtatatgcatgttatgtcaacttgtgaagtgtaagccttcaacagcagcctaatcttactttttttttctgcaattaaatttactattcctaattaaatcaatcactcctttgtattttaggatagaattccgggctattttaggatagaattgactcacaatggatccgtggtccctaaaagtattgaaaacataggttgatgggtatatatatttattctgaaccatatagaaaaagattttacgggtgtgtttactccatactaaaattggaagtttgtttgaaattagaacgatgtgacggaaaagttggaagtttgtgagtgtaggaaagttttgatgtgatggaaaagttagaagtttgaagaaaaagtttggaactaaacaagggccagaacaaggtagtaggtgcgtgagtcgggtcacatgcgaggaggagcagggacgtgaagcgtgagtggcacgaagaga

SEQ ID NO: 8729 - DNA, 1501 bp, Oryza sativa
aaacgagcaggaaatagcactgttgctggtgatgcttaactaatttaggaagagattatgcacggctcaagaaaagtatatggatacaaataccattgtccgaaacatggaacttcttcctttcggtactggaatctaagcatcagggcatgtagaaaatgcgccatgccctctcatagcatcttcatgcaaggtgctactccctctattccaaaatataacaacttttagcacttagaatttatccaaaatataacaatttttccaccaataaaattacaatcctccaccatttacttttcccacctacctccattactcattcaatcacaactctccaccactcactttacctactttcttagtaaccgtgtccaacctactttcttagtaaccgtgtccaacgctaaaatttcttatattctggaacggaggaagtattacataataaaagtatccttataaatatcctcttctccaatttagaagttcgttcatataccttacggatttcctactaaagcagcatatgtctacgagccccatcgtttaccctaaaaagaataacccaaaatcaaaatttaaatttgaaaacttaattttaagatattctcaacgtaatttctctttccatattggtttttatattgctaagaatacatataaaaatcttacacataaattattatctttttctaataatctattacaacctataataagcttttaggtaaccgatgagacccgaaatgttaaaatcaggtaattgttcgttctggaaaaagatcagctaattgcaaaaagtaaaaataaaataaaatgcagagccgacccaaacagtaacgggctaaagtccacgaagatgtgggggcggcccaattcccgacgccaaaacccttcttctcacccaccaccagtagactgatcgccgcctcctgattcccgaagctctcaacctcaccgctacgccggccgctggcgtcgtcgcgctcttctcgccccggcccgcgcgaccagacaagcacagcggccagcggccgccaccgccagccaagccaagccaaagcaggcatgggctccctcttcatcaggttccaagaggtacacacgctttctctcttcgccgtctacatccccccgcaaaccatcacctccggatcccgatctgctccttgcgcgagcgagagaagcgccgtggatccggttaacacgcggatttcttttttgtttatgcttgtggaatctggtggcattttgattgtaactaggctgtgggcaatctagtttgtatagttgcaagtcattgttttacctctgttgcgctctccgtcgtccctgcctttctttcgtagaatttcttcactttcttgtgttgattcgggtgatgtgtgcttgacttcggcacactctttctaatgccgactcaaatgactaaatgaatgcagtgcttgtcccatcgaacaacattatgatattcattttgtcggtactttttttttgt

SEQ ID NO: 8730 - DNA, 1501 bp, Oryza sativa
tcctccaccaaatccaccgcatcccgtgctccgtttgcaaaattagttgaggggaaatatttctcttatcctcctctatcatttcctccaagaatcggactttatcccgaagaaatcaacgcggaatcgaattcgttttcgagtttatctctgcaactaaccctcggtttttccggctcaaatcctctcggttggagtccgatctcttcaatccaagcctataaatagcatcccctagtcgtcctcttccgtttgccccaagtcctgagctccctcgtcgcccgtagcgccgccgccacgttgccctagccgccgccgtcgtcggtgaccttccagccgcgtcgcgccgccgcggtagccgtgtccgttgccagccgtcgccgccgttgggtgcgcacggaggaggggaaccccggcctccccttcgcagccgccgaagaccgccggagcgccgtcgccattgttgacccgagccgagccgccgtcgaacctcgtcgccggccgtcgttcgtcgtcgtcagtcgttgttctttgcaccggtgagttcgcgttgttctcctctacgcgtaggtaccctccaaaagtccggccgagtcttctagcgccggcgaggtcgtcgctgatgtcgagtcgacattgatgatgtcagcgatgacgtcattaatccctttttcttagttttctctattagatgaaaatcgattaaacttcggaaattcataactaaatcatcgtaactcggattcgagtggttcaagttgctaaatttttctaaaatcaagatctacatgttaaaaatatccacatgtactgtttttgcttgtttttgtactgttttgttgattttgttctttcattttagtttccgaagttccgaagagagcgttttcgttgaggaaggttcggaagtgtttgcggaagctcaaggcaagtcacacagatcccaaacaaccctttgagcatgttgaacccatttaaagctattgttttatttcaacttatgcattattttcgaatgtcatcgggtggtgagcctttcccaattaattaatggccgaagatgactttattttcctatgggttataatttgattagctagaaccttatatattggtttgggttcagctaaatgctatatatatataattacttagccatgcttagaaacattagcacatgattgggataactaatattacactatcacttatggttatatttaatggtagctcacgatggtcaatcgtgattggttaattaattattgccaattaaaatttgtcaatggtgggttgtgagcacatggttgtgaaggtcgtgctcatggcaattaagaaccggttcgcgagctactgttgtgaaacattaaccgtgccaaccacaagccagcgtgggcaacggctttaccttttgtatagcatgattcattgcggggcactagactgagaagcggcgagaagtccgtgtgggtcgctggggagtccatgtctctggttatat

SEQ ID NO: 8731 - DNA, 1501 bp, Oryza sativa
acctgcggagcagcttggtcagcggcaaggacatggccggctgcagcaacggcccggtccgcgaggtcagcacgacagacggggcaggtgacatgcgcggcgagccacacgtcgatgcaggcggtgtggaacacatggcagcacccggggaggaggcagagcttctcgccgtcgtccacaaactcggcgaggcagaccgcgcactcgagcgccccatgcccggccttcaccgccctcgctgtcgcgtacgtcgagccccacgtgcctcctccgatgttccccaccgacgacgcgaacggccgcgctggcgtgcacagcaccgcccccacggcaacgatgcgcggcagtggtggcctcggagcagcgtgggcaatggagaggaggaggatgacgtgggcgacgaatgcgtagtgacgccccatcggaggcgccacactccgtctgcctcgcattgaacaaatagcagagagaggaagagaaaaaagaacaagagagagaaaagaataaggaagaataaagaaaaaaatattcgaagggtagaaccgtacttacacagctgtttctctctccaattccttcggatataataaaataatcccgccagtgtccagcagttaattaccacatttttgcagtatctacgagaaaattcacgttctttggctgtctcacagcaaaggtcataaatattgagtgtcatgtagcaaattttgccaatgacatttgaactagcacctaccgcttacatgttattaatttgtttattccaacatattgtaacaaagcaaaagattaattttatagtcactgcagccatctttaactattggttaacaatttattcattaagtcacttatagcggcgaaccgtgacataatatgagtgtgtcacaatcaactgattactctaatcttatgaatcattaccattgggaatgttcagcgaaaatataccgcaaaacatttgcatatgaaggatttgctcaccattgttgccatgttggctgctcatttccaaacattgttggaagagagcttgaggctgctcctccatgtgagtgaatttgatcattcattttgctatttcacagttctatgtgtacccaccagatagagttcgactgttctcaaaagatgatgtactactctacattaaagaaatgaagatttctgaatttgatacagatggacaatgcaacacaagtatatgtttcttgttggaactatttctcttatttgaatagtaataattattccctccgtcttaaaatgtatcaacaaagtaccagattagatatattgtattactataaatctagtcatagagtctgtccagatttatattactagaatatgtctaattaagtactaggttgctatatattaggatagaaggagtgtcgactagatgatttctcactttgcagtactaatgtttggatagtttcctaaatgaaattatagttgattgatttgtagattcttgcaattctggaattta

SEQ ID NO: 8732 - DNA, 1385 bp, Oryza sativa
tttttttttcctggaaaaatgggcatcttatgttcatagtgaaaggaaattggttcaggccggccagtggctgatttacctgagagatcttgcaatatgaacgtccaaaccaatcgaaatttgcttagaattgattagaatggttaatttgccgcgatcaatatttgaatagatcaattactggtcatgatttggatgtgtatatccttcgtggatatagagaccggattaatgaaaatctattttctaaaaaaaaattactggtcagggacctgattgatgatcagtgaatgagacgaggtcttggctgtgatttctcctcctggctgaatataaattatttaacagacgtggatgagatgtattatccattcttccttagtgtgatgctattaagattcatttgtttgctcgcattattgatagcaaacaagcgtacttcgccggatttgagttttgtttatgctaggtcaacatgatatggcgttgatattttgcatgcatcattgcagcgacttgtatctagtttatactaccccattatatctacttacctagtgctctttttgttgtggggatagagactaagtcaactcagaaagtaaggtttattattaactggaatctggattaggcatgatgcaactataagtgtccaatgatattttgccatttggccagcaactgatggagagttgagggtaccagtctggtgaaactggtggaccgaattaatatctatcgcccatgtatttactatttagcctatggtttgacttatccatttgctcatatgaaatacggagtattttacaaggatatgaaaagattgcaacttagaaaaggtataggtaacatttttacaacttgtaaaggtattgtgaaaaatcacagaaaacgccttttggtgcaagcaaaaccggctgcacggaatctcagccgttggatagtcacgtggacggaagcagattggcctttcgggaaggaataagtcgactctaactccctcaatataggtccgatttaatttgtatcctcgactgcaatactagatatgttgatccccaactacttaaaaactggtgtagtttggctttctggactgttttgacagtggttttcattggtcgattggcgtggctagttaacttggtcaaaatagtcgagtcaccatgtggggcccacatgtcaatgtttcctcctctcttaatatggttttaacagttggagtcattatatttgattttgccgttgagggatagatccgatgtatatttaagggactcaatgcagacttattcctttcgggagtactagtacatgcgcttgggcctgggctaagtgcttttcaattgggtattggaccatatttctggcccaatagg

SEQ ID NO: 8733 - DNA, 245 bp, Oryza sativa
tttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatcca

SEQ ID NO: 8734 - DNA, 1501 bp, Oryza sativa
tagctttaaattcctatatggactctatactctacttctaatattccttatttttaattccgaatttccattatttcctaattgtatttctatatggactctatactctacttctaatattccttatttttttaattccgaatttcagttatttataaattatatttctatatggactctagtcttttttattctgaattttaactatttctaaattatatttctatatggactctgtttttctttttcttcgattaatatgagaatttctaggccgtgagagcgaacgtggatgcttcattttctattcctttaataagttaataaattagttttgttaatggaatatgtttaatactccaaatattcgatgtgacatagattaaagtttagtctctgatccaaaattccaaacaccctctaagtacctcttgatgtcttgatggccatcaatgaatgaatagatgaatgatgtagttgtagtaataaactccatgaagtacgtgctccgtgacaagtagtgacaaacaaatgcagaatggggacgtggttgaaggtagaaaacagggtctagttgttgtagtaaaatctgaagccccgtgaaacgtttgttagtacggtggtgacgtggcgtgggtccaacgaggagggagcacgcacggtgagggagaaagtgatgaagttgcggttggtcagcgtcgtcacgagctggcttaagagaaagtgacgcaactgagtacagagtattacctccatctcaaaaaaaagtgcagtcatagggaaccccgtgtccgacgtttgaccgttcgttttatttaaaaaatttatgaaaaatttgaaaaaaaaatagtcacacataaagtactattcatgttttatcatttaataacaataaaaatactaatcataaaaaaatttcaaataagatgaatggtcaaaagttaaacataaacagtgcaaaactgcatttattttgagacagagggactaaaactttatagacggagatgacggtccatgcaagttatgaatgctgaaaagcaagagagaaggaggaggaagaccctctgtgagagcagaattcattaatttttcattaataatataaggaggtggaaagttgataagagaagtcttgtgtcggttgttggtcgggacgggaggaaggttcgtggcggcggcggcgtcgaatgagcgcaggacacggccgccccagaaatcgcccgtcaacctcccctctcgtgtcgcaagccgcagcacacaacggcgaccgtgcgcgcgcgcgtccccacgcggaggggaatggtggcgtccgacgcggagacacgcgggggaggggaagggaaccacgcgcaaacccaacgccctacgagactgtagtcgacgatgatttgataatacagcacggcagagcagagcaatgccaaagtcatggtctcctcctcctcctccccccaatccaaacccccaaaaccaaagccaaaacccctctcgccaccga

SEQ ID NO: 8735 - DNA, 697 bp, Oryza sativa
ggtaataaggacaatgaggttaggacagcaaagatccactactgctcagtacagttgcaggtagaaaacaaagcgatcgaccaaccaaaccaaaccaacaaacaaaccaattaagctagctctgatgatgaatgatgatgattcccccgtgagattgctacctccatttgctaaagccaatcccaccgagatcgcttcttcaccggcgctagctaccgtcgccatcacctcctcctccgacgcgccaagagagacccgtgctttcttgctgcgtggtatatacaattgcacacttgctcgagcaatttattagtaggagtagtgtcgcttcgtcctcactctcactctcctccactgagctaagcttagcttagcttagcttctcctccccgcttcttcttcttgcccatcccactcgccggccgccgccaaccggagaggaggcaagaacggtggtgcgacaatgcagccgttgcggccgagcccggcggcgggcgggtgggcgggggtcgccggggtggggcccaccaccgtcgacgaggcctccatggagcggagcaagagcttcgtcaaggcactgcaggtgcgtgcccgcattccatcccagatccctcgcgctcacaagaatgtctcgtttccttcgcttaattttgtccatggatccggccggttcttggtttgtggtggtggtgatgcc

SEQ ID NO: 8736 - DNA, 215 bp, Oryza sativa
aggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccccgccagc

SEQ ID NO: 8737 - DNA, 1064 bp, Oryza sativa
tctggcagtatgccagtattaccaaacattgtataatgcaaccaaaggttgcgaaggaagttgtggacgttgagggattaacgcatgagttctagcagtatgccagtattacctgcaggctccggtctcagctagatgccataactgaaagtatttattatagctaaataacacaagatttggagggagagatgtccctctaaacagccggacgtcataactgaaagtatttatagttaattaacactgggttttgtagatttagagggagagatgtcacttcaaacattttttaaaaataaattatgaacatgttggagattgaatacagaataaaaccacacacccattgtcattgcactattaagtgtatctcaaagttgtacgcacggagagtggcgtaattctaataaccagatttatttgcacttaacagtatatttgtagttttacgcacggagagtggcgtaattctaataaccaaatttatttgcacttgacagcagaagttttgtaggtatttttgtcaagccatccatgagatttcatttgaacgaagtaattctaagtcatgagatcatctattaaaacttctcaattcaagtttctcaatataatgctcgtgtttctgaatgcctcataagatttctcaatatagtggttcataagttctctcaatgttgtgcgtgatgtaataccgatataaatagttttgcttgatctactgaatcacaaaaccatttgccatttttagcattttccatttgtattctatacagtgaacacattcctcgagcctgagcctgaatttgaacgcagcagcgcttttccaaaaaataaataaataaataaataaataaataaataaattgaacgcagcagtgccaatcaacactactgaatctgaaccgaatgaattcacaccggttacactataaaatacaagtacatttcttttaccattaccgttgctacaaacaaacaccacaataaattcagacaaaattttctgacacactttgcaaaatcggcagcctcttggcacacacatctttctttgcaga

SEQ ID NO: 8738 - DNA, 359 bp, Oryza sativa
ttatataatgtggacatcatatatgatcgacctacagaagttgcattgtcctgtttccttcatataagttctgtgcatgtatttgtacagtgtaacctatttcagaacaatgatcaattgccaaattatgtgaacaaggctagaacgttgagaaatgacaatgacgtgactatgtaagtatcaagctgacttatttttcgaatagtaagaaccaatcaattagttgatgcattcaagcaaataatatccaaggagatgtcactatatatacgtgtacatcagcgaatgacctattcttttaggtctcgtcaccaatctagtagtaataatcagttcaaggatcacgcatgctctgcagg

SEQ ID NO: 8739 - DNA, 1501 bp, Oryza sativa; identical to SEQ ID NO: 4270

SEQ ID NO: 8740 - DNA, 1501 bp, Oryza sativa
ctctggatctacatactaatgacgtactccctccatcctataatataagacgcacacgtatttaaagatttagcatttaaaatatttcactaacacttagtataatactcccttcatctctaaatgtttgacgtcattggtttttttaaacatggttggtcattcgtcttatttaaaaattttaagtaattattaattcttttcctatcatttgattcattgttaaatatacttttatgtatacatatagttttacatatttcagaaaagtttttgaataagacgaacagtcaaacatgtttaaaaaagtcaacgacatcaaatatttagggacgaatggagtataaaataaattttatttgttaaaaattatatcagattgatatttaaatttactttcatatggttatagttttgtggctaggaaccttatagtacatggaaaattataggttaaagattagttttggagaccgtgtcaattttgaccgcgtcttatattatgggataaagggagtagcatgtattttttagctcgtgatttttacagcggtaataaacaaatttacccatgtaaaatagatccttgccatacatattgcaacgtcatgcagttatatatgaccatatgaggatttgggccccgaaaccctgatgctagttcaggcaacccatgacggccggccgagccaaggcttcagaaaccattatgagaaaagaaatcaaaggatatatatgattatcttattgcggggccaatctgaatctactccaatatgactttatttaatcttcagtttaattgctctggcaatcatgaccgcgactctaccgacatgctcagactgatcgcccaggctttgaaagctgaggaacttcaaaaatggagcgcgagaaaattgcattatgcatataaacagttctaaactctgaatactattgctctgctttccccagctgaagcacaatcacagaacaacagcgtagcattgctgtgcatctaaactactcattccgtctcaaaatacaataacttctctttgaatttgttctaaaatataacaacttcttcaccagcattctctttccaaccaatcacaaacctccatcattcactttttccatctacctccatcttaataactgtgcataactctaaaatttcttatattatgagatggatagagtagtaagcagaaagttaccacatttgtttctcattttgattgcttcaccgaacaccgaacgagagatcatgcagaaaatcgcaagatcaggagaaagctcgtgtgctaaaaagaattattaggagaggcttatcgtgtcaccgcgagaggataggaacgacacacacggacgtacatatccctgtatcaatgcgcctttcttgacgagaaatctgcaagagcaacagcgcagcagcacacggtagctgtacgtacgcaggccaagccgtcgtacacgtaacacgtccagtagccctcgatctcactctcccagg

SEQ ID NO: 8741 - DNA, 545 bp, Oryza sativa
acttgcactccccgccgttgaacagtcggagtgtaaactttaaagagcgttgagcgagctgtaaaaattagcaagtgacggggaagtaaagtacccacggtacggtagctgaggagacacaaaatgtcttcggatgcctgaaccttacagcagtgcgcagttgtgcttgtgcaccaactcgtgtgagtccttttggtgcctgaccacgagtaaggtgttttagtttttcttaatttaagggagtagctatatttgtgacgtcatatttttcatcaaaaaataattagcatgtatttacattgtaagtccctaaattacatatgtaaatttagtgtatttataatgtaagtttcaaaattacatatgtaagtctaaaaattacacagtaattatatgtgtaagtggtgtgtaagtgggatttaagtggggtgtaaatttgtataaagtatagtatgcatgcgtgtaaaaccttgaactaatgaagacgttaagctttaattaatcaattaatcatgttgacagcctcaacgttagcctgccatagc

SEQ ID NO: 8742 - DNA, 380 bp, Oryza sativa
ttaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatgattcatt

SEQ ID NO: 8743 - DNA, 1501 bp, Oryza sativa
tccctatttttccctctctctctctcgcattcaaatggccggatttgctcccgcaaatctcgccggcgccattgatggcggccgcacctcccacgccggtttccttccccgccggccgccctctctcccttccaaccctatttaaaccctccccgcaactctctcgcccgtttccgccacttgccgcaccttctccccgccggaaacgagctcgcgccgtcgccctctctctcctccgtcgccgacgacctccggccggccctctccgctcaccgggaccatctcccgcctcggcatcgccttctccggcttcgccgcaccgccgccgaccccgtccaccacctcgccgagctcgccgaccgccggaacgccgtcgtccccatccacccgagccgcgccgccggctttctccggttcgggcggcttctttgtcatccccgtcgacccggggtgagccgtggaccaccgcctcttttcccccttcccttcccctctctcggccgccgctatcccgtgcctatggccgccgccggcgaccataggggcgcgggcgccgcctccgggcgccccgtgtgcccccccagtggggcccgaccgtcacccgcccgcgccctagggtgcggctcacgcgcggggcccacggccccgcccggtgtgagcccgggtacgcccggtccaccgtggaccgtgatgctgccgcgtgggccccactcccgtggacccggtccgcgcgccctcacacctcggctgacgcaataaaccctttttaaattaaaatttaaatgcagaaattcgtaaatattcatttaaagagcagataaacttcaattggccataacttggccatttgaactcggaattggaccgttcaagtctctaatttttccttaagaagtcaagaacctatttgtgtgctttgttcttgcttgttatatggagtttattagagtaaaagccttttttcctttccgttggtcgtgtagacgctgcagcttcagaagatccgctccacgtggaggttgaagccgatgtttgggaaagcgagcaaggcaagtcacatcatctttgaacatattggatcccagtttgtgaaattattttgatttaaattaatgcattaccgctttatttaaattcccgcgttatcactattttatttagccatgcctatttgcctttgttatgaccttattattattgttattgtgattattaccttgttcaccctagaataaacaaaaccccaactagtgggtactctattcatggtaccactagtatgaatttaggtagatgcttcgctgtttaattaggcaacattaggtggttttataactctagactttgggaatattcatatcacttggacattatggaatggttggattattgtggaattggatgcacaccttcccctctattcaaaaccctcaaaatggttttaggctgggctcggggtgcatggttttgatagtagcacctcggccatataaggaccggt

SEQ ID NO: 8744 - DNA, 1501 bp, Oryza sativa
ctggagcaaagctatcggctcaactgctcaaggactggttctgcagtttctatgaaggcttccaaagagatgctcgagtctggtttccatatgaggactcagtaaactttgatctcccatcggacttcagatttgaagacatcaactctgaaaattccaaaaatccagagaagtcttctcggctgccattagtccatgcatccttcctgttggcattcaccaagggagaaacatacaagtatcttaggagttataccatccaatgagctcggccagacaatttggaatgggatagttgccgatcggcttgttctttgccgataagatccagtgcagaggagaaatctgatcaacattgatgatggatcggctgctcaatatcctaggaccccctttgggtagtattgataacatagagctggcaaggttcaggagcaggaactttgaaagatggtggggtgaatggaagcaacatatattccatcagctagcctctatgtatatgacagatctattcccagatattgttcctcaggtatatcgttactctgtcaattctgttgtaataaaagttagccgatttgtacctttaactaatctcttcgtttattttgcagacaatagaatcttctcctcctcgcaaaagcaacagtggcagagatatagaatatgtcctaggccttctaccaaatggaggtggactagctcctcctgtcattggctatcatgcccccaggaccacaagtctgcttcaagagcaaatgagagaaccacccgatattcgtaagaagagaaaaaccaaggcatcggctattgatccatcggctctggctcccaagaagaagaccaagaagaataaacccaagccagccgatgacctgcctactttagatccatctattgagcaagcctgggatgaagaagagatcgaagaagatgtttgtcacaccctgaagttctcctcccaagccaaaaatttaatttataaatgaccctaagaaaatgccggcgcaaatcaagagaaaaccctaagaaagtaatacaaataataatcgaatctgacatgtggaatttttcttgagttctacatgtcgaaattcactaacaggatttttagtggaattttcagagccctagaaataattttgaccaattaaaattgagcataagcaatatttaaatccctggaaattcctttcttcctttttctttttccttttcccttagtgggccgccggcccacttcccctcctctctccccgcgccttgctgggccggccggaggccacgccccagctcaacccgcgccccctcctctcgcccggggtcaccgacaggtggggcccacctgtcggacccgtctcccacctcgccgccgcgcccgcaaccgccgccgcgcgcacgcctccgcctcctccgggccacgtcggccacgcccgcgcgtgcgccgcgtctcccgcgcccactcccctctccctcccgcccgcgcccgcgcccgaga

SEQ ID NO: 8745 - DNA, 850 bp, Oryza sativa
tctgggctgcctactcaaaggcagaatttttccaagccaatctcattgtcatccaaagtactactgccaatgaactgacaaaagaattgatgaaccaaagcagtgacatacttctagacaaacaacttaggcgaactgagagagctcccatggttatagcatatggaaactgatcctacaataaataaaataatttacattgtaatataagaaaccaacttttctgctacttgaggtttagaaactgaccttgaaaccacggttctggtttgatccacctgaacatctcacggttatccataagtacaaggcaaatatgagtagatggctaattcgctatggagcaaaataatactggaagactggaggttaccttttgttgtttgcatgtaatgatatatgtgacacagaagacctcaagaaaagtttctatgtacggataagggctatggcttataaacatgttcatgttttttttccggtttgcaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaatgttttccctaagtaggcctacacttccagttgtaagaaggattcaaactaaagaaaaaccacccttccatttgtattcatgctttaaaattgtaaaatttatcttatattcttttctttttaccaatgctttcatacagtttggggatagacggtggagatgagacgaacatgggttgggagacgccgcagcaa

SEQ ID NO: 8746 - DNA, 1501 bp, Oryza sativa
gcgccctcgtcgccgtggccaccgccgcgcaccggagcggcgccacggggaccgggtacgccggcgccctcttcctcttggcccccgccggcggggacaccggcggcactacgctgggccgcccccgcttccgcgcccggcacggcctgctctgcagctggcagagcacgcggttcgtcgccgccaccgccgcagcaccgtcaccaccacccgtcacccccgccgccgccgccggcagcacgggcttgggcgcgatgggcctgaacctcgccatgatctcgttggccttcacggccatgtccaccggctgcaccatggccatggcgagacgtacaccggacgaacgaacgaacggtacgctcgctctcgcaggtggtgaacggatgcgttggggcccgagtggtggggtggtggggttaagaaggcgtgggcggccaatcggatgcgcgcaggggggaggggcacgtgggagggcggggcggggtacgtgggcgaccgcgcggggacgcggccgacacgtaggcggagcggagtcgcgggccgcgcgctccggtggattccagccagcagcgcgaggcgtatggtggggtgaggtgaggcgaggtcgcgtactcgcgttgcgctgcatgcggcgtccgcccccctcgggcgcatcgtcccccgtggcgcgttccgccgcggtcactggctggctggcgtgccccgcgtgacggcgtgaggcctcattggcagaaggccgtgtggcgcttttgcgctcgcctccaccaaccggctcgcttgtactctagcaccacggtaagtttagcgtataggcggacaccgggacacaccactttacctttttttttttttgtttttcactaccagatcgaatgatcaatctgcgtcaaaactgctttttggtcataccttgccgtgcatgcatgcatgtacactccgactccggtggtgtactcatgctttcgagattacttctcagctgaggtacatattgtttcagccagcacaaaaccgcctaaaagttgatatatccgcacgtggttttgctggtcatgtatggtctacgagactatacatgcatgtacatacaaaatctcggagggaaaccagacgatgcaatgtaaaccacgacgacaaacgctttgctatctttccgatgaattaaaagctggtgacgacggtctccagcacgtggcacacatcaagaccgggcgaacgcttgcttacgtcgctcgtcgggactagatgcatgcaccatccgtttcctatagccaaagccggagtttcttcgcctggacgaggagcaaaatttatcaaagttcatatcgaaaaaaatttacagaagacggtgcccgatgaagtgagaagctttttacaccggtgaaatttcccaaacccaaacataaatcgactggatatgtaaaacactgtggatctaactcttctgttccaaaaagtacgcggctcgacggtaaatgctctactgtgacgacctgtccgc

SEQ ID NO: 8747 - DNA, 1150 bp, Oryza sativa
taaatggtttgaaatttatagtgtggtaggaagtggagaaagggggagatgtgtgcgtgttaggggagggacgggcgtgctaatcgcccaaggcgatcacccgtccattaggcttacccgttcccagttcctactcagaccttttctaaaatataaaaatagtttttttggactacaaaagttctttttttctttacaagtatggtaaatgcaaatgctaacaacttgcgcacactgttatagaaccggcctagaaatcacatcgataaccgaacatgtaaaaaacatcataggagatccaaacacgataatgacactgaggtacgatatttgttaacgagatttaatcgaagcctacaacctaagggcgttgattacgaatgctcctcccagatcaaacataattataacatattagagttataaggacccttgatttgatgtcatcggcagccgctccctctcacatatactaagttgtaatgcggtttataacagatgtatctctctatttaaaagagagcttaggatagagtccaactctaactttacctacacctattacaaactcctagtcctacattgtaatcgactacgtacacatattcgatacaaactctaacatacacacacctccctataaatatacgcgtacaccctatcactatgaacacctcaaaaagactgaattgtcacatctcaagatcggcaaagtcatcaatgatgtttcggtgttgatgagtgtgccgtctattactgaaagaataattagccgtaaatgcgagcacctcaagtctataacttgaaccgaatatattgattcccccacaagttatttaaccagttgctacgctcacttcaaaataaacttttgattacatggcaaagacatagcacaccactacacacgctgaaaagcagaataattatacggagtactacgaccttttattttgactacaaaaaatacccatacgttacaacgtgtgaagattattttaatcttattattgttatataatttagttaaggtgaaattcaccgtgagaattcacttggatatatatatatatatgtatgtatatatatatatgtatatatgtatatatgtatatgtgtatatatgtatatatatatatatatatgtata

SEQ ID NO: 8748 - DNA, 477 bp, Oryza sativa
ttttcggctttttttctccttctttttctgctttttttaagatgtacgtatgcaaagtttatattcgtatatataccaaattttgtatttgtacgcatataaagtttgtattcgtgttattttctctcggtatatatataggtggtttgtatacacgtatgcaaaaattgtatacatgtatactttttatatgtcaatttttggtacacataaaaattatatatacgtatgtatatactttatatacgtatgtataaattttgtattgtatatgtcgacgtttgatgttgcaattccggtatttgtataggatggagatcgttggtactaggatatatacgagagtgaggtaaaagagacggagacatgatttttatacaggttaggaccccttaattggcaggtaataaccctacatcctgttgaccgaagccggtcgttgctcttattcatcataatcacaccagtacaatattt

SEQ ID NO: 8749 - DNA, 398 bp, Oryza sativa
ttgtagcgtagcgcagcgtgggagtactacactgcactgcatcgcgcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccacc

SEQ ID NO: 8750 - DNA, 438 bp, Oryza sativa
ttcctgcagcccagacacgacaattcaaatgctcttatagaatttcatttccttttgtcaacaaactgtactaatcttgtgggttaaatgcaatatgttagctacaatcggtactttgcctggcccctggtagcttacatttgcaagtttctgttcagacttttctggtgcagttcgtttttgtcaaagtaattaacttcatctgcatgcttgctaaggcctgcagctatgcctgtttcgttaagaaagctcatatcttgaattgcaaaatattaaaacctttgctggagccataattcttcaaagttatatatctatatatcccgcagcaacgtgcggggtatcaactagtttttttaatatctgtgactaccttaaaaatgcttacatttgagacgaaggaagtaatcaacaattaattctttcttttttttaaga

SEQ ID NO: 8751 - DNA, 607 bp, Oryza sativa
attcctgcagcccgattaaattttcttctttccttttaaaaaaccgtgtaaaattcgtacatttcaagatgaacccaacaatctacagacctacacaaacaggagtgtggattgagaaagaaaggtaggagtattccatgatcacagcatataggttattgatgtgctactttcgacatccacatccatcagtatacctgtatacgcagacatgcatccgacaagatcaatatcgcttattgattgtattcaggactcctattaaaaagccttgaaaccatgagcaagatcgatcgacaaatggcatacgaacaacttcagaattggcaccggtgcactttccacgctgtcccacaccgcccttctaggtagtacaatcagatggtgtgggcagctgcctcttccaatcagatggtgatgacaagcatcaaatgcgagtgtttctatgatcccccaagacagatgaacgtactttttagcgtttaatcgacagataaatacgcctcgatgcttttggatggtagtacaaagacgggtgattttaccgtgttccttcttggcgaatttaaccgtttttgatcgaaatatagctgaaaaggaacgaaga

SEQ ID NO: 8752 - DNA, 558 bp, Oryza sativa
cgattaaaaggagggatgtcaagatatgccggcccagtctttcggaggtgctcataggggtagggtgtgcgtgtgtgcattcataggggtgagtgtgcgcacgttgtgagcgcctatatttgtactgtgtttctaaaaaaaaaggagggatgtcaggcaggccgtaaagcaaacaagtaaggcggttgctgggatttctagaaagtaaaaaaaaataaaccccattgataatcatattcgatttttaaaatctcaatggcaataaaaaggagaagcagcgggcggggtgtataagagtatagttgcagagccgccgacggttaatgagacttctagaaaataaaaaatgaattccaacgatagttatgttcgatttttagaatcacaatgacaataaagagtaggcggcggacgggctatagaggggcataatggcatcgtttgatgggacttctaaaaattataaaaaataaaactacaagtctaatttttaaaggttcggaacttccaaaaagtaaaaaaaacccaatgataattatattcgatttaaaatctcaa

SEQ ID NO: 8753 - DNA, 754 bp, Oryza sativa
tctccttctttatttgcttgctcaatctactattatttctatttattcttcttggaacctttaaaaattagattttatagtttttagagtttattgtcacgttgagtttcgtatttataatttctagatgttccgtcaaacgttgccattatactcctctacggcccatccattgtttcttctctttattgtcattgagattttaaaaatcgaacataattatcgtttgggttcattttttactttctagaagtcccgccaaactgtcagcggctttgccattgtactcctctacggctcgtccgctgcctcccttctttattgtcattgagattttaaatcgaatataattatcattgggttttttttactttttggaagttccgaacctttaaaaattagacttgtagttttattttttataatttttagaagtcccatcaaacgatgccattatgcccctctatagcccgtccgccgcctactctttattgtcattgtgattctaaaaatcgaacataactatcgttggaattcattttttattttctagaagtctcattaaccgtcggcggctctgcaactatactcttatacaccccgcccgctgcttctcctttttattgccattgagattttaaaaatcgaatatgattatcaatggggtttatttttttttactttctagaaatcccagcaaccgccttacttgtttgctttacggcctgcctgacatccctcctttttttttaga

SEQ ID NO: 8754 - DNA, 162 bp, Oryza sativa
attcctgcagcccaacagttagtaacggagcttgagcatagaccacgtggcatggtcgactgctcagcatataatatagacatactatagtggtatatatatacctccctcatatatatattaagctttcttatgtgatgattagtctaagagaaaaaaaaa

SEQ ID NO: 8755 - DNA, 1281 bp, Oryza sativa
ccgtgccactccatcgccgcgcctcccattgcaagccgcgcgcgcgtgccgtggtggccgaccgcccggttgccgccgccgtcagcctctgcacgcgcctgtcgccagtgtcgccgctccgctccaaaccgccccgccgtcatcgccgtcgtcatcgcccggccccgccactccgcgcgcaagccgccaagggacggaggcagcatccctcctccctctgccgcgtcgcccccgctcacctcctcctttttcccgaatcggcaaaggggcaagccccctttctccccctccttttcccctttttcctcctcgccggcgtcatcctccctgttgccgccttggccgcgaccgccgagcgccagctcgcgcccttgaccgcgcaagtcggttcccaaaccgacattgccgcccatttaaaccccagcctcccctttcccttcctcttccattcgcctccgtgccattgccgccgctcccgtgctctgtctcgcctccgccgtccatcgccaagcgccgggagagccggtgcgttcgtggacgcggaaggggactccgggcgcgccctcttcttcctcttcctcggcccgaggccggagagatcactcccgcgccgtcggcctctcgtcaccgcgcccgtcccgcacggtagtgcctccctccgttcttcctcctcgctccatctcccctccttagctttcggtagtagctcgagtagcctccccgaagttagccggcgccgccccgaccgttgccgtcgctcgccgtgtgctcgccgccgtcgccgcccgagctcggaagcgccgctcgtcgccggcctcgctcggcgtagttccgcccaatccgacgctagcatcggattcccgtaaccgcgtagatgctctcgccgccgggaattagcccctagtgacctcgtcgccgttccccccttctcccgccgccggttgccgccgccgcaatccgccgccgtcgagcaacccccggcaaatccgagccgttggttcgtctcccctcatcacgaacaaccgcccggtgtgctagcttttgcccgtatcgccgtagttcgctccgccgctcgccgccgccgcccgctgtccattcgcggccgggtcgtcgtctacctctcgccggcccgcgtggcagccacgtaggcgccacatcggcgccagctcagcctaaaccgggtcgagccgaccccggtcagtccctccccgtgcgcgcgttccaccgcgagccgtgaggctgcgcgtgggcccgccgcacctgcgtccaccgcgaaccgcg

SEQ ID NO: 8756 - DNA, 1501 bp, Oryza sativa
cgtgagtgcgtcgagcagcctggaagggccagtaggtgatgatggcggcggcgacgcaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtggaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagct

SEQ ID NO: 8757 - DNA, 1026 bp, Oryza sativa
tgggaactgaagctggcgttcactgccatctacaattttgaaagagggagaaaagatcagtaaccattttagaaacaaactattgaaaataaggaaaccaaaagaagccttagcttttcgcaagtagttttgaaccgagtatccttagggtcgtcctaagcatcgggtttcgccctagggccaagcctgtgctctgataccatctcttgtcacgccccgaactagtcccgagcggaactagcccgtgacgctccaaattaacctattaaccgataccagtcccaggaaatagtgctagtatcacaggaagacagaatatcacagcaacagaggtctctttattatagagtaggagtacagtcatgttgggctgcggatagatcccgagctcacaactgcattacaaaagggaaacggaagccagacttggaccaaacatcacaggcgcgacttgggaactaggccgaaaccctaaaactcatcgtagccggcttgctcctggaagaactcctcgtcagcgggatccgcttcatcttcttcagcaactgggggggagttatttatatagagcaagggtgagtacgggagtactcagcaagccatgggaaataagtgtttaatgcaggcttcaaggaaagactgttgtttttgcaattgattttatttgaactcttttctgaaaacaactaagtgagtgcttctcaaacgacacggatgagacagtgcgtctcgtccggtcggagtatgtgtaatgtatcagtctttagaattgttcaagattggcacccggccaacaactttcaaacggccacccgggccaacaactttcaaacggccacccgggcctagctgatcccatcagctgcagatttttccaaacatcgatccccttttcacaacagcaatttcacaaggcagtagtcaaacaaaactacgctaggaatcacctcacatccgcccatgaccgtgggcacggctgttcaaacagtttattaacctctgcagagggggtacactttacccaca

SEQ ID NO: 8758 - DNA, 1501 bp, Oryza sativa
atatcctttgtttatttggtctttgggttttacttttgtattcaatgttgagttgtccatcagattcctacccatcataaaccattctaaccaaacaaacggtaacaattattccatacttgagtaaaaaaaacaattattccatacaatattaaagggtagacaaacaataacaattattccatacaattttaaaggctagaatttctaataaaccaacaattgtattttgccaacataattttgtctaactttagccatatttatggtacaagagccgtcaaaacatatccaccaaacttatagatgcaagacacaagatgtgtagatcgtagagaaaacataagaagattagtaacgccacaaggcccacaactttaagcatgctttcatccaactgcatatttacatgacttgcatcgtcctccaagcttgtagaaacatataaataaataggttgaatgaagggatataaagattacatatatttaaaacatcatgacttttaacatcctttctcttatacatatttacagtgctagaatcatccataaaacttatagatgcacgtaactagttatttataaacataaatgcatgaagaatcctctattggatttataaatgggtggaactagatatgctcatgttgaacaaaaacaaagaaaaagagtagtaaagtaccagcataacaacgctcactccatcttttttatataattttgagaaaccctcatggttcaattattgcatattttaagttatagtttttaaaaaccctcatggatctatacgtatgtactttacgtaacaattttgaaaaacccacataaatatattaatacatcttttatgtttcaattttataaaactcccgtggccatacgttttttacgttgtagttttgagaaatcctctttgctctatttgtacgctttttacgttatagctttgaaaaaccctcttatctctatttgtacatcttttatgttacaaattttaaaaacccctatgaatatattaatacatcttgtatgttgcagttttataaaaccttattgcatcttttacattatagttttgaaaaacccttgtagttctatctatgtgccttttgaattgcgattttgaaaaaaaaatgtaggcctatgagtatgtgtttggtatcacgatttgggaaaaccttcataaatttattttttgaaaggaaccttcatgaatttattattatatcttttgtgttatggttttgagaaactctcatggctttatgtcttttgtgttacaatttttgacaaacccctaatacctttattaattcgtatttgttacaatttttgtaaaaaaaaaactaatggctatattagtttgtcttttacttttaggttatagttgtgacagaaaccctcatggctgtattaatacgtcatgtcaattgacgtacgtaacattaatcaaactagctacaagtccaatcatcgcaatcgctccttcagcatta

SEQ ID NO: 8759 - DNA, 1501 bp, Oryza sativa
tttcatatgaccaagggtagttcatatgtaattacagaaatgccattttcagtgtatatggcttgtcatttttatatctctcaaaccacaaatgtaaatgaaatgattcttgtttctaaaaccagtttatcatactctctacctactgtaattaggccatgatttatagagcatgttgcatatgcatgtttatttgaatcttatttgcatatttgcctcttatcggtagattcggagaattcggagttcgtggagcgagactctgaggttgagtgtgtttccatacagcagcaaggcaagcacctaagcatatagaacctatactttctctaaaaatgatttggttgcaatctatacgtatatatatgcatgcattgcctagatattaatattgtcggtttatggtgtatgggtagaacctatttatgcatttagttcttgtgttattgctgtccttatatcctattaccactggttgggattatttgggatgtcttattcattaatgcttagccatgcttagtgctaatagaactatagggatggacagtgctattaattgtggtatataaataacttgcattattgggcataaaacttgagcacttacactaaataatggttgatgaaatatgttagacttggacgggtgatagggcgatgatgggaggttggtttcccctgatgcaagtagccccgtctaggtcgttaaggaccgaacattttgacatctaatcaagcaccctacgtacttaccacatgccttatttgggaccggcttgttcttactagttctactgtgatcatttatatcacgttggagagtcgtgaggcaggtagcctttggagggcctcgggtgcctaggtttggccgggggtgcctcccgcgtggcgcgcccgccttggtcacatcacgcacgcacgtgactgagttgtcgggaaccccagcgtggtataggtggttggggtgaggctaagaaagggcatgtaatgagcttgaatcacttgtgtaccgcactcgacggggtgtgtagcttttgatccttgttcatttcgtgtgggtccagttgtacacctctgatcagagtataatctattcgaatagtcgcgtcctcggttatagacaatgcttgatgtgttagttatgttagcatcaaatgtggattattatggatgggattatgtttgatggtggtgttggcatgttgtgccatgttgttatggactttggtagtccatggttgatgatgagagcgccgtttgggctcatttgcttatatatttcagaattatatacttgctgtccataaattaaaatgatgctagatttacttgtccttgcttattttactcattaattgctcaataaaatttgcttgatgcaaatgttgaacctagagacccactataggctagaaagcttgcatacttctctctcccttttgtatatataattttgggtaagacttgcgagtacaatcttgtacttaatccggtgtct

SEQ ID NO: 8760 - DNA, 1501 bp, Oryza sativa
acctgcggagcagcttggtcagcggcaaggacatggccggctgcagcaacggcccggtccgcgaggtcagcacgacagacggggcaggtgacatgcgcggcgagccacacgtcgatgcaggcggtgtggaacacatggcagcacccggggaggaggcagagcttctcgccgtcgtccacaaactcggcgaggcagaccgcgcactcgagcgccccatgcccggccttcaccgccctcgctgtcgcgtacgtcgagccccacgtgcctcctccgatgttccccaccgacgacgcgaacggccgcgctggcgtgcacagcaccgcccccacggcaacgatgcgcggcagtggtggcctcggagcagcgtgggcaatggagaggaggaggatgacgtgggcgacgaatgcgtagtgacgccccatcggaggcgccacactccgtctgcctcgcattgaacaaatagcagagagaggaagagaaaaaagaacaagagagagaaaagaataaggaagaataaagaaaaaaatattcgaagggtagaaccgtacttacacagctgtttctctctccaattccttcggatataataaaataatcccgccagtgtccagcagttaattaccacatttttgcagtatctacgagaaaattcacgttctttggctgtctcacagcaaaggtcataaatattgagtgtcatgtagcaaattttgccaatgacatttgaactagcacctaccgcttacatgttattaatttgtttattccaacatattgtaacaaagcaaaagattaattttatagtcactgcagccatctttaactattggttaacaatttattcattaagtcacttatagcggcgaaccgtgacataatatgagtgtgtcacaatcaactgattactctaatcttatgaatcattaccattgggaatgttcagcgaaaatataccgcaaaacatttgcatatgaaggatttgctcaccattgttgccatgttggctgctcatttccaaacattgttggaagagagcttgaggctgctcctccatgtgagtgaatttgatcattcattttgctatttcacagttctatgtgtacccaccagatagagttcgactgttctcaaaagatgatgtactactctacattaaagaaatgaagatttctgaatttgatacagatggacaatgcaacacaagtatatgtttcttgttggaactatttctcttatttgaatagtaataattattccctccgtcttaaaatgtatcaacaaagtaccagattagatatattgtattactataaatctagtcatagagtctgtccagatttatattactagaatatgtctaattaagtactaggttgctatatattaggatagaaggagtgtcgactagatgatttctcactttgcagtactaatgtttggatagtttcctaaatgaaattatagttgatttatttttagattcttgctattcttgaattta

SEQ ID NO: 8761 - DNA, 1501 bp, Oryza sativa; identical to SEQ ID NO: 8730

SEQ ID NO: 8762 - DNA, 1501 bp, Oryza sativa
tggttggtcccaaacggttgtgtgcacagctactgcggctgctgctacgactgcttatcacaccttaatttttatttcggtgatttataaattatttatagaatttatattgaagtgtacattaatttgcattaatttgcttgtaaagtaaaacttcctaaacaaaacgtggctggatttaatttttattacattctccgaggttaattacactctagaatttgctcggatttttcatagctcaattcctaatttttaaaatacaatcatcaataaagcaaatatttaaaaggaaaagtaactaagagcatgctaagattgtagccaaaataaatcttaccaaattttggtaggatttcttatatattttccaaatttaacaataaataaaacatagactttgccaaaaaatagtatggttgaaaatgacatcaatctgaacagtccctaaaaatatccaccgaagctttgggccatttttggtcatcttcttttgtaataagttcactataggtccctcaatttgttgtcgagtatgaaatccgtccctaaccgtaatcctatatcgatagagtttattcccacttagtgtatttaatatgattttcctgcaatgtggttgttccacgtcaccttgattgcttttgaactgttgatttgaacttgtatggtaggattagatcgtttttattggtctgctgctggaaaatgaaccatggtcgaggcccaccaggcgaagcatcgaaatacttacctagtagtcaccgatcaggttccgattttcctggttttttgaaatttttttagtctcttccattgcttgccgcgtgtcctgctgatttttttttacagttttccactgatttggtgaccggttgatttcctattggggtgacgtatccggtgtatgttactggtggccaactttcttcacatggtgcccacgtacgtgtcggtgattttttccattttattttacgttgtgttttacttagccggtaacggccggttatatctaacgtgccccttcctgattcgttatttcttacagtacacgcagtattatgttcttgtcgtttgttttagcttgtgagctaaggattgtttctctctccttatcttcttacagtccatgcatggcaagctacaatgttgcacacatctagctagctgcttctgcttgcctcgtgccgacatgcgcgtgctgcgtgctctcatgctgctcatgtgtgttgtcatgtgttctcttctttccaatgtttatgctcctccttgctccttaagtatgtggtattttttctctcactttattggctctttcttttgctatttaagtccgaccatctcgttgttttcccatacattcttcacatcaatatatattctttctttatttcttcagtgctacttgagttgtttcctgtgtgttgtcatacctttttccgctgccatgcatatttcttgtttggttggtgtcttatgttttgttgtgttcgatagg

SEQ ID NO: 8763 - DNA, 1501 bp, Oryza sativa
cttctcaattgatgaaattggttgtaaaacatgcatgcatgagatatattaattcgtactacattctaaaaaaagattcgatatatgtcattttgtatacttatagatgtttgaagttttttttttggtgaagaaagttttaggttggaaagagctagaaacattaatggttaatggccatggtgttacgcaatgactaaagttgatataaaaagttataacctaggactggaggacctattcacaggctgcgttggcagatcatgatttctatcatgcataatcagtggagtacaggcaaaacgtgattttaatttcttcagtaacatttaaatacatatagctaggttagctatagaaaagatcagaaaaagttagtcatatacatcaatgctttagaataagagtaacttattttgacataaatcaagctgataagtccataccctaatatcagcctctcctggaaaaaccggccatccaaagtggggtgtttggaacacgtgtcattcgtctttttcatgtctttggcgacacaattatttcattctccactttataacatgtcgggcgtgtcaagaaattattcgatatatgcgctttataattattattcctatcaaagtgcgcgtgccgaacatccactacgtacctagcttatgcgacatggttatcctcattgtgtggcaatggcaatgaatctttctctatatatactacctcctccgttggacatatatatacgacccagcttggatgtgtgcttacagaaggtaagtagatatcagtcataatattatttcttcccttgttgaaatggtacttatgtgtattagtattaccactatcgtgattattgaattttgctatccatgacatttatagacagtaattaagcccacaatgtatctaaattcttgtgagcatcattccagtaagatcatgtagcgacaaaggaaagagctttacaagtactacaattttgagtacagccataaaaggacataggtgttcatccaaaatacaagttttgttcaaaactattttgtagaagaggaatattacaacaattctcacataaagtttccagtaatactatacatgaccaggcatcaaaattattgggatataatgctatttgtagtgtccaaatacttgtttaattgaataattagtacagaaaactataattaatataagaatattttgcctgttattttggacaaaattgtagattttcattacgtttagtaccgagcatatattgataatagacaacgaaatatatgctcggtttaatgttcaacatgcatggtgtggtggaattgatttctaggaacagacatgattgatccctaaactatcactcttctatatatatctagtttgtccaatgagatgtattttgatagttcttttgtggtatctatcatatttgagttaattagtatatttttactacatattatataactcattgacgatactgcatataatcatt

SEQ ID NO: 8764 - DNA, 1501 bp, Oryza sativa
ccgcgtttctgcgctgcgtcgcccatgcatgggcatgggaccatgcgcgcgcgcgcgcggcggtgccggccgcgcgacgcgacgctgcatgcgggacagctcggctcggcggctggctccgcgcgctcggtgtggggacgatgcatgcgggggtggatcgcgtattcgcgtacgatgaaagtagaggaggatgagcgcgcgcgtcgcggcctcgcgggcatatgggggccatgcatggttgacactgtgacacacagtattacagtaagtggtggctgcagtgcacgtacgtacgggcatgatgcggggggcgggctgcttcgttgggcgtgtcagaatacagatctcccccccatgtttcgctgcgtgctgatctactgttgagaacagtagccgcacaggacggttacgaggtttccacgagaacctgcaggcatacatggtggtagcatagtagacagcctagaacgtgtgggcgttcgaatcgtgtgtctatctgttgctatgcgatgatcagacaaggttcgacagagagggcctcgtatatgcgtttatatgcgtgcaccggtgctatgttgcataattgttacagtacctttctgtgaagcagcagttctcctgtgaattgtgggtttttgccaacgtcaccgaacacgactttgcaaagatgcaacaacgcgtacagttccggcccaaataatatggctcgcagcactcgcacgtacttccattccggcccaaccaatgtgggctaaactgtagcgcagtcgaccaggccgcacgcaccatccaatttacgggatattttttatttattaaaaaatatttacaaactactccctccgtcccatattataatcatttttagagttagacataattattaagaaagtaggtagaaatgaatggtggaagattctgattggttaagtagtggagttaggtggaaaaaaatgaacggtggagagttttgattggttgggaagagaatgttgatagagaagttgttatattttgggacaaatcttgagggctaaaagttattatattttgggatggagggaatacaaatatagacgcctcacgtcttctggaaggatgttttttaaaaatcgccttttctaaagacgttaagggatctaaatgtaaaatttttatttatgttcagacccttttcgttggtttcaatttctaaaaaaaaactaataatgcttatttgatgctctaaatgattttatatggaagagtaataaactataaagttgactttatagatctcgatgggatctacaacttttatataaagtttatcttcatccaatgtcgtttaaaatgttttgaattttgttaagttgttaaagtttttaaatattttaataaaaaatgtaaaagtaaaaaaaaaatccaatttgcggacgcaggtttcccagcactccgctatccattatcagacgatcttgctgaccataagctgtaccacactcccactcaaacggaggct

SEQ ID NO: 8765 - DNA, 1501 bp, Oryza sativa
gctcaataggggaaaaagattatactactacacatcaaaggcatgtaccgatggaattctcgggtgtgattgctcgtacgttttcagaattgatcacccggtgtgccgtattcatagcggatggggtgatggtacatgcatgtgtagcgtattcttatgcacgatttcagctctgcagttgacttggttcgctagctagctagttggctggtcgatccgtagacgagaatgccgccgaattgaattgaattgaatcccaagagcaacgaatggggatcggaaagatgttgcacttgcacacaggttggcacacacgacaacgacggcccgcccgggctagtaatactgatgtggtcatctttgccgtgtcgccgccgaccaaattttcagagtcagcgcaagcgtaattagaccctgtggctttctacctgttattttccgtgagtcccagagcccatcgagtgctctcaattgagggatgtacgtactaccagcggcctagctagctagagatagtcgtgtcatctgactaggaagtttataccgtgtcggcgtaaaaaaccaaagtaatttcgggaggctctgtgctgaccacgtcgcctgcgcaggcgcgcggaaacgtgtcggttccaaagcatcgcaaaagcgatactagaacacacgtctccaggcagcccatgccgtgccgcgccgcgccgcgccccccgtcgcgatctcccaagcctcaagcgtttcgccggggcggccggcctagtacgcgacaagcggacaccgcgcggcgcggcgctgcggttggggggtggaaacccaacctggcgtggcgaccgctgcgtacgtgctatccggccaaaatagtcagcggcttaactggctgggtgaaacagagttaataaaaaaaagaagaaggggcacgcgctgcacagtagacagcacaggagtaaacggttttgtactgtgcggtgggggtgggggcggcggcggctgccttgccgtgtggtgggtttgcagttgcaggctttgcttgcagctttgtggtgtgccttgcctggcttggctttgcacactggcctcggtaccggagccacaagcctggggctaccggcaggcgatggggcgccatgctgccgcgcatcatgttgttccgttgcaaagcgaccggttttacaagcacagtacagtactcctcctactcgttccgatgcgcagtaggttttggattatcgaagcctgcagtaacacccagcgtcagatccgggattaacatgggcatttcattgtcatgctcttaatcctacatcaagagaaaggggtcatgactcaagaagagctggcctcatttcttcctacattttgacttcgcaagtgatcaagcaccagtctgactttgcagtatataatactataatagaagcaaagcattaataaactgaggtgctaattaaatacggtcataataaaataggctagtgggaacctggaaaatatatgatcacattgcatc

SEQ ID NO: 8766 - DNA, 1501 bp, Oryza sativa
aaatgtatagtcaagtcctcgcatttataagagctatcaatcattaccttctcagctgctaccacaatcatgagtcggccaagaatctcctgatctgaaagccttgagaaccgtacaatagcacaacggctttgaatgggttcaatgatcttagatgaagtgttgcatgcaagcgcaaaccttgtggtgttagaataaatctccattgttcgtctcagtgcttgctgtgctcccgatgtcatgctgcatgtagcaagtgcatgtgaggcaaactcagaaacaactagctatatccttgatatcagtagttatatgcttaaaaatcataatgaacaagtctttaattcataactacttcaacaatcatcagaagtcctggccggaaattgcccaggtggtggtggaagaagctgcactatggcgcttagcagggctttggtcatttaggtcgcaacacccatgacacaagattcagccctagcatccctttttttttgccttttttttcagttttcaccttgtaaatgttatacaactcctcagtcttaatgtaaaagatgcacaatccttgtgtattcacaaaaaaaaatcatctctacgagataatatagctttgctcttacagagatggagcagccactaggtttctccattttcacactgttggtatcactacaatcctactacatcttaacctctagcaatccgtggtgaaattggcatgtctggactaaataaggcacagtactagcaatggtgtcacatcatccgcactagggggtggcattacctgtcagcctcatccaagatgacgatcttgtgcctccccggctgcagcgtgaccttcttctgcgcaaacatcttgatcttgttccgcaccacatccaggcccctgcaaaagcacgaatcaaccgtcagtccgtcacacacccagtccacaccacgggcgcacgccgcacggctacagttcgccaagtcaaaaccacgccacggccgcaccaacctgtcgtccgaggcattgagctcgagcacggcctcgcggtagctaggtccgagcagctcgtgtgccagcgacaggatgctcgtagtcttcccggtgcccggaggcccctgtagaaaacgatagttaaaaaaaaaaaaaggttagaaacgattcgtcgtactgctgcttgggtgttagcgagagcgcgcgcaaggtgttcgaggaaatggcgcttacggagaggattaggtttggcatgttgccgtcgcgggcgatgacctggaggcgggcgacggcgtcggagttgccgacgacgtcggcgacgcgggtggggcggtacttctccacccacgggatgtcgtaggcgtcggcgagggcgggggcggaggagctggaggcggccatggcgcggggcggatgcgcgggagaggggaaaaaaccgcgccgcggtggagggaaaagaggggaaagctgccccgccagcggaggggagggttttttttttttttttcgggcgtg

SEQ ID NO: 8767 - DNA, 1501 bp, Oryza sativa
atagtggggtccttattcaagacctgcagcttacgaattgggatcacatgcagtttgtatatggactgcaagttaagctactgcaagcaataggagccatctatttcattgatgaatggaccagaccattagctacagtggcagatgtaaaaaatactaaacaattttgctacagtgatctacagtacccgaacgcattttggcccttggatccagatctaaaagctgacagtggactgtataagttgcagtcacactaccaactgcaccaaatccaaatccgcagcttacgttctcattcgattaaccagttgctccatcacacttctttaagagttatactcgagctacagaagctacatagtagttataatataactacactacaattatatacttagttatgttctaaaatttttatttctgaatgttgtataggtactcccaaaatatttcggctgcgagggccgaggggcgttgtcaagcagtccaagatcccgtagccccgacgtggccgcaggcccactccgctccgaagttctctgcaaaatccccgtgtcgtgccagccatcatcccgaattctcgatatcatcacatccgaccgacaccgtcaaccgccagccgctcctggccttctcgccgacgcgccgtcctcgtttcgagccagcgtgcggcgaccccgcctccacggaccacgtctccacctgcagctacaggttgcagcagcgaccgcgcctatgaggccatgagcccatgacgaccctgcttgtagccgtgcgcgcgtgagcagctgaacatgtcaatacggcgatcgattgactttcttttcgagggattggctgtttaaacgctgcaagtccacgctgcatccaacccctgcatacgtccgtatcccacgagatttcctctcttttcataaatcagaaacgtgtacacgacaaagggccaaagggggacaatttggccatgaggaacataatcatcttgcacaaaaaatcgacacagctgatgtacacattagtactctctcttcggttagcacgagtgcatgattgattggattgagcgggtgtgtaggtagtatctgtatcagaccgcaagcgcgagtactccgtcctgactcatgcatgatttattggttacggcatcaacaacgatttgcagttggagcctgggttatacggaaggtagtagagcttaagagaaaatcggctggggatgcacgaagaggctgacggcgatggccggtttgcaaacaggcgtagcagcaaagcaacggaactgctataccagactctgtccatttcgtgaggaaagaaaaacgagaaacatctatctatctatctatctatctatctatctatctattatctattatattattaaaacaactttgaaagaaggcaccacgttcgctgtgggggttagaaatttccacattaatcgaagaaaaagaaaagaagagtccaagtagaaatactattatattattaaaacagc

SEQ ID NO: 8768 - DNA, 1501 bp, Oryza sativa
gtgcctgagataagagcaagtttaatagtatagcctaccatgggctccaaatcatctgcaggcgatttaatagccaattcatataatagttacatataaatatatactacataattaatatctggttccatctgtcatacacacatacatcttgagtccgtgctgcaactgactataaatctgtagcccgttgcttatctctctcatcttttatcttctcgaaatgtgtttatagatggcttatagtctactattgtacctgctctaataaggatagatgagaacccaacaatgtatataaatacagtacatgtaactagaatattacttgtatgcaatttttaaaaatcccaacggtatcatgctatttccacgaatcggaggtcgtgggaccgaatcccttcacctatatgcatgttgtgattttctcttccttatttgcacgaatcatgaagcaaatccaactattcaaaatcacacgaaagttacataaaagtcacggtgtaattgtataaaagttacactacgattatactgtaatatttaggacagaatttatcgataaatatatagcaaaatcgaaacttatttggattacacaagaaaattgaaacaacttttaggtttctagactgtaaaattaatatagttcttgtttatagggaagagcgcgtgtgcgtttatacaagcattttacgtctgtgcttaaaaaaaaaagctcttataatttgtatggtggtactagcagttgacattctctcaaatttaaaatccgagggagtattttttttaattacatgacggatacacaccactgcacatgcaaaattacactcatactccgcatatgcacttaggggtgaaaatggtcggaatcgtaccatctctttggaaacgacatttgatttaaccggtaattgatcataattatcatttaaactactcaatatcgacatcactatgatttagaaagaaattagaaaaaacaaaatttatatatagccaaaaagggtaatggtcgaaaacggcgctcggtcgattgggaatttccgtgaccattttcacccctatccgctaacacacggatttaaatcctagttggtggagtcatgcacccacgatttcaccatcatatcatcccccaagggagtatttttgttaatggttagaacatttcgtgcagtcattttcgcacttctagaatactagccgtcgagacgtcgacggtgatatgatatcatatgatcctacgaaaaatcatccatagaagagtttcttcctcgtcatgtgtcagtcgcattcactgcgtggtcatggactgcaactgacttggaacatcttgtcaggtcaggagcacattcacaaacttgcctagtctttccttgacgattcagcaacaacgacccaaaagaaacccagatcttttcatgattatttcaccggacaactcccatttctgtacgaactgtacaccgatcaaagttcaagaaaccccaaaaaa

SEQ ID NO: 8769 - DNA, 1501 bp, Oryza sativa
gcgcgcggcgtgggcggcggcgaagaggtcgtagaggagcgtggaggagagcagcgtggaggaggaggcgagcttgttggcgaggtggaaggcgagggagccggcgagggtggggtgggagagcacggtggcgtacacgaacgacgccagcgccggctcgccgtcggcgtcgcggcgcgcctcggccttgatctgggaccacacccgcgactcctcctcctcgtcgtcggcgtcggcgtccggctccggcggggacgggtcatgctcgtgctggagtggctgggcggtggtcatcgctgaagtctcgtcgtcgtcggccggtgacgtcgacgccggtgaggtcgccgtcgccgggcgggacgcgcgcgggaagagcgaataaataggcgtggagacggacacgtcagccaaccaatcagagctcgaagctggtgtggtgtggtgtacacgatgacgtggcacacggacacgcttcgaccaagtgatccaacggcgcgagctgcacctaggctgagggcacgcagcggcagactctggtcaacagcgaccttgatagccaacagaaactaacggatttggatccggtgcaacacctagtgtgagcagtcacactaggaacttttgatgcaaatccaagggtctagaatctacaaagtactgttcacatctgaaaaaaactgcagaactactgtagcagcagcactatagcatcagatctagaccgttcactggaaaaatggatgactgagatgatgtgcagttcctaactcgcagccacagttaggactgcagtggatctcaattcgaaactaacacattgcacattttggaagataaataaatactctctcagatttttttaataaatgacaccgttgacttttttcaaaagtcacatgtttgaccatttgtggtattcaaaaaatttacgtaattacaatttattttgttgtgagttgttttatcacttaaagtcttttaagcatgatttgcataaaatttttaagtaaaacgaatgatgaaactgaaacgtatgtttaaaactcaatgacatcacctattaaaaaaccgagggagtactgtatataggcagaaaggcaacagagaaccagaatactattttcattgtgcagagctactcctaaacaagttactgctcctacgcacttgttccttacatgtactcttcgtcctaaaatataacatatcggacatttttagaactatcctacgctgctatattttgagtgcatttctagcggatcaccaaattaagcacagcagttcaaacgcagatggcgaaacaacatcggcaaatcaccgaactagagttttatggactctgcctcgctttggacgaagacggaagtggtaggaagttaactccaagtagatggagagctgatgatatgcccagaattatgtatgattcatccctgaacaaagaggagaaaaagttaagagaactacagcaactagagaattggatgccctctatcta

SEQ ID NO: 8770 - DNA, 1501 bp, Oryza sativa
gttcgtacagaaatgggagttgtccggtgaaataatcatgaaaagatctgggtttcttttgggtcgttgttgctgaatcgtcaaggaaagactaggcaagtttgtgaatgtgctcctgacctgacaagatgttccaagtcagttgcagtccatgaccacgcagtgaatgcgactgacacatgacgaggaagaaactcttctatggatgatttttcgtaggatcatatgatatcatatcaccgtcgacgtctcgacggctagtattctagaagtgcgaaaatgactgcacgaaatgttctaaccattaacaaaaatactcccttgggggatgatatgatggtgaaatcgtgggtgcatgactccaccaactaggatttaaatccgtgtgttagcggataggggtgaaaatggtcacggaaattcccaatcgaccgagcgccgttttcgaccattaccctttttggctatatataaattttgttttttctaatttctttctaaatcatagtgatgtcgatattgagtagtttaaatgataattatgatcaattaccggttaaatcaaatgtcgtttccaaagagatggtacgattccgaccattttcacccctaagtgcatatgcggagtatgagtgtaattttgcatgtgcagtggtgtgtatccgtcatgtaattaaaaaaaatactccctcggattttaaatttgagagaatgtcaactgctagtaccaccatacaaattataagagcttttttttttaagcacagacgtaaaatgcttgtataaacgcacacgcgctcttccctataaacaagaactatattaattttacagtctagaaacctaaaagttgtttcaattttcttgtgtaatccaaataagtttcgattttgctatatatttatcgataaattctgtcctaaatattacagtataatcgtagtgtaacttttatacaattacaccgtgacttttatgtaactttcgtgtgattttgaatagttggatttgcttcatgattcgtgcaaataaggaagagaaaatcacaacatgcatataggtgaagggattcggtcccacgacctccgattcgtggaaatagcatgataccgttgggatttttaaaaattgcatacaagtaatattctagttacatgtactgtatttatatacattgttgggttctcatctatccttattagagcaggtacaatagtagactataagccatctataaacacatttcgagaagataaaagatgagagagataagcaacgggctacagatttatagtcagttgcagcacggactcaagatgtatgtgtgtatgacagatggaaccagatattaattatgtagtatatatttatatgtaactattatatgaattggctattaaatcgcctgcagatgatttggagcccatggtaggctatactattaaacttgctcttatctcaggcacaatatcttcccagcacaccaactcattcggcccat

SEQ ID NO: 8771 - DNA, 1501 bp, Oryza sativa
tgataccggtcaatcttctggtttttgcaatggtgcaatggcagaaagtttaggccattcagaatcaatgtacagcgaaggggcctaaccgcctaacctgcaaaaatactagaaaaaagtgttctcaaggaggaaaatggaaatgcactgctagaaggagaggcacctacaatcaactgttattttctgtttatgttaaattcaaatctcagttcttaactgtgtgaggcactactccaaaaaggaaaaaaaattcaaagagaatcatgttggtctcatcatagatagagggcatccaattctctagttgctgtagttctcttaactttttctcctctttgttcagggatgaatcatacataattctgggcatatcatcagctctccatctacttggagttaacttcctaccacttccgtcttcgtccaaagcgaggcagagtccataaaactctagttcggtgatttgccgatgttgtttcgccatctgcgtttgaactgctgtgcttaatttggtgatccgctagaaatgcactcaaaatatagcagcgtaggatagttctaaaaatgtccgatatgttatattttaggacgaagagtacatgtaaggaacaagtgcgtaggagcagtaacttgtttaggagtagctctgcacaatgaaaatagtattctggttctctgttgcctttctgcctatatacagtactccctcggttttttaataggtgatgtcattgagttttaaacatacgtttcagtttcatcattcgttttacttaaaaattttatgcaaatcatgcttaaaagactttaagtgataaaacaactcacaacaaaataaattgtaattacgtaaattttttgaataccacaaatggtcaaacatgtgacttttgaaaaaagtcaacggtgtcatttattaaaaaaatctgagagagtatttatttatcttccaaaatgtgcaatgtgttagtttcgaattgagatccactgcagtcctaactgtggctgcgagttaggaactgcacatcatctcagtcatccatttttccagtgaacggtctagatctgatgctatagtgctgctgctacagtagttctgcagtttttttcagatgtgaacagtactttgtagattctagacccttggatttgcatcaaaagttcctagtgtgactgctcacactaggtgttgcaccggatccaaatccgttagtttctgttggctatcaaggtcgctgttgaccagagtctgccgctgcgtgccctcagcctaggtgcagctcgcgccgttggatcacttggtcgaagcgtgtccgtgtgccacgtcatcgtgtacaccacaccacaccagcttcgagctctgattggttggctgacgtgtccgtctccacgcctatttattcgctcttcccgcgcgcgtcccgcccggcgacggcgacctcaccggcgtcgacgtcaccggccgacgacgacgagacttcagcgatgaccaccgccc

SEQ ID NO: 8772 - DNA, 1501 bp, Oryza sativa
gacgacgacgagacttcagcgatgaccaccgcccagccactccagcacgagcatgacccgtccccgccggagccggacgccgacgccgacgacgaggaggaggagtcgcgggtgtggtcccagatcaaggccgaggcgcgccgcgacgccgacggcgagccggcgctggcgtcgttcgtgtacgccaccgtgctctcccaccccaccctcgccggctccctcgccttccacctcgccaacaagctcgcctcctcctccacgctgctctcctccacgctcctctacgacctcttcgccgccgcccacgccgcgcgccccgacctccgcgccgccgccgccgccgacctcctagccgcgggcgcccgcgacccggcctgcgcgggccgcctctcccactgcctcctcgactacaagggcttcctcgccgtccaggcccaccgcgtcgcgcacgcgctctgggcgcagggccgccgcgccctggcgctcgcgctccagtcccgcgtcgccgaggtcttcgccgtcgacatccacccggccgccgccgtggggagcggcgtcctcctggaccacgccaccggggtggtcatcggcgagaccgccgtcgtcggcgacggcgtgtccatcctccaccacgtcacgctgggcgggaccggcgaggccgtcggcgaccggcaccccaaggtcggcgacggcgtgctcatcggcgccggcgcgaccatcctcgggaacgtcaggatcggcgccggcgccaagatcggggccgggtcgctggtgctcgccgacgtgccgccgggggccacggcggtggggaacccggcgaggctgctgctcggcggggaccagcgcggcggcgcgccggccggtgaatccatggaccatgcctccttcatgctggagtggtcggattacaccatttgagtaggagtggcatcgtacggactacatttgtactactccttagccatgtgtttgtacttgcctgtaaatgcaagtgtgtaagcagagttagcttgtaaccacctgaatttcgtcgaattttaccaattctgctgaatcccatcgaattataccaatacgcgccctgttgataaggtcgaaaaccgagcagttactgtcggttttgtgaaccttttgcttccgacacatgtactgaaaattcacctgtaatttcgcaaaagttccttaaaatttcggcatatgtgcttttgatttttagactttcttttacgagtagggccttctgtgaatccggcctgtaaaaccgggcctagttttcacatcggaagctgggcctatgctaaggcctggcctacagatccagcttcatttctcagtctgacactgggccccacctgccagtgtctgcggcttccacggactgagctgcctcgcccgcctccgagcagttggggaagagaaccgaagcacaaaccctagcggcggcgcagctcagccggggtttgcggaggaaggggaggggcaccgcccgcgatgctcgcgg

SEQ ID NO: 8773 - DNA, 1501 bp, Oryza sativa
gaccgtatcatgaacagtgcacagcatgatagcacatcataaccgagcgttgcgcgttggcagccacagccccgcacacatatccagacgcgctcaccgtgctaaatcctatttatttcttaatagcacataacatcgatgactagacatggtttcatactttcatctaagcatgacttataccttacttagtatgacaaacaagaaaagtttaaaatgagtgacagtcaaaggtaatcacataagacaaactacaaaagcctaaaaaaaaattcagagcacacaacaaacccacagccaacatagctatcacttttctcttgcaactaaagaagatatgtaccagtaaaaaatccacaaacccatagctgtaagtccctatactctacaacaaggatcatgcccccactcatccaaggctccaagagcaaaaaaccaccaccagctctgccccacccctcccctgcggcgcgcacccacatcgaatcggatgcaacagctgtcgaacgatcaacggcggcacgaatctcgacgccggggacctctccccccacaaaccctaccgcgcgcgaacgagacgttgctaatgctcgcaagaaaaaaaattcgacacacggaggagatagccaggggagggagacacgccatcatcgcccgcaaaaattgcacaaatctaccctcgattccgtgaatccgcccccctcctcccgcaccgatcacccaatccaacccgtctccacgaacaggaatcgatcaaacatgcaaattaaagcgcatcacccgaaacgaacgaaacaaaccgagcgggagaagaagaaggggagggagaacgcgcacgcacctgctctctggagactcgtcggcgtcctcgcacctgcggacttcggcggcggcggcggcggcggctggagcagaagcgatctcgatcaggcggaggagggaggaagacgagacgacgagataataaataaataaatcgcacgaaacggggtgagatttaagccagcatcaaaacctacctctttaatccaacccgcggcgttttttctcccttttttttcttttttttggaggtttttatttttcttcgtctttctctcgtgttcgtctcgcctcggcccacgaggaggttcacgcggcggcaccgacgtcgaggcgggtcaaagggggcctcgtcctcccgtggggcccacgtgtcggcggctgcccggggcctcgtcctcccatggggcccacgtgtcggcggctgcgcggggccgcgtcgcgcgtcgccgtgccgtgccagggcaagtgtgtcactgacaggtggggtctcgttgtggtcccctcatggatggctcgtatagtcggggtagtacacgtgttttgggcgaggagaaaccgggcgtgtcacgtcgtgatctggaccgtccgtcgggtgattgacgttggcccccgtctttggctgatacgcgacgaaaaatatcagatcataatcctcgtgcttgtttgggtcgctgtc

SEQ ID NO: 8774 - DNA, 1501 bp, Oryza sativa
attggaatgtcaggaattctgtctcacaacagttaacacagcaggcctcaactgcatgtctaaccaaatatgtacctattcttgatgtgaaactatacattcgctgtccataaagttcctgatatgtcagtctcgggtgaacacagattaaatatcatgtggtcctgactcgtctcagttatcctcatttgattggaacatttgaactagatacaatcaaatcaaaaccctcaggatcacccttttattctctgagacttaatctgaaactatttgtatctctcttatcaaaagcagaaaaaggtcagtcaatactcaaattagaatctttgccatttttagacatgaaacacttcttgattcagccatgcttgtccaaaattaaatatcgacctaagcacaataattcaggacctaatttcgagtcttttctttttcctcttgaaaccatgatgtgtcagtttcaagaatattggttatcactagctccaacactgtgaatcagtcttttacttgacctgaagatgtacaatccttttcatgtggaaatttgggaaatgtcaaacgcaccagtcttgcaaaactgttttctcatgagaccaataacttttgactcaagctgtacttaaagaacaaaaggagatatctaattgagtgtagatttatttctaaaaatttccagtctgatctaaagtcccctcttattgttggtccataatgctccctgaaaacagaaatagtggataatacttgtactaaccattagctccatttttctgaaatgattttctgttcttcctctgacattccatattagctttggtggctttggttctatatgtattttgctaaaaatattctggtcgaataaccactgttacataactaattgcatcttaatttcctaagcacaagaatattgcgcactagtgccatccctccaccccatgtctcaaaagatgttgccaaggcaggcagagatgcagggtaaaggaagcattcaaactccccatatttcttttgccctttaatggctttctcttcttttctttaactcccctcttctttctagttttacgtgattctcttgttcttcgcgggccaaagtgcaccaaagaaccaaaggcacaaagataacccgcccctcggtttcagcaacccctgccaccgcactataaatacccctgcacattagcacctcgctgcatcaccctttcacctcacagcattttccaccttagagctcaccaacacagcagctgatacttgtttaggtaactgagcttcctgttagtgtttgttcatttgttttgtatgcatgtaagcatgttggttgtggttttcctatttcttgaatgcaaaaggttttgcaaagagagaacagctgggttatcttataagtcaagtgtgcttctgggcttcagtttgatcattttttcttcgcccttgctctgatccaataatctttaatgagtggtacattgttgatgtgcagggtaag

SEQ ID NO: 8775 - DNA, 451 bp, Oryza sativa
cccccccccctataaagcccagcccctcctctgtgaaatttcattatattcactaaaaatccaaaaaaaaacgaaagagagaggggagggcagcagaaggggagcggcgaagccctgctggttcgctcacttcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttaatttgatctggagaatgtaatgtacttttagaaatttagagaacaatattgtagagaatgtaacttagggcgtagtacagaaatgcgaggttaacgcagttattgttttcatcaggcacaa

SEQ ID NO: 8776 - DNA, 1501 bp, Oryza sativa
tatggcagagattaagaattgctttgccattacaaaaatatgctgagaaatttaattaaacagagcaagcaagcagcatctgacattgaacctcaatgataactggatctcctggtacaataggccaacacagagaacaaggatgcaggagcattcatgcttgaaattttgtggggaaaagaagtgattactgaaaaaataataatcaagcatttatatatggtaaacatccagcaataaagttgtagtatgtcaaaaactgtccttttgaactttagggctgcatgactagcagtatgtcaagttggcaacctagaatgctaataaacggtttaacattgttacgagaagaaatgtatgtatggttccatttatgctaacgatgtactccttcatcaggcagcagaaacatcagttaataataagtaaagtaataaggggattagggaaacaaccttttcagatgatagagtctccatcagctttgacgctcgctcttgttctgaaaaagaagggatatcaatgtttaagagaaacaaaagcataggggtaatagtactagagagtgaataataatgaagcgggtaggacctctggatgcatggtcctgcgtagtcctaaaagcggcatagagtgatagtgagaaattggcaatggcatcattcaacgcggagtgagtaagggtgttgagggaaatggtgatgcgaggtaggccctttgcctttgtagcaacaagatgaacgcgatcaagacctatagtattatccatatgagcatagggaagatgtagtgtaaaaaagcgtagtgtaggtagatcgggtaccgaccattgtgagggaagaggaggttgacttccccagaggagaggcaagatttgaggtaatccaggaagtcggagcaggagccgccgatcccgacgtcgtctctctggaaaaagcacgatgtgaagactgatactgatactgattagggcttgggaggagaagaggattacgagatcgtcgatgtcggagagggagagggagcggtcccaggcgagggagtggaggtcggtggcgaggaggcggagttgggagacatcattagtatgggcgtgggcgtggaagaggatggggcgcatccgcatcgccaccggcggcttggcctcaccgaacatggagccgaaggcatccatggccatggctagcctgactcgactctggagtgggccacccaagtcaggagagagagagagagtccttggtgatttattagtgcatgattaattaagttttagttaatttttttaaaaaaagatattttgattaatttgatttttttaagtaacattcgcatagaaactttttttaaaaaatactgattaacggtttatacgagggagaggggttgagaaaaggcgatgccaaacacacccaaatttgtctctctactagtatctcttgttgttagactagaatagacagaagaagagagaagttgagaatagagaggggaatgggat

SEQ ID NO: 8777 - DNA, 520 bp, Oryza sativa
accgtcatgtgatcgacaactcaacggcccaagttctccggacttatatagagaaccttacattcatattatattagcatatatataatatcatcagtggtggattgagaacccggcgaccctagacagccatctatccgagctctctggcttgctatagtagagcaagcatgtgcattgttccactggcatttgatgatgttgacggttatctagctaccgtgtgctctgtctatgtaggaaaaattcacaagtccgcacaattatatctgcaccttacgattaatcaatgagggtggatgatatatatagtacaattttagttaaccggaggttttgttatagactattatgatatttttatctgattatagtggcaaaggatatgaatccatagtaacacaaacttagatatcgaccgatgaagcacgttcaaatgtgtgcatgcgtgtatcttacatgtacactagccagcggattgtgtggacattgcaagatggaaggggcatctaaaccacaa

SEQ ID NO: 8778 - DNA, 1501 bp, Oryza sativa
ggtacacaaacataatgatacgatatatatatatatattttgcagcaagcagatgatggatagatggatggatgggttaggcggtagattccttgaggtaggcgatgaggtcggtgcgctcctgcggcttcttcaggccggggaacaccatcttggtgcccggaatgtactgcaaagccagcctcagccgttattaattattagcaaattgcgtacgtactcgatcttggtgttgatgattgaggaattatacatatacaacaacaattaattaaattagctagagtaaataaaagagaaataattaatataattgaccttcttagggttgagcaggtagtcgtagagggtgccttcctcccagacgacggccatgttcttgttggcggtggagtaggcgtagccgggggtggtgccggactggcggccgaagaggccatgaaggttgggaccctgcttgtgcgcgcccccgcgctccaccgtgtggcactgcgcgcacttggtccggaagatcttcttgccgctcgccgcgtttccaacgggggccacgccgaaagaagccatctagctagctcgtcgatctctctctctctctctctccttctctccagctacctctttaattattttgctggctattcgtctcttgttcgatctccctccgctgtgctctccagcgatcgatggccagccccccccccccccccccggttagatcgatggtcgtacgacaagagcggatgcaacgaccaacaccagccatatatatccatcacccatgcatatgttttagttagtttcctagctaaaaatcgatcgataacagttactcctagctagtccaggagatccgcttattcaactccgctccttttactcctagggtgcatttggttgctcgtatccccttagtcttgcccatctctctcatccaggctgagcttgacctggttgagaggatacacatgcagttgtttggttgtttgcattaggctagccatatatctctttttaattactcatacaagagatacggtttgaaagataatttgtttggttggtttacggtttggaagagaatttgtttggttggttgcatggacgatagggataggtatctctttttttaaagggtgagattatcacatagaacttggggactgcggtgagctaaaatttaactcaagaagagtgtaaggctcccatcgaatggcctaaacagccaaagaaaaagccaaattttaagctttcaacgtagtttcttttacagtattgacttttaagtcacacatatataaaagttttacctacaaattcatttttattctctaataagccgttttggcttatcaggaaaaaagccaaacgatgggggcctaaatttctaagtactaaacatttgattttatcttctatattaattattgatattgaagttcgtggcaacgattattttaagaatcgtcaaatgagcaggatatatacaccagcacatctgtac

SEQ ID NO: 8779 - DNA, 1501 bp, Oryza sativa
atgcgggagagggcacggatgcggagggatctggagacgtctgctcgatcctgacgcggaggggagggatgcggggagatgcgggagaggatgcgcggtcgagccgatgcggcgtcgattgcggcagagagagacagggggtgcgggagaggaggaggagcgacacgcgcgcatctgggacgtccgatctaactcatcagatgattttacaccgttggatgtgtgatatgatgttcaattatagagtagatcagccaaaataccaatggatccggcggccacgagctggacgtcgccagatccggcagcctcgggctcatggccaccggatcttgttgctctgatagctgcgaacagcagcgcgcacacgacggcgaacggcaggtcaaggcttcggcggagcggcaggcctagcgacatcaacgaagctccgctcctctcctctccgtttttttttctgtttttttttctttttcaccgactggcaaaccgtgaccatgaaatgtgggaataatgatgtttactgtatgcattgctaattatttcacttattttatattgccgtacagatgtgctggtgtatatatcctgctcatttgacgattcttaaaataatcgttgccacgaacttcaatatcaataattaatatagaagataaaatcaaatgtttagtacttagaaatttaggcccccatcgtttggcttttttcctgataagccaaaacggcttattagagaataaaaatgaatttgtaggtaaaacttttatatatgtgtgacttaaaagtcaatactgtaaaagaaactacgttgaaagcttaaaatttggctttttctttggctgtttaggccattcgatgggagccttacactcttcttgagttaaattttagctcaccgcagtccccaagttctatgtgataatctcaccctttaaaaaaagagatacctatccctatcgtccatgcaaccaaccaaacaaattctcttccaaaccgtaaaccaaccaaacaaattatctttcaaaccgtatctcttgtatgagtaattaaaaagagatatatggctagcctaatgcaaacaaccaaacaactgcatgtgtatcctctcaaccaggtcaagctcagcctggatgagagagatgggcaagactaaggggatacgagcaaccaaatgcaccctaggagtaaaaggagcggagttgaataagcggatctcctggactagctaggagtaactgttatcgatcgatttttagctaggaaactaactaaaacatatgcatgggtgatggatatatatggctggtgttggtcgttgcatccgctcttgtcgtacgaccatcgatctaaccggggggggggggggggggctggccatcgatcgctggagagcacagcggagggagatcgaacaagagacgaatagccagcaaaataattaaagaggtagctggagagaaggagagagagagagagagagatcgacgagctagctaga

SEQ ID NO: 8780 - DNA, 1501 bp, Oryza sativa
tgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgccagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagg

SEQ ID NO: 8781 - DNA, 1501 bp, Oryza sativa
tccctccgttacaaaatatttaacgccgttgatatttttaaacatatttgaccgttcatcttatttaaaaatttttataaatattatttaaaaacttgaatagtagtagtatatttaacaataaatcaaatgatagaataagaactcataattatttaaattttttaataaaacgaacgatcaaatatgttttaaaaacatcaagggcgtcaaaagatgcatggccatggtgcacgtcaacgcttcacgcgccgggggtacactaccagtgcgacaccgcagcgtgtgcgtacggcacggcacgagccccgttcagcgttgtgtctagtacaatattttattcctgtgctatatatatatatattggaagtaattttacggtccctaagaagataatatgagcttatcaattttttatattgtaaatttgatatctctttatacctaaaaactatgagatacaaaattttacactaaaattacttcatggtacctttttaaagattgtaaaattactcgcatattggagtatatacctagcctacactatatatagagagagatagatgtaacatatatatatatagaagcccgtgtaccattcacatctactccctcaatttcaggttataagacgttttgacttcggtaaaagtcaaactgctttaagtttgaccaagtttgtagaaaaatatagtaatatttttaacttaagataaatttattataaaaatatattcaattattgatttgatgaaactattttagtattataaatattatcatatttatcgataaacttagttaaatttgaaatagtttgactttgacacaagtcaaaacgtcttataaccttataacctgaaacggagggagcgcgttacaaggaattgtagtaccccacggaattgtagtactggggtaggttagcatgaaaatcatactaaggacctgtttgggagagtttttaaccgctgcagtttctcccaaaatcacaagctccctaaaacagttctacttttggtctaatgattcttaaaaattggctaccaaccagctgctgcttaaaattttaagctctctaaacatgccctaaatgtcaattctgaagattttttttcatttcctcattagataagacttattggagataaattttatagttaattggatctacgccactgcaaatataccaattcgaaaaaataccactactatttagcatatcggctacgtgccactggaaatttagaaaattcgaaccgtgccactccatcacgttttttgtcagcctcctggacgtgggacccacatgtcagttctatcttcctacattgtccctcttttttcttccccatctcttcctccatccccacgatgggagcgtcggtggtggtgaacgcggaggagctcacgggggcaccggtcggtgcagaggcggtggaggtgaccacggacggggcgagggtggagggagcattggcatctggggcgtcagtgg

SEQ ID NO: 8782 - DNA, 401 bp, Oryza sativa
atagcctaggggttatggaatcggttttgtcgataatctacgtttaataatcctaaatagcaagattccggagagttatttaatagcccgaaggatccaaacaagtccttagttatgtttaagtagtacttaagtaacactaggcactaattaagactcattatgagtgttataattaacctaattactcatgcattcgccataatggatgttgcatgggtatatatatacgtggcgcgggcgtacggcactttcgctttcgtcctaccagcccgggccgtgaccgcgcgcgctggatcgatttgcttcaccggccaacctgtggccttcatgcgtaggccggccagtgtctgtatatgctatagctaattaactaggataggatatacaagcggcacgca

SEQ ID NO: 8783 - DNA, 1501 bp, Oryza sativa
tcccgtgcgccctgagcgcgccgccgtacctcgcctcgccgtcgatccagtgccagtaggtcacgtccccgtccgacgaaccgacgtacacgacgcggccctcggccgagacggcgatggcggtgactgcgctctcgtcctcccgcagcaccgtctccaggacgtgcctcgtcttcgcctcgccgccactcgccgccggctcctcctcccgccgccacaccttgacggtgccgtcggcggagccggtgaacacgacgccgtcgaacccggcggcggcgacggtgttgatggcgtcgtcgtgggcgcacaccgactcgaggcacctcgagtccgatacgcgccacaccttgaaggacccgtcccaggaggcggagtagagcagcccggcgccctcgtcgaggctgaggcacgacacggcgtcggagtgccggagccacacctcccggcgccgcccgcggcggcgccgcggcgtctcgacgtagctggacgggttgacggagctccggacgtagtcggcgagcctcgggagcgagccgacgcggcggtgcacggcggggtcccccgcgtcggcgcgccacacccggaccttgccgtcctggtgccccgtgaagatgcgcccgtcgtcggcgacgacgatggccttgaccagcccgctcccggtcctaaacccggcgagctcgcggcggtcgcgccacacccgcacgttctcggagtccgtgccggtgtagagcacgtcccccgccgccgccagcgagtacacgtgcccgtcctccttcaccagcgacgcgacgagcccggtggcgccggcgcccgtccccaccccgccgccgccaagccccggcaggtgcgccgcccacggcgacttgggcggcgtcgacgcgctgcaccgcgacggcgacgaggccgcggacccgtacccaccggcgccgtcgttcgtctgccacgacgacgagctacacccgtcgtcgtcggaggcggaggacgacgagaaagacttgggcgagaacgacgccgacgccgccgaggccgccgccgccgcctgctcggcgcggagcaagtggatgagcttcctgtggccgctgcccatggcgatcgatcgatcctggtcgagagcttttcaaggcggggatggtgttcggaagaatgacctgagtcgcaaggaaggaaggcgaggccgaaagggaggagaaggcaggtcgcatcgcttgctaggttggaattggaggcgggggaagacgagacgtggcggtatatataggaacaccagtagagacgtagagtgcgcgggaggatgccgtgggaggcgcgacgccgcgacatgtggccccaggatttttcttttcagctatttttggggagaaactttgtgtatttctggcagtttgggctagtgttcgatcacccaaccagggacacgtggcaggtgtgggtgtgtgctcagtctcagtattggggattgcagagtataaatttggttccttctcacgtcacaagtatggaa

SEQ ID NO: 8784 - DNA, 1501 bp, Oryza sativa
gttcctttttttttctaatcaatagtgcaatttttgttttaaaagaaatcagcactttatttaatactttctccgtcataaaatataaaggattttgattttgggttttggttttggtttacgctagtcttgtgtaactagttgctggaaaaatgctgatagccggtgcaacattttcgcaagggaaactggaaactttttgagttacggctgacacataagagtagtggagtgtcgttgactaactcgatggtcaccaagcagatggcatatgtcggagcaaggtctagcaaatctatccatagttgaagaacttcaccatctccttcgatctgcaaaaaaaggagaaaggaaagacatacaaggctacaacggaattcactcgactatgagacaaacccgtccagcctccagaccgcccttcccttgtctgtgaccaacggccatcgcagacaaagaggagatgggatttggcaagggaaaaaagaacacttggagttatctttcatagaagcactcacaaagagatagaaagaaagttgtcatgaatatagctaattaagaccggttaattttgggctacaatgactatacgatacgatagtggataagttgaagatctaaattgatattcatgtactccctctgttttaaattaaaaaacctaaagttttatctcagatatctaaattagtagtactagattaagttcaatccgaacatatattaatttattttagaatgaaaagattatagaaggacaatattgtaaagtaagatatttatactgtccttccatacttgtgacgtgagaaggaaccaaatttatactctgcaatccccaatactgagactgagcacacacccacacctgccacgtgtccctggttgggtgatcgaacactagcccaaactgccagaaatacacaaagtttctccccaaaaatagctgaaaagaaaaatcctggggccacatgtcgcggcgtcgcgcctcccacggcatcctcccgcgcactctacgtctctactggtgttcctatatataccgccacgtctcgtcttcccccgcctccaattccaacctagcaagcgatgcgacctgccttctcctccctttcggcctcgccttccttccttgcgactcaggtcattcttccgaacaccatccccgccttgaaaagctctcgaccaggatcgatcgatcgccatgggcagcggccacaggaagctcatccacttgctccgcgccgagcaggcggcggcggcggcctcggcggcgtcggcgtcgttctcgcccaagtctttctcgtcgtcctccgcctccgacgacgacgggtgtagctcgtcgtcgtggcagacgaacgacggcgccggtgggtacgggtccgcggcctcgtcgccgtcgcggtgcagcgcgtcgacgccgcccaagtcgccgtgggcggcgcacctgccggggcttggcggcggcggggtggggacgggcgccggcgccaccggg

SEQ ID NO: 8785 - DNA, 1501 bp, Oryza sativa
tatgcatgatttgcattccagttcgaattcaattttttcatatgaaatattgcattgcacctacaagtctatacctcaaaaatttatacaccgaaagtttgtatgcaaatttatgggccagattttgatttcaattcgaatttaatttttacaaaatactgctatgtaaaaattttccatgtatatatttctatctataaattcaatatttatatatacaaatatgtaattatgtattactggaaaaaataattgtgcatttcaacaggtaaagcctattttaatcttattattgttatatggtttagttaagatgaaattcactgtgagagttcacttagatatatctctactattataaaaattgaagatgtttttgtcggtacttttggtacgtcatccgtatttaaatcggttttaattttatgtttcggttttaatatcttatcaaaatcttctctacttaaaaagaacaagaaatttccataggcggtaaaaaaaagtccaactaaaaaggtggaaaaaaagtccgactcaacaagcaataaaaataaaaatagcttctgtgacgtcagtgaaaaaaaatcatccgactctagaaaaaaaaaggaaaaaaaatctcgccaacaaaaaaccaaaaaataaaaatctgtttggtttttttcaccggtatttttgtgacttgtttttgcacgcaaatgaatttttttttgtgcgcattggtttttttcgtctggttttttgaatccgttcactacgcttcccgcatgtctcccgagttgaatctcagcgccatattgattgtacgttttctactacaatttgattgaaaaaaatctattcccactcctctctcatcatttctccatgattttcccagctttatttcatcggatttaatataacagttgccgatgataacgcgccatatcgatagtgcgtcttctattccaatttgattaaaaaaatcgattcccactcctttctcgttattttctccatgattttcctggctttatttcgctggatttaacctaatagttgccgacgatgacgactatcttccccaatcttttttacctcgagtttgatttttgggaaaacggaaagagaagattgagtggatcaaaaaccctcaaccaattttgggtggatttgataggtcgaaggaggcatgccaaacggaggaaggtagcgaaatgggtagggctgaaaacgacttcactcgtggttgggtcgaaggaagcaaaccaaacggagagaggtagcggactggcttatggctgaaaaaggaaggaaggctttcggcctaataccaggaaggattttcattaacttttttaattataatctaatatagcgatccaatattaggattttcattaactttttttaattataatgtatagcgatttcaatatttcattttattactcggctcttaatatatcattgaaaattgtctttacctgttgcaacgcacgagtattttttctagtgt

SEQ ID NO: 8786 - DNA, 1501 bp, Oryza sativa
tgtcccagtcaaagcaacagcctctgtgatgtcacccgtgtctcacttgagttctgtaactcggaggaggacgacctctcataaaccctaataagcaccttccgtaataatagtaggcttcttaattcctcgcgatcggccggtcgatcgatcgttcctctcgcctgccgccgccatacccacgccccgccccggccggcgccatgtcgagcgacgacgaggagtgcttctacgactacgaggaggaggaggaggaggaggaggagccgggctgggacgacggcggcggcggcgacaccatgctggtcgaggaggaagcggcgttgccggagcgccccgtcgattgctgggtgagtaaagccatcccgacgtacgtacgtatagcgatcgcatatcgattgagcaaaggggattgattaattatgtttgttaaatcttgatctgatccatccatgatgcatatcaagcataataaaggaaggaattagaaacgacattagatcagatttaatttgcgcgttcttttagttattctggggaaaaaatgagttacggttttacattacttctaatgcacatgcataatatgttagtatttctttatgctttgcatttgtgaaaccatcggtgaactttaaaaattcttgccaaatatgttttcaatggatttctccctctgatttcaaatatgtaccgttttaggcttttagcatatgttctcagataccccctccccccctaaaaaaattgtgtcctttaactggagttgtttatatgcaccttttcttttcttgctagttcgtctttacgaaataaatgctaattttgtgacaaataagtgaatcatccttttcaatgtactataaatgaagcgcaacaaagtgatttgaccaatttttcaaaatcttctgggcaagcttagaacatgtactcttggattcagatggagtatgctttagtgcacggcttaatgttgttcgagtttggaatacaactgggatacatatttttctgaaaggtatatgtgagttaatttgcagccataattagcatgttttttgtatgataaatggatagcatactcacaagcctaaaaaatcccatccacgctgatgttatgcataaaaacattcacaggtaaaccgagcaatttgaaatgtagccactatgtatgttgggttaaatttaacctactggccggattggtcgactcattctaacaaatctcacgtaaaaccaaggaagtgtggcaagattatattgttaccttcatcgaagtacatccaaattgtttttctatcactaagtataccccaattattttttcaaagcaatcattaacactgattatttgagatgggccaataaaaattgtggctgtattgatatgtgactgccatagggtagagggggaatgtcacctctagaaaatgctttcaaatgagagaacaagaagcattttgataaagaaaaaagttgaatactacaacgacaagtaata

SEQ ID NO: 8787 - DNA, 386 bp, Oryza sativa
caatgacctacattgtgaaacggagagagtactatgttattttaaaaatgtatgacacgttagaattttccgcacaacgtttgatcatttgttttattcaataatttagtataaacatataaaactaatcgatgacaaaagaagtcagaacaaaataaatgatatttatataatttttaaataagatagatagtcaaatattatgtgaaaaattaaatccgtcgtatatatatttttgaacgaagcatttcatttttcgcataatgttttaccatctatcttatttgatttttcggatatatatttttgaaatgggggagtatttgttggtagtaaatgagaaagatttgatgatctttttttttttgcaattttgttcgatcagg

SEQ ID NO: 8788 - DNA, 1501 bp, Oryza sativa
aattaagaagctgttttccacatcgaattaatgatacagccacggtcacagtgatttttgccatcgaagtcgaagcgccgtaatcgcacaaatgtgtggcagatatagaattgtgtcagcaagaaaaataagggatttatagctggttatataatcagttagagcacgacagacacaggtgaaaaattattgactctcatacaaaagccaaatttacacacgtggttcaagagatgaaataattatatagagagcagataaaacttgagacacaccttttatactaaactactccctccgttttaaaatgtttgacaccgttgactttttaatacgtgtttgaccatttattttattcaaaaactttaagtaattatttattcttttcatatcatttgattcattgttaaatatactttcatgtacatatatagttttacatatttcataatttttttaataagacgaacggtcaaacatgtgctaaaaagtcaacggtgtcaaacattttgaaacggagggagtattatactaccgttcacaattataagaatattcaagctttatatacacatagctagacaaatagtactcacttagatgtataaactttaattccttatttgtgcacgggtaactctaatagtatttgctagctctaacacccatatttaaatagccttatataacaagttaaatagtagagccaactattagacatggagtataaattatatcggtgttatccaaaatttgtaggagttagctattacattgtattagctactcaataatcgatttttacatgcggtcaaaattgattttcgtagacagctaggtgactcgcttgcacccatgtgtctgcgaaaataaatttttgcatgtgggtagttcaaccgttttcgaaaatacaatttttgcaagcaaaaccgtctgtctgcaaaaataattttggcaaaaaaaatccaaaaataaaaaatctagaaaccccggaatctaccgccgccatcaccctcggatccgctgccatcatcgtcgtgccaaagccgccaccatcgtcgcattgggatccaccatcatcatcgcttgaagccaccgtcatcgtcatcgctcgaagtcaccggatccgtccctcccatcgcaccgttatcgctcaaagtcacaagatccacccctcccgttggtggatccgcgtgagaggggcggagagacgacgggcgagggggaggagacgtcgaatccgcccctcccatcacacccgccggtggatccgcgtgcatggggtgcgtaggggtgacgggatccacacgggaggggaggggctgcctataggatcaagatgttgaccaaagggggtgaatagacgatataaaaaaataaatgacacctaatcaaaactaacctaaattgctaggcttgatgagagaaaatactaactaagcaactatattaagttttgcaatcctagaatgataagggctcaaatagtccctataaaaca

SEQ ID NO: 8789 - DNA, 1501 bp, Oryza sativa
ttggtatgtgcacaaccccccccccctggggtggggggtgtgtgtatataggaggtgctggatttgggggttgatggggggttgtgctttggttgacacttgacaccagggtttagaagttgctacttttgggagaggggatggaggaatatttttgtgggattatattgaatgtcctcttttaatggttggtgtgagccggtctaattggtagtatgtgtgttttgaatatggtaggttttaggcatggtttatatgtaataatgtgtttcaggataaaatagatcggcgcggtatcgtgtttagtagtacttaaaacactttttttattattatatccggagtgtgagagtaaaaataagatagtattgatgacacatatatggcgtgaagctccataaaatcaatcatgtgttttgcttaaggacccgtgtaaattttaatattcttttcatgtgatttagaaaattgttttgatattgtgttgtataattatgtaagatttttttatagtaagttttgtttaattttttatatttcactcacaagtgatataagagtattacttagctaaaattgtattatatatggtgaaggattctcatttctatttagtactcaatatttttgcttcagatcagatagtgctaataaaactaacaaacatcatcaattttaattgttacattttcttagttctttcaagatttacgtatgtagataaatttttttgcaaaactagctctatttgacaccttagagaagacaaaacgtagcattgcaccacgcgtacactcatgcaagtggttgcgttacatatcaaaacatgcaacgtctgccacctaccatgacatcaatatgggagactaccgcttaactgattatgttgctttatagtagtctcaagctttttagaatgcttttcgaatatttgtctgattatcagaacgatgcgttgctattatatctaatgtttgcatactgagaatctggtgattaaaaaacatatataaatcatttgttcaatatggtatgttgatgtaagctagaactggattactttattgggggaggggtgggggtgttaaattatacccccttcatttcatattatagttcattttgactttttcttaagtaaaacttctataagttttgactaagtttataaataaacgtagcaatatttcgacactacaaatatactattatactattaaaagtatagccaatattagatttactgaaactaatttggtattgtaattgttgctatatttttctatagacttagtcaaacttgaaaaagtttgacttaaagaaaaattaaaacaacttataatataaaacgaaggaagtatcatatactccctccgtcctaaaaaaactcaaatcctagctatatgaacctagacaagtatttatccaggttcatagccagaatttgattctttttaggacagagggagtaatatgtaatttctcaaacgaaccctatagg

SEQ ID NO: 8790 - DNA, 1353 bp, Oryza sativa
tattctgttaagaacatgtaacggtgttaactgaagctcaaccacaaaatgtctctttatgcccttgcttttttaaccctattatacgtgggacccacccgtcacttctctattctctcttctcttctcttctcttctattctccactccactccactcgcccgagcaccgccgccactcctcgtcgccgcttgccacagcccgagcaccgccaccactcatcgttgtcacctgccacagcccgagcaccgttgccgatgaggaagccatcgtctgtcacgcccagaaatttagcccaaatttccagactattttgtgtattaaatctctgtccaggaccagccagggtacacaaaacgacaagtaatacacagttccaaacgtaaataaagcgtaaaatacttacagaagaggcacttagtcctcacaccgaaacaaaagcagcagcagcggaaaaaaaacgatcctagcgggccttcagctccactccacaggcaaaactcaactggggtctgagccttggtcctctaactccatcttcagctcagaagcactacacttctgaaaagggggaataatagcaaggctgagtacaaccaccgtactcagcaagccacaccaatgatgcagacgtgcaaagggatacaaggatggtttgtggctatttgcataaaggcggttgtaaaacattttatttagcaaacagtaaaactgttgaataattaaagtaacattaaaatctccactgatcaacgctacaccacgttgaacaggcccaaccaacccacctgtactacagtgcattgggtcgatttattaagtgtgagactaatcacggtgaatctggtcgatcgcccataaccacgggcacggctattcgaatagttttactctggccagaggtgcacaactgtacccataagacacaacccaccaacatgtcaccgcgtcatcatgtgcccatgatgcacacgtcaccgtgtcgagtgattgtgatgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccataaaaca

SEQ ID NO: 8791 - DNA, 1501 bp, Oryza sativa
acgtcacagtaggtgcgagatgatatatgtaatacaaaccatcgcatgcatgacgtacacgatgccagtattaagattgtctacttgtctgccctaaggtgtaatattttcatgatatttatcgacaatactaattcttttaaaaattataacataattaacatctccctagaattcgacgtgagctactgtattactttgttctttatcattatgttgtaggtatgatttttcttattatctttatttttttatatatgaccccctatagggttcgtttgagaaattacatattactccctctgtcctaaaaagaatcaaattctggctatgaacctggataaatacttgtctaggttcatatagctaggatttgagtttttttaggacggagggagtatatgatacttccttcgttttatattataagttgttttaatttttctttaagtcaaactttttcaagtttgactaagtctatagaaaaatatagcaacaattacaataccaaattagtttcagtaaatctaatattggctatacttttaatagtataatagtatatttgtagtgtcgaaatattgctacgtttatttataaacttagtcaaaacttatagaagttttacttaagaaaaagtcaaaatgaactataatatgaaatgaagggggtataatttaacacccccacccctcccccaataaagtaatccagttctagcttacatcaacataccatattgaacaaatgatttatatatgttttttaatcaccagattctcagtatgcaaacattagatataatagcaacgcatcgttctgataatcagacaaatattcgaaaagcattctaaaaagcttgagactactataaagcaacataatcagttaagcggtagtctcccatattgatgtcatggtaggtggcagacgttgcatgttttgatatgtaacgcaaccacttgcatgagtgtacgcgtggtgcaatgctacgttttgtcttctctaaggtgtcaaatagagctagttttgcaaaaaaatttatctacatacgtaaatcttgaaagaactaagaaaatgtaacaattaaaattgatgatgtttgttagttttattagcactatctgatctgaagcaaaaatattgagtactaaatagaaatgagaatccttcaccatatataatacaattttagctaagtaatactcttatatcacttgtgagtgaaatataaaaaattaaacaaaacttactataaaaaaatcttacataattatacaacacaatatcaaaacaattttctaaatcacatgaaaagaatattaaaatttacacgggtccttaagcaaaacacatgattgattttatggagcttcacgccatatatgtgtcatcaatactatcttatttttactctcacactccggatataataataaaaaaagtgttttaagtactactaaacacgataccgcgccgatctattttatcctgaaacaca

SEQ ID NO: 8792 - DNA, 1501 bp, Oryza sativa
cggtgtgggtgggtggggaggcgaatccggctcgagctggcggattccgatggggctgggaggctagggtttgggtcgcggaggcgagggcgaggcgaggctcgcacgcgcttatgagggggagggggagggggaggagagaggcaacggcattggagcggagtcggagaaagaatacagtacagcctttttttttctttatttgttttcttttatttcttctgtggatattttaatggcgtttcggttggaaattcggaaaggggaaggggaaggggaaagggcaagggattagagctctggattgaccagtttgccctttaggtgttgtatttctacccgtgttcgtcccaaattaaaggggaaattctaaaaaaatcaaaataccattgtgagtttgagattctgactcgtatgactcctaaatttagtttcagaaattggatctggagtaaagttgtggagtagtctaaactcagctgcatatctctagtttattttgaaagcgatccacccagctccgctcctattttacatggagctgaaactgtttggctgggctccagctccaggagagatagatttagagttggagctacaagcccctaattcatcttggcttgagatttctttgtatttggtgttgctcgtgtattttttttcctttgttccgcatgtgttatatgaattagtatatctcttgatggacatgactctaaacacatctgacccatgtgaccatggctactcgccaattagtatccacacgatccatgtgtggggtttgtagctccgagaatagccgagcaacggtaattgagagaatctcaaataaagattaattagaaggggctatttgcaacaaatactcttgtaaagaagaatctcaaactcatgataacactcaaggtggttttgtaattttctccaaataaatcttttttaagtttaaactttgtttcaaaatttatttcccacctaattatttttgaaagagggagtatgtccgaggtccattcgaatttaataaatattttactcgattatacagataaattaaatattactaatattataaaccaaacaaataacttagataagtgtctaaacaatgtaatataggaaagatcttttgagaaaatatatatttgtaatacatttgagcaaaggtatactaatgctcaaatgtattataaatggtccattacttttacaaatgttttacagatatatatcgtcaaatttgtgtgggaaaagatgagaaaaacacttatataaatattctatatatgttgatgtgttacaatgggattgactcttattttcttatatatatatatatatatagcttccaccaaatcaaatcaaacggctaaaaagtatatatttcttagtatgagttttgtactaatgttttaattacgtagaacactgctttattcgtcgctagatattgttcatccttgaatttgatcactttctttgattattacttcccctg

SEQ ID NO: 8793 - DNA, 1501 bp, Oryza sativa
attcgttgtaatttgttgtaattcaatctttataacaagattttacatgattatattctgataaaaattactttaattagatatataaattactttcaaatttgatttatttaataattagttattatgaaaataaattcaataaagcttaaagtaattatcataaatcataattacttctattttttcttatttttttgggaaaattgtttcttattttaaaattatcttgcagtgtaggtattttgtcgaatgtttagtcctaactctaagaaaatattactacctccgttttaggttataagaatttctagtattgtccatattcatatagatgttaatgaatctaggcacacagattcattaacatctatatgaatgtgggtaatgctagaaagtcttataatattaaacggaggaagtaatattttctagagctacttttccctagtagtgtactacttacttataataacttctatattctcttataattacttcatatatgaagataaatttgcttttctaaaaaaagacatagtgatacattaaaataacaaattaaattgtatttactcgtgaatcttctctacattttactttgcataatgccttatttcaacaccatccactacatttactttcaatgctatgcagagttacttccattataaaacctaattatttccacaatttaagtaaattacttttgaatgtttgaatacaatcaatattggactcgttctgttacatattttgtgtggagtacgatggttcaaatggatcttaaaaataatacaaggtttaaagaatatttatcgccaaagattccatacccaaaagaaaatagactagtgtaataaggattcaattgttaattggttggtgttgacctccgcatgtaaatatgtgccacgtcaactagatagcgccgatcggactttgcatgtatctcgcgataaacctaaatagtgtataactagaatttacaaaaatttcaaataaaatctttaaaaaagaaacgatcaaatctgaagagtcgagtactaaatctgaaaagaaacgatctttaaacctgaagtgaagtgacttggataatttgatacagtactagatctgaaattctgaaccgtcgcggctcacaatcggacggttgctagatctgaaattgatagatctatcaaatcggacggctcacaagctctccccatttcctctcaaaaacccccaattcctcagcccgctgtcctgtgttaaaccctaaacccagcccaccgtccatcctccgccgccgccatgcggcgccaccaccacctcctcggcctcctccgccgcgccacggcctcgccgacgcccgcctcccgccgcgcgggcccaccactccccggcctcctccaggacccgctgcggaatggcgccgccgccgctggcccccgcttcttctcctcgcgcgccggccccggcgccggagctgccgcgaagagcctgatcgaggacgagg

SEQ ID NO: 8794 - DNA, 1501 bp, Oryza sativa
gtacagccgggcagcgcagcaaggcagagccgctggagtactggagtccgatttggttgcaacagcgacaggggctggggctgagatggttccatgcatggatgtcggcgatggcggcgggccggcggcaacaagggcaagggcattgcccggaggtggatatcacgtctaaaagggctggtcgtcaggctgcggatggaaggtccgggagatgtggaacgaagccacaaagcgcggcagggagtaatgccggccgagcgtgattgacgggggaggggcagagaggagggcatctcggcgtcgtttgaggaggttaggtgcggccgcgtgggtgggcaaccggaagcgcgtgatgaatgtacgtcggtggggatggggcggtgaatgcgcgcgctggattactgcgttgcacgatggatgaattagcgggaataagtgatttggccatccgattgcaaaggtacaactcctgctttttatattagtatagatgtgtcctccctcgacagcaacattcttaaaacatgcctataggtacaaattattttcctcctattttgcctcccctgaactgaatctctatactttctcagctgatcatggggcaacctcttttctttatgcctatgaactatgaagaattggttagttgatcacagacttcagtgctgaaaataatttcaatcactgcctaaaacaatgaaaggtcacagtttacagttaagcagactatggggcagtaacctgcagtttctcagtctaaaacaatgtgaaagtcgcggatgaatgtttggttgaacaattacgggagaactaattatcatttcttttcattgatcaccctagtactaagtatctattagtagccgagtaacatggagctacagccatttatctcaccaataaagttcagatccatttttttcttaaaaatctttttacagaacaattaagctaatgaagcaatgaattcatggtttgaaactgatatagctgagggcatacaacttacgactcacaacattaatgcatcaagaaaatagtaagggtgcacatgaaatccatgtagccaataaaatgagtaaaaaagaaaatagtcaaatctcatgcactctttcacatttgttttcagatttattattacttattcagaagggtttatacaaagcaaaattatgttgggcacaattcttttgcatccttagtctgcaaaaataatgaagaatctgagctcctcttatcatcaattggtgtgcctaatattttggaagccaatttgatgaactgaatagaagcttcttaaacatgcccccacacacttatcttgtcgatagagcagaagactgaagcatcctaatcactaaagagaattttggatggtcaaaaactgataatgcatcatctatctcaatcaaaccgagtcaacatatgactaattacttgaagaagctgctcaatcaagcaaataaactaaataatgaatcaagaaacattggaaaaa

SEQ ID NO: 8795 - DNA, 1501 bp, Oryza sativa
aaatgcacattcaacatcttttctcgttgattcttgatgaagaggaaacattttttccttctccaattgacgatgccagatcgactgaacaagagttgcccattctagatagattccattggcgtatagtatcccaaattatattaatttccactgtgtagcgcatccttatcgatatacccatgagttaataagtgaatgtatgggattggttcaaaacactgatctcatcatttgatcctgctacaccgaacaaacaatgccaaatccaccggtcacaggatgccactgcctccacgatgattgttgctgcaccatagtctccatgtgtgtacattgctttctaactgtttgagcacttcttccacttcttctatgatatgttgaacatcatcaccggtgggtttcctcatatattccagtctgaatattgcaatgatgccttgatgcatgtgtgcggttgctctttttttttttagataatggaatatacacggatgctcttgtgttcttgttgttgatttgtattgtggatgcggaataggagggcatcgatgtgctgggctgtgaattttagagagccgcttgaagcatcgacttgattcaagccatcctctatgtttttatttattcgagggaacacatcaatgtcggttttaaaatgggtaccgacaaccccttcatcagtgcctaattagctgtagtgtcggttaggaaaccggcactgatatgccttttcaactggtattgttgacgatttctgtatttgtggcaaggtttagatgaggaaaggctccttatttgacggatcgatcgaatcaatcgtgcccagcaggcagcaaagtatgcatgcatggccaaaccatagatggtgggcccacacactctggctctcctccctccttctaccgtacctcaacgccgtttcctatatttatgtcacctcgccttcgactacgtacataccaccctgcgcttgtcatcaaacaacggtcgacctcaaaccaccatcagatcgatcgagcttgaaacaaattaagccaccaaaagcaacattcccttggtgaccgtagctagactcatccatcatccatgggagacgcgctgtgtgatcagctcctcttggtggacagcgacggcggcgagttcatcccccaccacgccgacgccgacgccgacgacctcttcaccatcctcgagacgtgggagggctgcgccaacgtcgtcgccggcggcgcccccgcgaccacgacgacgttaggtagtcctattgccgccgctgcctgcatctccggcgttgttggtgggcagaatcatcagcagctgccggaacctgccgccgcgaagaccgtgccagccaccaataacaagcggcgggaggaggaggtggcggaccgtgacggcgacggagacgacgacgacggttcgccgcagaagaggcgcaagtgctgctcgccggagtcttcgacgacggacgtggcggcggcgacgacgcccaaga

SEQ ID NO: 8796 - DNA, 1501 bp, Oryza sativa
tccaagattttatgttaatcttttgtttaaatttcaaataggtctcaagaaaaaaaatctcaaatatatatgaagttaatgtattttcctctcctaaaaaggcaaactattatcaactaggtacatatatttgtacaaacgttaaatttccgttaaattccgattaatcgaccgtattccgattaatcgtttgacggtaccctctccgtccaacatccgcataccgtcttccacaacactagcaatgacaacgccacgccaatccccgtcgcctcctcgctcttcctctcagccgcgcaaatccccgccccctcactcgctccgcttgattccccccgcggccgccacagtccacagtcctcagcggtgtggcgcagcggtatccggcgaagtccaatagacgtgcaggcgccgccgctcgtttctgactgaggcgatgcgaatcggcgagcgagctctccggctcgacgtggtcacgaactcacgaagacagcagcggctctcgatctggcaacatgcagcaacggcgctctaccgtccgttggcttgaacagcggcggatgcactcgccggcgcattgcatcgacgacaacggcagtccaagctgtggggatctcacatgcatcttgctgtttcattctcctgtgttccctttcttgctctgctactccgttaaggtgtaggtcaattttccccaattttgaagtttaaattcaaattttgcttgaaaatttcgtacgaaatttctgaaaaaaaatccgaaatttcggtaatttcgtaatttcgctgacccccaaaatttttcctctttccgatagatcaaaccctggtcatgcctccatcgtcggaccatctcactcgctgtcgtgcctcctcgcgactcctcgctgcacgccaccgcatcgtgcccctgaaggcgccgtggtggttgccccttccgccccagcgccaccacagttccatgcaactcagtttctcacgttcaatgagtggatgacaagtgataataacatggtacatttgtatatatatgtttttccaatgtttcttgattcattatttagtttatttgcttgattgagcagcttcttcaagtaattagtcatatgttgactcggtttgattgagatagatgatgcattatcagtttttgaccatccaaaattctctttagtgattaggatgcttcagtcttctgctctatcgacaagataagtgtgtgggggcatgtttaagaagcttctattcagttcatcaaattggcttccaaaatattaggcacaccaattgatgataagaggagctcagattcttcattatttttgcagactaaggatgcaaaagaattgtgcccaacataattttgctttgtataaacccttctgaataagtaataataaatctgaaaacaaatgtgaaagagtgcatgagatttgactattttcttttttactcattttattggctacatggatttcatgtgcacccttactattttctt

SEQ ID NO: 8797 - DNA, 1501 bp, Oryza sativa
atatgcattgatgcatgagacagtattggtagtactgtcgtactacgttacgtaggaccggatgcctgtgccaataagtgatgtgatatgatcgactagctagcagatagatggcatagtgcgtgtaggatcataaatgattgatacccaatccatggagactagttggagaatctaacttgttcgtgcaccaatcacattagctagctagatattacatactttctcaatctaaaaaaatgaacttctgactagaagtaaactatgctattccaaaagttcaactcaggctatatattatatactttctttgtcgtgaaaaaaatagcttctaattagaagtaaccgtaggctatgtccagattcatagcaagaaagtttgtatacattggttttttaagacacatggggtagatcacttatagttagaggcttatatcgatgtgtagacgatcttacccgcttgacgtagaagcatggcatgagggagcgaagcacggcgaggttctcgttcatctgcttcctccggttgcgctccacggcgatgtgcgccgtcttgggcgtcgtcgccgccgccacgtccgtcgtcgaagactccggcgagcagcacttgcgcctcttctgcggcgaaccgtcgtcgtcgtctccgtcgccgtcacggtccgccacctcctcctcccgccgcttgttattggtggctggcacggtcttcgcggcggcaggttccggcagctgctgatgattctgcccaccaacaacgccggagatgcaggcagcggcggcaataggactacctaacgtcgtcgtggtcgcgggggcgccgccggcgacgacgttggcgcagccctcccacgtctcgaggatggtgaagaggtcgtcggcgtcggcgtcggcgtggtgggggatgaactcgccgccgtcgctgtccaccaagaggagctgatcacacagcgcgtctcccatggatgatggatgagtctagctacggtcaccaagggaatgttgcttttggtggcttaatttgtttcaagctcgatcgatctgatggtggtttgaggtcgaccgttgtttgatgacaagcgcagggtggtatgtacgtagtcgaaggcgaggtgacataaatataggaaacggcgttgaggtacggtagaaggagggaggagagccagagtgtgtgggcccaccatctatggtttggccatgcatgcatactttgctgcctgctgggcacgattgattcgatcgatccgtcaaataaggagcctttcctcatctaaaccttgccacaaatacagaaatcgtcaacaataccagttgaaaaggcatatcagtgccggtttcctaaccgacactacagctaattaggcactgatgaaggggttgtcggtacccattttaaaaccgacattgatgtgttccctcgaataaataaaaacatagaggatggcttgaatcaagtcgatgcttcaagcggctctctaaaattcacagcccagcacat

SEQ ID NO: 8798 - DNA, 1501 bp, Oryza sativa
gagtattaattaggtgtgtgctccacgtacacccagattaatcgatcaatctttttcttttataataatgaattaaaatctggtatctatataaatgtgcaaatatggctatacacaaggaaaggttgtgaaaagaaacacttattatactccaactaggaaaatagcttgcgcgtatgcgcggacacttatttaatgttgcttgaatttttgttacgaatgtttacgtgtatatgatatttataaaatagatcttgactctattttaaacatgttttcgttaatatctaatttggacatattacttcaaaccgtacaaccttgaatttatgaaaacatgtgtcatgattatggaatgctggagttgtttcatatctatgtctactatatatgattttttaacccggataaaggtttttttaaatactaccaccgtaatttccaaagcaccatattattggttatattttgacaaatatctataattttgagtttttttccaatgcctattattcataatcagatgagacacctttactaattaatttggagaatgaatctatttttccaaacttatttacaataactaatttattgaataactaatttattgaagtatactttatagtcacatcaatagggtgtatggcatacgtccatcaaattatgcctgataagttggaactcttcaagtataagaaaatatatcataaatagtttattgcatatgttacttgtttgtttatttgttatcaaaactatttcacacagagaaaaacatacatatgaccataaatctcatgatggtttaagtggttgtattatagcaagaataattggcttggatttttttttcataatttttttacatggatgtaacatttaagttgcccacttatcagatactaatgaaataattctaaagattaaaaaaaattgagaatcttaatctctaacaaattaaaatcaaatcagatccacttaaaaaatacacaactaaattgtattgttttcatttattttacatatgtagatttaaattagcattgtatagtcgtcaagtgatatttgacatctgaaatatgatgtaaattttgttaaaatcagaaaaagtacgaattacccctgtaaacccaaaaaccagacatctttcacccttaactattagtaccaaaagaattaccccctaactcaacccggagcgtggttatgttcctacataacagtccagtaagcattttttagaaaataaaatacgtgggacctaccagtcacactctctaccctctctatctctctcccctctcccctctctctccctcatttccttaatcccattccctagcctctctctcttatccctccccttgctgcagggggcggccgggcaggcgcgccgccgccccgctgctgttctccttctccttcgtctgtccattgctcttgctctcttgattgatccacctcgttgttcttgattggtgctttctgtctcgtcagg

SEQ ID NO: 8799 - DNA, 292 bp, Oryza sativa
taatttacaaactttgctcaatacaactatggatatatggcaaacttttttcactggattataaatacaaagttaaattagctacaaccactaaatatataattaccatgccaaataaattctatggacgtagttgcatttcaatgttaaaactctaatggatatatgcaagaccacctactttttttttgtatttttctcattttctctcttttttccctatgatatgtgtaagggcaaattgggcatttcatcatatatttgcatcgaaagatgacatggcatgcccaca

SEQ ID NO: 8800 - DNA, 1501 bp, Oryza sativa
acaaaaagaaagaagtctaatttgtatacttgatttggataacgttgttttgcgaagaatttgaattaggagagaattcagaaaaggagattttctaatttatttgagtgcaatatttagaggtggagtttgagggaatttatttggaagcactcaaataggaaagtaaattaatagtattcctcaaaatatttttgggaatgtggtaggaaaataggtggaggcaaaaggataggatttgaatcctaaaatatatggcatgggtttcaaggaattgtttgaggctaaaaggaaatttaggtgacaaggatataatttattttcttagcacaacagcaattattcacaatatttgtaataatatttttcttgtgccgagaaggaaatcaagccacaggaattaaattagcggctagatcaaaaggaagaatttagatatttggcgataaataagaataggtttggaatcaaaggataggtttaaaatcaaaggatgggtcgacaattaaatccaattggaattgtttggtttaggttctaggacaatagtggagaatttcttggaccataattcataaaaatagaaaggggttttcaaactaaatttgaataaaagaaattttaatcaaaagaaggttttaaaccaaatcaagaaatacctcaatttaaccaaatatatatttttaaatgaaaaacacaaaagagattaaataacagagaggttttgtgcgagttagttctaggaggtccctctaattatattatcctaggtttaggaagttattaagatcataataatcggcatgatgcaggattagaaaatgacgcattttcaggatgttacatttgggggggggggggggggaattgcatatgtaccattgcaaaagaatgacttcgctagaatgtcattcttaaaacaggcttcggtaaaataccacgttcaacgaagacggcttcgccgaaatgccatcctggacgatattacccttggctccacttcttcctcctccatgagccggaggagctcaccggcgacgactatgtgccatggccaacactagctgtagcattggagaggagatgcagccacgacgtaaaccacgatggtcagcagccaattcattgaggacaagcagagccaattcgtccttctcaaccagcaagcaaacaagcagaacaagcagcctcaaacagtcacaggtcaaccacgacgccatcgacggctccgccgcctcgtcgtccatcacggcaatttttcgctgtcttccgcagtggctccaagtctgggtccccgcatcaccagctactaccgctcgccgccgtctcattgtcctccatcgtcaattgcagcgctgcccttccgtcgtggtcctcacccgccgctcatcctcacccgccagcaccagatctggtagcatgcctcgacggtgatggcagcggtggtcgttgtcatcgcgcgcgcccgcggctggcgagagcacgtggtgggcgtgcatgc

SEQ ID NO: 8801 - DNA, 1501 bp, Oryza sativa
catgtgagatataaaaatatttcacaatatcatgtatttgcaaaatattgtacatttcatattatttctttgatgtttcactcgttgggactaaatatttcgtatagttgttattggtgtagcacttagtacttatacatgagataggagagatgaggggttgcatgtagcacggtgcagacatcaggcggaaaagctagctggcgcgtgtgccgctagcgtgtgttttgcgcgtgttcacgtaactaactcactgacggttagttaaggataatgacagtaattagggaacaattttctttttttgggagatttttttactaacaaattgaaatctttcaagttagattttaaaactttcaacttaagatttaaactttgaagacaaattttgaaaactttctcactttgaaaattttctactcgaaatttaaatttgcaagaaaatttaaaaactttcaactccaatttgaaaactttcaagtccagatttgaaaatttttaaattaagatttaaaaattaaaaacttttaactcagatttgaaaacttacaactcgagatttaaaaactttcgagtccagatttgaaaatttttaagctaagattcgaaaatgtacaaatcaaaatttaaaaattttcaactcaaaacatttaaaaatatgtgtgctaaagattaaaaaaataatcgaaaaaagcgccaaaaggaaagataaagaaaagaaaaaaaaatcaggcgggggaggcggcgccagctggcgcgcgccaattagccacaccgacatcaggtggaaacatgcatgtctgcggggagttagctatggcctatgggcgcttgatttctttttttccttccgtgcgtccgatccgcttgcatcagaaatcagaataggaaaggaacaagaatttttttcggttttagattttttttaaaaaatatttacagaaataatctatcggccaaaaaaattacaaaaaatagaccctgccgcccacctatggggcggcaagctgacgtggcaaacaggggaggaacgggcggtgacggagggagggttttttgctggaaaacccttgccgccctctggccgggcggcaggcctcgctgcctataaaaggcctcctgcccagcccccagccctcattcttctctcctcaattccagtgaaaaaaaaaaagaagagaggagaggagaagagaagaaggggcgaagccctgccggattcagacgccaatttcaggtaatattcatagatcctatatataactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcattgacagata

SEQ ID NO: 8802 - DNA, 1501 bp, Oryza sativa
tatatttaacaataaattaaatggtagggaaagaattaataattgcttaaatttttttgaataagacgaacggtcaaatatgtttaaaaaagtcaacggcgtcaaacaattagagatgaagggagtatcatccagtaggctatagaagctcgtagctgcgacaccttcatcatccgcctagcttgctccattcgtactagaagatatttttgtgcaggtttacctatactttatttcacgcgtgcaaacgagactattttatgattttttaggtcatctactaatttgaaaaatgaactacagtttcactataggaccatattgtgatttcgatgccacatcacctaaaaacacaatgaatatagactaagtttgaaatgtgaacaggtgtttatagtggaaaaggttgagtaataacgtcgtctggtttggaagttctagttgctttacatttttttgaaagaaatagttgctttattacatagtagtttccctgctacatagcactatatacgacggttcacctagacccagtttatctcaggtgtttcttcccacctatccaatacgtttgttcctttctctcatttttcatacacacgcttcccaaattgctaaacaatattttttttcaaaattttactatataaaacttatttaaaaaatcatattaatttatttttttcaaaaattatctaagacttaattaatcacacgctaatgagtcatttcattttttttagggtttagctcccaaaactaattgagaagagactaaaacgtgttttagggattagctcccaaaaataaactaattgagaagagaccgaagataagaaataaagtgccggtattaaacaaaggcacataatagttgagaagagaccgaagataagaaataaagtacgtgctttgttgctatataaggcaaattttaatttttgagctactgaagacgagtccgttgggaaaaaagagcgaaagtcactaaaatattagcatgcaaaatggctaaaaccctcaatagtttagctagctaaagggttgctcgatcggaatctaaggccctatttagttcccagaactagcattttcacgctgtcacactgaatgtttagacacatgtgtggaatataacatgtagacaaaaggaaaaaccaattacatatattgcgtgtaaattacgagacgaatcttttaagcctaattgcgccatgatttaacaatatggtgctacagtaaatatttgctaatgacggattaattaggcttaataaattcgtctcgcagtttcctggcggaaactgtaatttgttttcttattggaatacatttaatacttcaaatgtgtgtttgtatatccgatgtgacaaccaaacctaaaaattttccccaactaaacaaggcctaacaacggtgatatatatatatatatatatatatatatatatatagcgccatagtccttgtcacttcacatgcccttgtcattaattgtggt

SEQ ID NO: 8803 - DNA, 462 bp, Oryza sativa
atcaaaatacccctaacttagtgggatatagaatctagaggtttataaatacatatgccgcacatatatgaccttaattaggctcaccaagggcaaaagaggaatcacatatttaagtgcgtagtgacatatattcacaatcaaaagtgatgagtaaatgaaaatggaggtagtacgacacacgtgtcgtcaaaacaagagatacacatcctggtgttcaaaaatatctaagaatttgaaaacttttaggacccttaaattggaggattgccataggaattttggagtattcaatttcctaaggaatttttcctatgaaacccattgattcacataaaagtataggaaatttttcatatgattgcattcctatagctcaatttcataggaaataagcaagaggtccaacctcttggaaactttcctatgctttgtttgtttcctatggtgctatcatataga

SEQ ID NO: 8804 - DNA, 1094 bp, Oryza sativa
aggcagagcccctcctccctctgccgccacgcccccgctcccctcctcctttttcccaaagcggcaaggaggcaagccccttttctctccctcttttctcctttttccgtcaccgccggcgtcatcctcctccctccgccctgtcgccgatttggacgcgagcgccgagcgccagctcgcgccttgaccgccctaagtcggttcccaaaccgccattgccgcccttaaagccccgggcgccctccctctcttctccttccatcgcctccactccattgccgccacccccgtgctctgttcgccgtcgccgttcgtcattgcgcgtgtcggaggagccggcacgagcaaggacgcggaagaggactccgggcgcgccctctccttcctcttccccggcccgaggccggagagattactcccgcgccgtcggcctctcgtcactgcgcccgcccgcacggtagagcatctccccgttctccctcctcgctccatctccccccttagttttcggtagtagcttgtgtagcctccccgtatctagccggcgccgccccgaccgttgccgtcgctcgccgtgtgctcgccgccgtaaccgcccgagctccgtagcacccgctcgtcgccggcctcgctcggcgtagctccgcccaatccgacgctagcatcggattcccgtagccgcgtagatgctctcgccgccgggaatcggcccctcgtgacctcgtcgccgtttcccccttcttccgccgccggatgccgccgccgcaattcgccgccgtcgggcatcctccggcgaatccgagccattggctcatctcctctcatcctgtgcagctacccggtgtgcttgccttcgcctgtatcgccgtggttcgctccgccgctcgccgctgtcgtccgccgtccgttccggccggcgtcgtcgtctacctcccgccggcccgcgtggcagccacgtaggcgccacgtcggcgccagctcagccaaagaccgggtcgagccgatctcggtcagtccttccccgtgcgcgcgttccaccgcgagccgtgaggctgcgcgtgggcccgccgcatccgcgtccaccgcgcgccgcg

SEQ ID NO: 8805 - DNA, 1501 bp, Oryza sativa
actccggcaatagcgaactggccggtaactgtcccggaggcgcagaccgatgcgataggaggaggggccggcgggtggatggggggtggcggcggcgagatagagggtggcgaaatgcaaggcggattgacgaagaagcgagctgaggagtgcggtgagatggagggcagtggaaggcgaggcggatgggcaggagcgcgtgaaagatagaaagaggaggagggagggcgcggtgattttgctggggtgaggcgaagcgatgtgatctggatcgaatcgggagggaggtggggagccgtttgatcgacgtcatcagataattttcgatcgttggatgtgtcacatgatgaatgagtaaaatcatttgttgaaggtagaaaagaattaatataggaggtgacttgttttgatgtgatccttcattgtaattatgtttcttgctaaaaagaaggggtcgtaaagactatcactactatatttcctaaacagtcacactatatcttgtcattctttgatgcccattcttaccaccgtcatacttcacatgattaactctcaagccaaccgttccctctgtaatccgctctgccttgttgtgttcattgcctaaaccattgatacatatacaagttatgaaccaaaataattacaaataattagctttgcaggggcagaaaaaagagttctctaccaaccattcaccccctctctggttggcttagttattatgattcgatcctacacttccaactaatttagctttatatgagcacaaacagcaagtcaaattccatgatagaatacgatttaggttcaaattcatgtactttcatgtaagccaaaccgtctgtaatgatagctttcccttaattttattttatttttcattaaccaaataaggctgactgcatgtgcttttcataccttgcttcattcagagtagtttccaatcttttttttagatgttatacatgcaaaataaataaataaatcagtaattgagtttactgctcttgatgttatcaagttcactgaaagaaaagaaaaggtaaatacagttgaatatttgcaagcaccaaggtgatacaggattgaaaaacatgccctcatcatctcgctaactttgataccctcgatatgtgctgccagtttcaaactttgcttaatttcatacgattttgcctaaaatatattcattgaaaatcttcagaattcatttcagctttttttttcagataaagacattaagctgactacataagatgtgcagattccatataaaaatattcttggtaaattagttcatataagataataatacatttcaatcctaataaatttatcctgggttaattttatttgttgtttcgttgtttttcgaatagtaacgtagttccaactcttaaggttgcacggttacaccatatgaacaataaactaaactagatgaataaagggatcgacagagttgcataccttccttgattattgtgaagtcttg

SEQ ID NO: 8806 - DNA, 1501 bp, Oryza sativa
gggtgttgtccggaaaaggctagtgccgtccttggcaagttaaggactgagccatgaagttaagcatgaaacgacccccgtacaaccgcacttctcgtatgggtatagacctagcggagtagatagctgagcggaggtaatatccatgcatagtggtttcttgatgtgtgaggcaggggctctacggtggggcaaccattggtagaaccgcgaggcgggtgtctacagtggtgtcgccatcggtaggactgccatgtgagaatctaaacataattataacttaatgcatgcatgagtcttcccttcccgggtgcgccagaactcctctcactgctagaaaccgtgtacgcctagagtgcatgaggatgtaaagttcatggagcgggtactgccaaggcgaggttatcgaaaagctttgccgtgacgcgtctcatgtgttgggacgaggctcatgtgttgggcagtcgcggagtgcaagtaaagtgtacatccactgcagtgtgagtaaaccaaatctattcgaatagccgtgctcacggttattgagcaccgggacatgtattacacttggctagactctaaattcttaacttgtgtgggatgggatattgcatgatgatttctatactgatgaaaccacttcctgagaggcgggaatgtggacgtcctcagaaaaccatgatgactcacaatggatggtggacagaaccgtcattgtttaatatgaacactggtactaaaatttgatcagtttgtgataggtcttaggtttgtgaaaagaattataaaacttgctttgcgcaaaagaaccatagccatcctttgaatacccctatcatgtgcattgttgctgtggtggcttgttgagtacggttgctactcacccttgcaatatacaaacttaatcagaggtcggagatgaagctttggaggatccctacacttactaccaggagggtgatgaagacgatggcactcgctaggtcttagttacggtcgttgcctgtggcaatggcgtgccgctgccttaactccgctgccttatctacttctgtttttggaatgtattctagaccgctcggtccgatgatttaagactatgcctgcgggcttttgatgtaataattcgcactagactttcgtgtgtgtgcatttggtatttcagctatgaactcgtgtgtaacagactacttgatccagggaaatggtactgtttacacgattgattcctgttataaaaacaggggtccacagagctggtatcagagccatacgactgtaggaaaagaccaaaaggcgccccaccccttttctaagttggccaagggagaaattcccatttagtaatactttcaaaaataaaaacgctatgtttacaaaactttgtacgattttcatcttactcttaactattttcttcacaaaacgagttttactcttagctgaccttgggttttttaaaattagatggcagatcaggattcatccgctacctgggaga

SEQ ID NO: 8807 - DNA, 1501 bp, Oryza sativa; identical to SEQ ID NO: 2900

SEQ ID NO: 8808 - DNA, 1501 bp, Oryza sativa
cccattagtacgccctgatcttcctgggcctcttcagctcgaacatggttcacttgtccgcgtccaaatccggtagcggtcctgttagtttgcggagtcttgaatagacctcgtccggtagtaggggtagtagttccacgaacaatcattgcattagcgccagtacggacaggagttttgtgtggatgagggcagttgttggcgtagtgcccatactccccgcagttcaagcagtccacattcttcttggctccaggggcagccagggttggtgtaggggtgcggttctgaatcgcaaccgacctgttgaatttgctaggtgcagcggggcggttggttgccacaataggggttttccacccagacgaagtggcttccttgagtcgctgaggcactccctgaggtaggcgattcatagaaagcctccttttgcggttgtgctctacagtcctttgatcgttctccagcctaacgaccttgttgattaggctctggaaactctcttgatcttgcccaatcataggtccacgcaactcatcattcagcccttctatgaacttgtcgatcttttcttcttcatctgcgaggtctccaattgcatagcgggccaactgagtgaatcggttcagatattcctgcaccgttgtgttcccttgtcgcagccttctaaactcgttcctcttcatacgcattaccgcagtaggcacgaagttctcgcgaaatgctgcagtgaactcttcccaagtgggttctccatcatcctcttcccgagcttccttgtaagtatcccaccaatcaccagcgggtccctccagttaatttactgcgaagatcactttgtcggcttcgcgtacccggacaagggtcagtttattctctatgatacgtagccaatcttctgcctccataggctcgtctaccgtagcgaacgtgggtggcttggtcctcataaactctccaaagctcgatccgccgcggttgccttggttattcgcaatggcttgtagaagttgggtttcagtggccataactctggccagggtggttaggtcaggtgtcgaagtttcttcattgctggttgacgcccgacgtcggcttgccatctgtgtaggccgattaagtaagtatcctaattttctaactagctcttatggttttatcccattaagggagttgtttcgatgtgaactttgttttgcaagcatggtggaataaactcatttataacacaacaacaataatatcataaataacatcatagagttccacaaatagtacataaatcatgatgcaatcgactgcacacatacgcagtccaaataaggttcatccaaaagatgcatcgaactaaccatcaagctactcgtcaatctaggtaagggggggtgtgtctcgcatactatccaaaaaccatctgaagcgagatcgaagctgcaataatcctccagtctagtcatccaaccatccgcaggatcctggggcaggtagagggtggtcgctg

SEQ ID NO: 8809 - DNA, 1501 bp, Oryza sativa
gatccctacagactccggccatggccgtataacagctcctaaggtacgagtcgaaccacacctcgcgacctcgtagtgcttccacggcttggtcctttttgacttgcaccatagtcctctcgagttcggccacctcgaatttcgtcctccaatattggattcgatgatctcggtcggccaatgcactctcgaggtctgctcaatatggaaatgactaagtcaagtcgttcccctcttccgagaacacggcaaattaagtcgatccgaacaaaaagagcaaaggagatgaggaccaaagtaccaacctaaggaagtcgtcgccatgcccgcctccacggacaagttttgatcaacgtcgtcccgcggcacatacggcttgagcgcaagtgccggaacgactaccggcgactcaggctgcccgcgctgctggacatcctcgacatcgacatcgacatctctacaacgacaacaaagtactcgggatcaatatgctaaagaaagcgaaggtgatgactgcacacacaaagacagtttgaacctacgaaagttttacaagcacaattgattaaggagtacaaggggactgaaatcctacccttcaaaaagggggagaacagactcccccaagtcactgacttcttccatcatgcccttacacgcgtcattagcagccccctgatccaagatcctcaggaggtcgagatcagggtgcgccaaccttacgcacgcgaggacgtggcatgcccaggtgtagatcccgttggacgtctcgtccccgatcctggccgcatgcttggaggggatctcctccatcgccgtggctagttccgcgagtgaagacgtcagtgagaactcatcggggttcgccgggatggtggtcgtgacgccgcactccccggcgagctggtgcatgccagtgtaggtgactcgcagcgagccacggatctccaacaagttgttctcgagctccgacatgcggtgctcaagcccctgccgctgcctctcgttttcggccaccagctccctcattttctggaagtcctcgcggacctccaccaggtcatgtgctagcttgtcggcgcgttcattcgccgacgccgccgccgcagccttggcctcctcgatctcgcgtcctatgctgcgagcgccggcctggaggatgcgctccatctcagcttggagctccccccaggtgaggacgtcagcgggtgggccccgagcaggcacaaggccaccggcagggccgctgggcatcgcctcccagtccctgggcacgaccacaacatctgtcgaggctgctgcaggagacgcactagaggctgctccagacccatcttgcgccgccttcgcccgcgccgccccgtgattttcataaagtcaggctaccaaagttttgtaaattggaagacctcaaattcatctacttacttttcgccaagcatcacaagcctttgccgtcgctgaggcgggggagacgcgtttgaggcctaagtaagataag

SEQ ID NO: 8810 - DNA, 1501 bp, Oryza sativa
ttctttcttcatgagattacaacaagctcattagttgttgaattgtgagagttgacagatctttggactcctcaatagcagccacaatgtactcatatttttcaggtagactgattaaaattttctccacgaccttttggtcgtttatatcttcaccatagaggcgcatctaattaacgatctcaataactcttgagaaatagtcttttaccttctctgactccttcatttgcaaattctgaaattgccttctcaaagtttgaagcttcactgcaagtaccttctgagatccttaaaactcctccttcaacttgtcccatgcttccttagatttcttggcgccaataatacgcggaaatagactttccgcaactccttgttggatcaataacaaggccttggcgtccatcatccgatcctctgccaaagattttttctgttccgccgtaagagtttctccagcaaaatactccctgtaaccattctcaacaatatcccacaatccttaagatagtagcagcgtccgcatcttgatgctccatatatcataattaattttctctaacaaatataggaaccatggactgtgccattgtggcgccctaacttgaagctatacttgtagcttcaattgagaataccgatacgccgcgctactccatcacaccctactcgaacctgggcgctctgataccagttgttggtgttgattattttgctaagaagggaaccaagacgaggagcagagaagcttgtgcttgttttaagtgtttcttttacttgctttgcttgagggctgaacagtacacttggttgtacgttgggcagcacatcatcaggcacatacacaagcattggctgcctatttataggcttacaaccaacgttacttgaagcttcatgaacctagtagaattagtactactggctgcctagtattactgcacattgatggatagaactacactaatctagaacctttttttttttgaccggggcactaatctagaaccttttactgagtagtagtagcactggtcttttgaccataggttctagagtaattgagaagaataagatgtctagaaaattcaggaaatggattaacatcaacaccctcggcgttccacccccgccgtgccctgtcgatcatccgctctagcaccggcgcagcgacgaagggatgcgccgcgatcttcttcccgtctgacgtgacgagctgcacgtcggccaccaccgccggccggagcgcgtccagatcaacaaattctcctcgctcacgatcaacaacaattcaataggctggttaaccaagaaagaagaggaggggagtgggatgacacgtgggccccaccattttatattattatttgtgtgtagctggcatgtgggcccacggattatattatttttcggatcaaaatgctacgtaagcgctatgtcaatgctatgtgggacgaagaactagtcaaaacagccatgtaagcgccatgtcagccaa

SEQ ID NO: 8811 - DNA, 1501 bp, Oryza sativa
  unsure (1)..(1501): unsure at all n locations
tgaagtttgaagggaactaaacacagctaggggtggacgttcggtcggaccgaaaaattcggtctcggtcttcggtttttcggtcagttcggtctttgcaaagtcaggaccaaatttctccaaaaaaactctggaccggcaaattcggtctcggtctgaccgaaatttttgagaataaagtttggaacgaaaaaatttgacataggcatctccggcgctgtggagggcggaggcttcggccgctgcgcggtggangacccggctgcggccgcgcggtggagggtggaggcggcggccgcgtgggggagggtggaggcggcggccgcgtggtggagggcggagccggcggcaacggcgcggtggaggctggaggaggcggtggcgcggtgggggcggagccggtggcggcggcgcgggaggggctggaggagtgcggcagacggcagtggtggtagactggtagggttgtatcacttctagggtatgttttagtaggcttattgggcttcctaggcctattgggccaaaatttcggttaattcggttaaccgagcccaataaccgaaatgaccgaaataaattcggtcttttgaggactagaaccaaacagataaccgaatatctcggtctcggtctcggtcttttcagttcggtctaaatatgcccacccctaaacacagccataggcttacaacctttgaggccaaccaatgaaccgtcactcacttgacagttatatgattgtagaagatgatccataattacttctatcatgtttatctatatctattctactatataaaagtatagccgtgctcgttgtctctcacaatgtattaaaaaaaatcgaaatgctgtgctccggaaagtaaaatcactaaagaaaaatggagggggggggatgtggttggataaaaaattatccgttttttatgttagatgtacatcacagttttttttttcaaggaaccgatgacaggagtttctcctgtcggaatttatagaagaagagcccatttttaatagtatggctcgttgcaatgaacgatcatatattacaaggtagaagttggaagagttgcattctaacacaaaaccgggtatggctcaagttttattcactggttctcaatcatgaaaccggataaagagagttctataattatcaaaaccaatctaaagtagtattgtggatggtcttggctaacgacctaatgtggcatcatagtcgaaaaaaaacacattcggacccgcatataagtggtcacctcaccttctgtttctatcttcccctctttctcttcatcctcttattcgaggcatttaactactcttcatctcgaggcatttgaacaaacatcccttcatatatattttataatcatttaaaaaaacaagaacaaatcatcaacatgtaaaatttaaataagtttatatatttaattcttcaaaatcttaatgataaatttcaagttgacaaataataactccataaaaaaat

SEQ ID NO: 8812 - DNA, 1501 bp, Oryza sativa; identical to SEQ ID NO: 1023

SEQ ID NO: 8813 - DNA, 1501 bp, Oryza sativa
accagccggcctgccacgcccagcccctcccctgccaaccgtcggccgcggcccgtcgcaccagcctgccgagcccgctgcgccggcctgccgcgcccagcctgccgattgccgcctgtggagagggaaggagagagagaggaagagagatggaggggtggggaagaagaggctgacgcgtggggcccatgtgggtcccacgctgagtcagctgccacgtcggacaaaaccgggttcgaaaccgccgagggatttgcactggttttataggttgagggacgcgttgtatccggttttgtggttcaaggatgattttgtacctccatgacaagttgagggaccttcggtgtactttttccattacagtttgggttgaacatgttgggccttgccgcttacggcccaattttatgtgtccaatcataacccgatttcgttgtcaatctgtgccttcacggcttctcagacttctctcctctatcgctagccacagatccgctcctggctcctgcaaggctgcaacctgcaaccccaacaccccttcgagaatcgtcgtgcgcgcaggtatgatcccctctcgcctgcgcataccaggtccctcgctcgatccaatcttcggttgattgaagcgaatctggaggctttgcctctctagtaggtttttttttcctgattatttccactcacatttgcttgcgcatctcaaacactattgtggagaagtggggaggtggtgaaaactggcaatgggatcgttgtgggccggatcagggatgaatcttgggggattattgccttctgctcgccgctatagacgtatgcttgtttagttttagtattctgactcttttcggctgatcgtatcatcataaaagctcttggtccactctgtggtttgattttgtgcaagaagaaatataatatcgcatgattatattctgtgatcgtagattgggatagagagcagatgttattttgtgcacgcacacttttaaaatcctctgatatggttaactaattccgtgacctcttcattcagcaaacctgtacatgggtaaacaagcataactgaattacaggcaagccggtagcttggaaagaaccctcttactcccagtaaaaacaataggaggcccactactgctattttctttattgtgcttctgaatgcaaagtagcacaagtagggatattaggtatgggagagaaagtccttttgttttgttgttatcctcgttattgtaactgttatccggtgccaaattagcacctgttattgtaactaaaagtcagtggcttttattagaagataacatcttccattttttatttatacctcttaaaatgtatcttgtgaatgctcgaattctggcatatgttatgcaatcacattcatttgtgttctgttcatttaggacttgttatattccactcggctttcactatgtgttattttgtctaataataaaatagttcctcacaccatgtagcagaaggaaga

SEQ ID NO: 8814 - DNA, 1501 bp, Oryza sativa
gttgttttcttgcggcggtgctctagtttatatgagtaggcgggctgtagggggagagcggatccattattctttctcaccctcccccctcaatcccaaaggcgtgatcagagttgagttaggtgcttggttgtttgggattggttttgggtggtcccgactgtagcttccttgttagcctagcggtggccgatccaatgctagccttctacttgagtatgtatatgtgttgtcggtgcgtgtggtggtgttttttttatttctttcctaactactgccttatagggtacttgtaatttttttcctactctattcaatggatcatcacgcccgtgttgtgctgatcgctaaaagaaaaaaatgagaaaagtgattgattttttttctttaaatttgaatttcctgatgctcccaaatgaggaatagtggataaggaaaaaaagaatagtgtttttctttgcgatttggttagtttttgcatcctataatcaaagttgagtttgttcttattggatggctgtttatttaaatctaaacttcttattggatgattgtttatttaaatctaaactactccctccattttacattataagtcgtttgatcttttcctagtcaaacatttttaagtttgatcaagtttgtagaaaaatatataatagtattttcaacacaaaacaagcatattatcaaaatatattcaatattagatttaatgaaactaatttgatattttagatattgctaattttttctgtaaacttgatcaaatttaagaaagtttcactagaaaaaaaagtcaaacaacttgcaatatgaaacgaaaggagtagatgtgtattttttttacttctaacaaaaatgttttcaagtttccatagtatatgttctgcggttatatattcaaatcctgtgtcatgcattaatttcaacaattcttgggatttattcatacaaagtatggaataaaattgaaagccaacaaccttttcacatctaccaactctgaatatcgaaccaattctgacaaaggctgacctaacacatatctctttttttcttttgttccttgaacgtgctgatttttacattgttttgatattggtaccaatgacgaaattgcatttatctatctttccatgtgatgggtcaatcacatcgaatatatacacacacaacccaatatatcaatttttctagcacttgcgttaacttcttgttggtttctctatgttgtagatgacatgaataatttaaaatttgagcatcatatgatgatataaacacatcctaaagctatagtgtcgatgaattttagcaactatctatcttgaacactcaatccactttatgtttcataacacatctattgtaagaaaataaatatattgatttctacttaagttgttttcgtattaatatcactgacaagattgtatctatctatctagtctatagagtgaaattacgtcggatatgtaacacagcctaacacgtcaaa

SEQ ID NO: 8815 - DNA, 1501 bp, Oryza sativa
gcagcagcagctctccccctctctctccccctcacctccccacatcaaatccactccatttgaactcatttttcgcaggattttttgtggaaattgaagagaaaggtagactcctccattcccccctcttttttttcgtttttattggttgaatttgtagatcgaagggtaaccctagaaccccttttatgcccaaatttgtgatttttagcatttgttcttgggatttacttgttgtagtgctacatgtttgcaatgtacgcattggtgtcacgatttttttaaccatatatgtggtaatgttaatttttggattgtttggttggatggatggatgaaaaattagggttgaggcatgaaagtaattttaatttgatggacttgatgctatagcctataggttaaacttttaacaattaattatatgaaggggagaaaattttggttgcattatagaaattgattatagttaattagaactaggttgggttgtatgacggagtatttgtaatatttcgatgtataatgcactagtaaacttgttgatagttgtaggtggattaaatattttttttggagtagtagctttgggacaaattaagttatgcattggttataatatgtcggtttggactacgtttataaatgaatatttaatttttgttgcaaagttacatttgattttttggtgtagatggatagacttgttcgtgtttactacggtggtagagtggtggaaccttatgttggtgcacatgttgagttttaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtcataggtcagttggaatgggaagtttactttgatttggtaaaagagtctcagtttagatctctagaggtgtttgcatcaaagttggtacgtaccgtagaaaatttgaatctaaacaaatctccttcttatcattacgttgagaagaattttgtgacatattcttctcatcgtgaagggggtgcaagtaagactgagttggtacgagaagacttggagggggaaggagataagaagagacctttgcttggaaatgatttaggggaggcaggatcatcaaagagacattgcggtactgatgatatggatgcagcgagggagatgaaaagggagttagtacaaaaggggcttgatctaagtgaacatttgtcggagagtgttcattggttgtcgtacggaggcaaccctgaatacccgacggaagtagcaggccaatatgtgaatccagatgattactttgatgtcgaattgagtggtggtcacgattctgtctcagtagaagtcaatagagaggaggttgacgaggaggcaagtgttgagcaatatgatgttgaatttgctgaagactctgatgat

SEQ ID NO: 8816 - DNA, 1501 bp, Oryza sativa
actaatatagagcctcttttacatttgctcatagcgatgaggatacgttggattaagaatgaacgcaaatgatggttccgtgccacttgtccttttgcttgcatggagtcaggaagagattaggaacaaccgaacaagagggtattttcaatggtccacgtgtccagaaaccatggcagatattttgttactaatagtttccacagtagactactactacacctcctcagcgtccttccctaatacacatatactagtagtattcagtttcgagttgaaagattttttgacgggatgagttgaacgactgaatttggatttgatgaataagagatgaattgaagcacaccctcacagctgtcccatcacatgcaaaggtcaacctgtagatctgaatgcacatgcctttgaatttctgattaagatgttaacctactactagaactgctaccatccgatctttttttgcccgaatcaaaaaagagagaaaagagaaaaaaatatgcttttatttttctcagaagaaaaaaagaggggtagagctgcatgcgcacgaccatttcgcgacggactaacggtttgttcaacacctgtcattcccatcatgagcaggttaagcatttcggcacgcattcctactttgcaacctgctttagctagccgcggtcagtgataccggcaaaaattcccaagtgatgtttacttcgaaaaaatagattattcacgcatcaataaatcataaaatgagtatcttacgatggactcaggaacaatcggtagatgtgtttaccgacaaaaagaaaaaaaaaacaccgccgcaccggacaccaagtaattaagcagaacagtgttcaggccagtatgatggctggttggggatgatcagaggaagcggccaaaggagagcagcattataggagcaggagcaggagcaggagcagcagcagctgctgccggggcagtacgtagtacgtacgagagcgcgtacagtagctgatggtgtggaaacagggcggaaagggagaggtgagctggagaaagggatgattctctcgcgcgctggccagaagagaagagaggcccatttagctatcactgtattggttaaccggtttaaccgatcagttgattaatccggctctctcgcccgcacgcctttttccctttatttccgtattgattgcgcaattattcggcagcgtctatctgtctctctcgcgcgcggaggcacccagctcggctattctagcgcgtagtggtggtgctagctactagtagtagtagatttttgggcagcaagcggccgcagaaaaggagagcgaaacggaggagaaaccgggaaactcagctcgcggccaatctataaatagctgccacccctctcgcctttccctccacaccccccccaacaacaccaccgcccatttccctttctcttcctcttcttcttccttctcctcctactcctctgcgattgacaaagataagtgaagtgagcagg

SEQ ID NO: 8817 - DNA, 1501 bp, Oryza sativa
gattccttgaaccccggagatgctcccacccctttgaatcgaaccctcgtcgtctcgtcgtgttttccccttttgatctccggtgattgccgccgccgcaatccaccgtcgtcggctcctctcgcgtcgattcctctcgccgccacgctcccggggatccccatgacctccccctggctgccccaaggccgtcggccttctcctttgtctccgcgccgtgtcgccgcttccgccgccgcctaacgccgccgtgcgtgcgccgccggtgaccatcaggtcccgcgtcaccgcgtgcgcgtcgcaacaccataccggttcggctaagcccgagcccgcgcacccttagctcttctcgcgcgcggccacgtcggcgtgccggcgagcttggtcgccgccgctagccaccgtcgtacctcccctctcaaatccgtgccgttaaacagattccccctgacctcctctagctgccggcggtggccgctcgctccggttcgccgccgctcgccggaacgcctcgcgcgtcgtcggccgtccgatcccgggcgcctcctcctcctcctcctcctcccctttcgcccctgcccgcgtggccgaccacgtggcagccacctcagccctgggcccgcttgactgggtcaagtcgcgcccagtaagcctcctccctccgtcttccctcccgtgcgcgcggtccacggcaagccgtgcggctgcacgtgggcccgccgccatccgtccacccggcgcgccgcgcccgaaccgcgcgcatccgaaaccctagcgcccgcctccgcgtgcaccctccccaccgtgaacccaaccaccgccatgtgggtcccgcgcggtggaccgcgcccaccccgacgggcctccctctctccccgcgcgccctcatgggccgcctcctcgcgcccgcgccggcccatttggttcggccgagccgcgttagcctttgggccgcaccaatgccaccgaaacaagtctagtatacatccctccttgatttccttttccacccttgttccataaatcaattccttattccaaaattccatgaatcattttccttggtcccggattcaatgactgtcaataatattcttgagaatattatttctataaattccataaatcatctctcctattccagaaactccaattaaactttcaaaattcatatcacccaattcgcaactccgattgactccgttccacttccaataattccgtaaattgagatctatttaatggcactactaattagtctaaataggatctttcttttggtcttttgtttaggttttcgattgtttgcgtatagttgtggttatcggattttcgtcgatcgcgggttttctcgaagattcgtgaagcttcgtgaagaccttgagcaaggcaagttaccctttgatcaattgcccctataattgaaaagtcattattattttgtttacaacttgcattattagaatcacacacttaacttgcttggcctcggtttgcg

SEQ ID NO: 8818 - DNA, 1501 bp, Oryza sativa
cattacttctcggctcccagagccattccacttgattaatcggctcccagagcctttttcaatttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggatatctcatgccacatagaaggatcaaaacctcacataaacataggccattttaggcattcacaaatcaaactccaaccaccttgatcggtaagtgagcaagcttctcgtccttgccttaccaggaacccagtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgtatcgcgagttttcacaattcattttattttcaaacacatcgacaccacatgtctagttttgaagacttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtaacttgccttgctcaaggtcttcacgaagcttcacgaatcttcgagaaaacccgcgatcgacgaaaatccgataaccacaactatacgcaaacaatcgaaaacctaaacaaaagaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaggaaatcaaggaggga

SEQ ID NO: 8819 - DNA, 1501 bp, Oryza sativa
ccgaccgttgccgccgctcgctgtgtgctcgccgccgtcgccgcccgtgctccgtagcacccgctcgtcgccagcctcactcggcgtagctccgcccaatccgacgctagcaacagactcccgaagccgcgtagatgctctagctcgcccgaatcggtctcccgtcgcgtcgtcgccgtttcccccttctctcaccgccggttgccgccgccgcaatccgccgccgtcgagcatcctccggcgaatccgagccattggctcgtctcccctcaacccgtgcaaccttctggtgtgctctctttcgcctgtatcgccgtggttcgccccgccgttcgcagccaccgtccgtcgtccgttccggccggcgtcttcttcgacctcccgccggcccacgtggcagccacgtaggcgccacgtcggcgccagctcggctaagaccgggtcgagctgacccggccagccgctccctccggccccgctcgcgggcgcagtccaccgcgagccatgaggctgcgcgtgggcccgccgcatccgcgtcctccacgaaccgcgcgcgtgcaccgcgtctctctccccaaaccctagcgcgcgccgcgtgctccctccgcacggtgagccgagccaccgacaagcgggtcccacttgggaccacgcgagaaggacccggcccatcggctccctctctcctcccctctcgcgcgtgccttgggccgccttctcgggccggctggcccattaagctcggccgagccgcgcctttttctctcgggccgcgccctagccgcccgagggaagtctatttcccctccctctttctttttcttttccaaaagggtttaattaaatccttttcctttagatcaaaaatccaataatcttagaaattcaatatcttctcaaccgtatgaccgtttgactccgttcaacttccaaaattcctcaaatctcgagatctatctaatggtacgcttagaggttaataatagggctttattttcgccgtttgttgagttgtcccgtttcacgtgtagtttcggagcccgaagacccgcagtgcgtggatttcgaggatcaagctcaagatctcgagcaaggcaagccacctttgaacatattgagcctatatttgaacttaattatattgcttgcaaaatattatgcattgataggattgccccgtctgcaaggcagaccgatgggcctacctagcttattgcatctgatccttcctttgttaatcgttatatcatgttcccttgtaaccacctagttgcgcctcagtaatcgtgcactctgcacgagtatcgacggtcgccttcaaacttaaaaactgagaaacaccttgggtaaaacttgggttttacaaaagacttggaaaacccgacacctgggtcggtgcttacgaactaaatgaatttccaaaatcacggaccggggaacgtaccgggtgtacggtttcccgctcttgcacttaaggaccgtttccttggaatttcatccg

SEQ ID NO: 8820 - DNA, 1341 bp, Oryza sativa
  unsure (1)..(1341): unsure at all n locations
tttacttactttgctccagtgctagtagaaattagaattataatagtcttctctagttcttcaagtcttccggagatttcgggtatggatctagtatctgttccctctcttgtaagactttatccgataatgaaatacttttctttatctagttttggtcctttactatacttgcataattattcgagtacgaactttagctcatacttgtctcgtattaaatatgtagttagcttaccagagatatgcaatagtattgtctaagtgtctatttatatagttgctctatgtcatctgtagagatgtagagtaatatttagtattgtaagcgtggtgcttagattattagatatcattaagtggtgctatatgccacggatctgtagaggtaggccgctgatggtgacagctcagtatgggtattcctccacgtgcgtaggtagggctaagagaggttcttgctgtgggtactcctccgtatctttaaccggttggatagccatgacggattgtcgtaaggaacccgacaatatggggcggtttctcgatataccagggggggcatagttagggagttattagccacagagttgtacaatagtaagtgtatactaaatgactatatactagaagtgcataaatgatgttgttctaatttcttctctatttagcctagacttataatttagtgagagtattctaaactgaaccttttatgtgtcaaatctatccttatcctcaattgattaatccctgcataagactttgatctacataagtatgataagaatttatagcatattactatcctaccatatcttcccttgggattaaataaatacgatatcttggacgtacttccgggtgaaatgctatagcggtatatccatgtgcttgcggaattatttctttaacccatacgattaccgtttaatatttctgacaacattgcttgggactaagttcctagtaatgttgttaagaaatatcaacagccatccctaantcggccaaacctagtcgaagccgctcgtgccaacctgcacctgggtcactgcctagtgggtcttcatgatggtgtacggtggatggccttaaatatgttggttttactctgatttttgggccatccaatctgtgtattcacgtctgattagtatatttcatcgcatgtcagacggttttcctccataattcacatgcatacaaatattcaccaagacttgtggaactagttagtaatatccactacctctaagtttagtattcaattttatattctttaattttctttcttgcaggaattggcagtcggatttgacacttaaggatctacaaaca

SEQ ID NO: 8821 - DNA, 1501 bp, Oryza sativa
tggaacctgcaggggtcagattttggaattggcaaactaggctccaaacttgtctgacaaagacacattcactgaacagatgatgtatcttcaaaagcggtacagagacaacatatccaattgcatgattagtgtctccggagcaaattctgggcaataagggtttttttttataaagaattaacaatccaaagaatttcatttttggttcaaccagggccctccatagagatacaaaatcattcctagcgaaggaaccttaaaattgaaagagatacgctcttggttgtgtaggaaccaggttcagtccaatcccaggaaatgtcatccggatcttaagaaagcgagaccagttggagcaaacctccaagctgcaccaagtcatgcaattcctccacataggtgaattgtctaaaagaggtaagccatttgttgtctctcatctcaacttgcatggttctttgctttctatttaccagactgaaacagttgggcacaatatcttttaaacatcgattttggatccaattatcatgccagaaactagttttagcaccgttgcccactgatattgttgttgctgcttgaaaaagtcttttgttcaaatcgtcacagagtagattaatgcctacccaaggtttgttctcctccttccacttgaattagagccagcggagttgaagagctcttgagaatctatccaggtttgggaggccagccccacccaatttcttgggtttacaaactgtttgccagttgatcaaactgtcgctaggattttagtgatcgggatatttgcctttccacataaacgatcttctgaaacggtcaattcttttaagtacctatttgggtgcttgaaagaccgtaagatgatgtgtcggcgtagcacttaaaatagaggtaactagtgttgacgtcccgcagaggtaaaaaaatgtcctttccagcctggcagtcttgacccaatcttatctatcagccttgcagattgacgtatcagatgacaaataatggagtagcgacgagtattatgtgtttacgtgaataatacaaatgatgatatcaaaaggattggaacagatttgtcagccactcagcctacgcttctttgtactgaagtcaagataagtgcaatcgtggctgagtttttgagagcatcacccaatatactagtcattgatgaagaaagaaaaatgaatgaccagcttgaccatgctcatacttttctttgattcttgcccaagcatataaactttcgattgtttattcaaaccagaattttataccagaatataacaaaaaaacagtcgtccggcctcttcgtggaaactgcagatttcagagctcaggctaatataatttgggcctaattctataaatacgcgtcatctccttccacctcaacaccaaccaccaaacagaacagagctcgcaactcacaagctgatacagagcagagaccatcggagttcagagttcagacacgagaaagccatgg

SEQ ID NO: 8822 - DNA, 1501 bp, Oryza sativa
cgccagcagcggggtggtggccgggtcgaacctcttgacgcccttcatcgcgtcgccggcgcgaacccacgccaggaagctgccgagcacgatgtcgacgtagccgacggtgtcgccaccgaagaagggcttccccttggagcactcgctcagcccgacctccatcttctccagcgcctccaccaccttcttctccccttccgccttctcctcctccgtctttcccgacgacgcctgctgcgacgccttcgcgatctgccaaaaataataatccaccgcgcataaacaacacggaaatcggaatcgacgcggatgatcagatggatggatcgatgcgaggtggtggtggtcgagttggtaccgtgtcgtcgcagaatgcggcccagaagcgagcgacggcgcgttcgtgggggtcggcggggagcagggtggcgccggcatcggggaacgcctcgtcgaggtactgcaggatgatctgcgactcgcagactggcttgccattgtggatgaggacgggcaccttcttgttcaccgggttggagctgaggaggagctcgctcttgttcttgagatcctcctcgacgtactcgtagtcgaggcccttgagactgagcgcgagcttcactcgcagaacgtacgggctcgcccacatgcccagcagcttcagctcgtctcctcctccggccatggctttctcgtgtctgaactctgaactccgatggtctctgctctgtatcagcttgtgagttgcgagctctgttctgtttggtggttggtgttgaggtggaaggagatgacgcgtatttatagaattaggcccaaattatattagcctgagctctgaaatctgcagtttccacgaagaggccggacgactgtttttttgttatattctggtataaaattctggtttgaataaacaatcgaaagtttatatgcttgggcaagaatcaaagaaaagtatgagcatggtcaagctggtcattcatttttctttcttcatcaatgactagtatattgggtgatgctctcaaaaactcagccacgattgcacttatcttgacttcagtacaaagaagcgtaggctgagtggctgacaaatctgttccaatccttttgatatcatcatttgtattattcacgtaaacacataatactcgtcgctactccattatttgtcatctgatacgtcaatctgcaaggctgatagataagattgggtcaagactgccaggctggaaaggacatttttttacctctgcgggacgtcaacactagttacctctattttaagtgctacgccgacacatcatcttacggtctttcaagcacccaaataggtacttaaaagaattgaccgtttcagaagatcgtttatgtggaaaggcaaatatcccgatcactaaaatcctagcgacagtttgatcaactggcaaacagtttgtaaacccaagaaattgggtggggctggcctcccaaacctggatagattctcaagagc

SEQ ID NO: 8823 - DNA, 1501 bp, Oryza sativa
ttatcacaaaatatattttctatacagaggaggggagcttgcataaggggggaagatgtagcgtacgtacgtgcacaatatgtaaacgatatggacagcccctatgggccttagggacttttacttttttgttagcaaatctaatggtacaaagtgggtccactgagtttaaagtaaaattaatggtcagatatgtttctttttctaagaattattagaaattcctctaatttattaaagcgccacgtggccacttaggatcgtttgtaggagtcacacgtgatagtttgattgtgtttgtagaaagtttaatgagcttttaataatatataatagataatagatagatgtccgatccattgtctctattttcttaagaaacctcgcgaaacttttactactgacaaatatatattatttgtaccatcgtcattgctttaattggttcatatgcatataatttgttatatgcttgcatgtgaattagtaaatatggaaaaaaatatatttaccctacacattgtttctctatgatacgtgagacccgtacagtagttaaaagaaaaagtatagtcaatctaaataatattaatactcatacatagtaaattatatcagaaaatctaaatggatttttaagttggttatgcatgcataggaacaatgaacatgctcgaggcctattaatattcatatataggagtattcacatttttaatggtctacgcatataaaatagacaaatttatctttatatctaaaagatatagaagccatagtaatattcatttgtttcttttacctttaagtccattaaatgataatgtatactatattttagaattcttatatacaaatcagccgatttaatttatctcgtcagttgagcatatttcaaaagacataattaattagatattgttgcatccaactaaaggtacaatattttttttataatttatgttattgatagttaaatctgttcttttcacttacatattatatatctaatttttctatgcatgcttgcaaagtaatgtatgatgatgcagtatatgttgtatgacaatttggatgacatttaaagtgtaggagtatggacctagataaattaaatttatgcataaatttattttcatagtttcatttataatttttattttaacaccatcgatctaatatagctatgcagttttatggaataacttaagatcacataatacatgtttattttatttttaatgtttcattgtgaccactagataaattattcttttatatgaaaattattcacggtgtatgtttcttaaatggtttaagatgataaaatatatgtacatttttttatatatcttattgttgtttgattggtatgtaaaagatacattggcctttctacattcaccttcctgggtagattattcgattctagctatattcatgtcatattaatcaatatatatcaatcaacaattacataatttatatgtgtagtaccctg

SEQ ID NO: 8824 - DNA, 920 bp, Oryza sativa
tgggatggcatgcatgtggagttttagtaccaccttgcttattctagaagagggggacctccttaatagggaggatgcccacctagccacttgaagcatgtgtggtggagagaagaggggaaacacatgcgcgctcgctcgcctggcctggcagggcagggcaggcggcgcacgtgcacgacgtacgcatcgaatggtccgcaaaattggctcctcacccttgcgtagatgcagccttcttttgcagttttgttttgctgcgggaagttcggatttgttttgttttggaaatatttcgaaaaatccggtgcgtgaaaacggcgtggagtccggataggttacgcacgacttatccagttcggtttacgcgggcgccctgatcaggcgacctatctctatataaaccgagcccccgccttcacgcaacacacgcgaaatcaatctaggatttgcctcctactctgtactgcgtcttcgctcgtagactacttcatcccgctcgccggcgtgcaccggcgatcgggagagcaggtctccggaacctctgccttctacgtcctgcaccgggagaaggcggcaataaggttttagggaagcgcttcgcgcgactgctccctgttcgtccgcgacggctcgccttcctcttcgctcgcgtgcttcgcgccttcgtcgacgctagcaaccgcgagtagttcctgccgagcaaccggtctttccgccacctcaatacatgttcgacatgttgcgcatatttgatctgttcatgttttactgcttagtttacatgtgtggatctaatgatgcgttcaatctagtttacatctgcaatgtcatgatttatttatggaataaattaaataattatgtgcttataatttcaacaatccaaaaaccttattgttggcgctgtgattttacta

SEQ ID NO: 8825 - DNA, 1501 bp, Oryza sativa
tgtacaactgtacgtactgtgactcagaaatcagccaaagcctatcgccaacgaacatatatatatatatatatatatatatatatataacacacacacacatacctgaactgtggagttgcgagcatagctagtttcgccatgccctgcattcatatggagaatttctttggtggtcatggcgcagttgcactaatatctgaatgtgtttgctacgatatatgatgtctgagttacctatttatagccttacaagtcgcccattgtgtggtctttattgtcagctgacctttgatgtcagaaatataaaacaatgattttcttttactaccgacagatatatttgttgcttaaaattaatttgtacaataaactgtccaatcattcattaatatttctgacaaccatgcccatgtgcggctaagtttgtacaataatccgcttactaataatttgtacaaaataagcgtggacttgtgagcatattatgtaatcgctccgttttacaatataaattattccagtattttctacatttatattaatattaatgaatctggataggaaatgttagaatgacttgcattgtgaaatggatcctgttgtccgataaacttatttgtttttagccgtgtacatctacatgtgaataaatgtagaataaaagaggcgggattttgattctactaaaattctagctgagatggatatggatgctatcatatatatactcatattttatctagagagtctcttcatgcatggactggttggagtagcatgcatgctatttaactgaattgactctagctaagatggatcactgagagtgctcaactcagtaaatctatcgtatacaatttaactatgataggttagtgagtatatatgctgacatatgtcagttaatgttacttttgtggtgcagaaaaaatgccgaatatttgccctactgccgcgcgccccttaattgggtacgttctcaagtcgttgcccaccgtgtccgtacatgacagtagcacataaaactgtgctacagagaaataaatcagtaattaacacatgtttcgtcttcttatttaagtaaggtgaataaattaacgagtgcagacacaatcacatgcacatgttgtgttacaaaagcaactcataacacataatatatatatatatatatatatatatatatatatatatatatatatatatatatatatatatatatatatatatatatatatgagagttgaacaaatatgttacaggcaaattgcttaaccatgtgacaatcagactatatgtggtcttccgcattagtctttgatgtgaatttcgtgttcaattagctaaataccagtgtttttgctacggataaatgtaaattatatgcatgcacttgtctatataaataaacttgattttagagatgattagataatcacaaattaaaatgtagaatcactagctatcttctaataatatggaagtatacataaggaga

SEQ ID NO: 8826 - DNA, 1501 bp, Oryza sativa
tgatatgtaatgaagtaggatgttggatgaaggtagttagcatcagaccataacattggcaggctaattaacccaaccaacccaaccaataatagacttaggccctgtttgattcagcttaggattattataatctggattattattataatctggattattaggagtaaactgaaataaacatatagctcattacgatatattattacaatctataagatagtaatccactctaaaggtgtttttttaattattaggtggctaacagctaacaaacaactaataatccagagaaacaaacagctaaccgcttattctatgccggcttattataatctagcttatagtaatctggctcaataatcgattataataatcttaagctgaaataaacaacgccttaggacatgtacaatgttagattcttatagttgttaacaaggtaactttgctaacatgtaagaaagagagaaacatagtgttgttacgcattacaacggcttaatatcaactcttaacgcttataaaatgaattttcgttgtatgacaatgaagaaaaggaaagaaaaaaatgaaatattgttttagtgtattaattatgtaagttttttttatcgtctcaactattattataagataagataatagtttctaaaagcctctaccaaggccttgaatatgctcttatatggatccatcgaaccaaaattagattaagaaaggataattactcaattaaccttagacctagaagattaagtaattaatcacaccttggggtttagaaatagaaagtgtcatagcccagtgcaagacaggcctagccagcccacatgagaacaacctaattcatagatgtagactatgttaccctgatacggggatacggatacgcgatacggggataggacacgtcattttcttaaaaacaccgatacggggatacgtctatatatatttaaaaaaataaaaaatacaaaggaaaaacataacacataaataactataagcctgcaaatagagttatacaaattacatgacatcattagagataattagaataaaacttgttccggatataagttcaactcaatagaagttcaagagctgcttgcattcatagccagcgatgtggttgaaagagctacatcccagacaggtctcatgcaccagatcttttaatagtactatcccaggagatcaagctcatcatgtagcttgccccttgtaaataatatgctcccatgcctggtcacaagtgaccctgatgaatctgtagccgcgctagcagtacatactagtgctagataagtggttaagcttccaattctaaaattcaccggatctaaataacaaggaaaaacacataacaaaacaaccagtaaaaggggaaagaaccaaatagccggtgatgatggactgtacgcgttgggcttggtagccggcggagaagctgcgcctggtgacggagatgccgcgactaccgacggcggaggccctg

SEQ ID NO: 8827 - DNA, 1501 bp, Oryza sativa
acacatggatatattccgacgaaaaattttatttagcttattattgaattatttttaaatgttgcacgatatttcaccaagtatatcggaattgtttcaataagcacatcgaaaatgtttcactcgtttaaatcggatgttgtttcaccttatataaaaacaatgtttcagcaaatagcgaaagaatatttcagttcactgtaaaattagatctatacatagtgaaatattataagtacactaggtgaaacatttttcggtggaacaacaaataaaatgaattcccttaatagggggttttcaaaatatatgggttttctattgcaatggaatatttcagttcactgcaatattagatctatacacagtgaaacattgtgagtacaataggtgaaacatttttagtagaaaaaaataaaccaaattcccttaatagagaggttctaaaatatatgggtgatttgttgcaacggtagataggagcatagacatggtggggccaggcctgtatgcagcgcgtggggggaggggcgcgcccgggggggggggaggggagcgcccgatccggctaccctcgcgctggacgaccgggtttaatcattctcgggaaaaattagaagtttgaagaaaaattttacaactaaacactgcctagtttgtagtgcatagggttgtgattgtacctgccgggttcccatttggagggtgggagagagtgggagtgccagtgcagttctatctccccatgtaggagtactacaattccacgcatcaatacgcacaagccttcctatcataggctcatagcccattctctctcttctcaaaatatacttcatccattttatattataattctctttaaccgttttataaaattcttttagtttgatcaaatctctactataataaaaattaaagatgtttttaccggtattttgatatgtcatctttatttgagtcggtttttaagtttgttcgcttttgaaaataaagatccgtgtttgagtcggattttaagttcgtttgttttgggaaatataaaaggagtcatataagaaatctcttttaaaaaaaactcgcatgctaacttgagatgaaagttagactcttaattgcagctcatgattttcttaaaaaaaatccaagcgaattccaaaaataaattttatcctagctaaaccgtataataataataagattaaaatagcattcaccggttgaaacgcatgggcattttttcttgtgtatagaaaaatttagctttttctgtaacaccaaactactttcattagatgtaacgttgaatatattttgataatacgtttgatttatgtagaaaatattactatatttttctttgaatttactcgaaaacttaaagtgacttacaatatcaaatggagggagtagtaatctaggactgaatgagacaaatactagtgtcagggttacgagtaaggtgtaccctctacccttcgatatacgtcatatatcgata

SEQ ID NO: 8828 - DNA, 1501 bp, Oryza sativa
cccatatggttgaattttgttctttcaaactcaaaagctttgcgtgttaacgtattagatggacccttggttaattaaattctcagtcaactgatgcacacactccaaattcccaaatttaagggaaggtcaacaatttgaatagtcagccgaagcactacaacgtacttttatggaaatatttattgcaaagtgatatatttatacttttgttaaagtattttttaagataaatctattcttataatttttatattttcaaactcaacaattcaacaatttaagaattagtgatgatttatattctcaagatttaacttaaacattatcctaaacgacttacttcacgacacgagtacggacatatctccaaagagatagtattgtattagacttcattttgtcgttgatttttattttagttatatgccggtagagttctactggcaatctactactaattaatctagctagtgtggtataatgaggctatgtttagaacacattttatttttcatggaagatttggttaacagactgtctggctactgtggtctctaatatttctgctgcctgcctgaatttttctgtcaattgatgcatgcactccaaattctcaaaattgacatagatgagggaaattctatttcataccacatggcaagttttagttccgcgggaaactggaacttgtactacattaattccaaattgggcagatattgctttggtgcataaacatcgaaacacacatttaatatgcaaagaatatgcatgcatgttttcatgctgatgaacagctttagcgcatatatccatgaatgggcatggagtacactgaattactagctagaacagccgcgaccttacactgttctgttcagatttaatccctcgccacgtactactgctgttccccctatctcatattataagtttgtactaattaagttaaacattcttaaatttgattaaatttatagaaaaatgtagtgacatgctatacaacaccaaattagttttattaaatctatcactaaatatacttttatatacagcatagaacatttattttttgttggagatgctcatacatacatttttctacaaatgtggttaattaaacttaccaaagtttaacttaggataaacgaaaatactaacttgtactaacatggaacgggccgtgtactactactaggaccctgttgcactataactactgtagctagtgcctgcaagcagcatttcattcagtgctagtaaagtttttggcgccaataaatagtgggatgtgtgcatgcaattcatggcgctgttcgtggacacgaaccacatttttattttgacatttatgtggtaggaaaagttagttagatagatagatagctagatagatagatagatagatagataggcgtgtgtgtgtacatgtacattgcatgcatatgtgtccttggacctctgatggatcaatacgtagtacgtactcacctcgaca

SEQ ID NO: 8829 - DNA, 1501 bp, Oryza sativa
tttatctcataatttacatgtaatatgtataaatagttctttctatgtctatatttaatactctatgatgcatgtgtccaaatatttgatatgataaggtaaaaagttgttgtttggaaactatacagggcataagtgtagtagatcgctcatcagatcgatccgttcttgcaagctatagcctgcctgcctgcctctgcatgcaatgcttgtagcagtggtgtggtatttactttgtgcagtactgcactacaatgcttttttttttttggacgatcgaattgaaagcattgcatgttgtatggattctctacttctgctactattctggatatttcagcaattgtccttgctcgatcaaatcatggcaattaactgaagatgtctcattactggaggattctagttctgcgtacacggtttgtgcagaggtgacaggcaggtagtcctttcaattaatgcacacgatggagcgaacttcatattcgcctcacatcgaggtgagaaggttgttactacgtctcctcccataatataagaagggttgtaagtagttttatcgttagacgcggttattaaaaaaatatataaaagtgaatggtgaagagttgtgattggatgaatagtgaaagtaggtggaaaaagtgaatggtggagggttatgaatggttaagaagagaatgttgttggagaagttgttatatttcgagacaaatcctgagagctaaaagttgttatattttgggacaggagaatattaatttttcgacaattaaggtatgtgctgataagtgaatcaaaagaggtagtaacatattacgtgccatgtaagtattctttcactctgacggttcatatatgacggctaaagagacctatcacaaattattatacccatacaattgtttaaataaaccgttaaagatctatatatatagggaccatcacgtaccatcgataatgactacgtatctataattaatggtctaaaaaaaggagcagttatatagatgtggtgttggtcatatacaaccactcttaatatgcagtttttacatatgtcaaattatttgctatggttacttatttaaaacctgttaaagaaaacataagtaatctataatgggttattttttctgcaacaattatagatagtagtatccatctagtacgatccttatctctctacgtctagaccgggcaccagacaccaaatcgggccggccatccagatctcctccttgactatcttctctaccttctcctaacctgcaccgctgctgtttggaccgtcttgtcatggttatagataccacatacctaatagtagttgactaaatctcggcaggatgcaccacataccatgtcttatacggaaactgacctcgagggagttccggataaggaaagacaaccagagttctacatggaaacgacaaggattactcggattgtatctatattggtttccctagttctacttggacaaggggacacctat

SEQ ID NO: 8830 - DNA, 1501 bp, Oryza sativa
gatgaagaagggggggggttctcgccggcacgctattccaactggcgaggcgggtagcggcgcggtggggcagtggcggcgggggatcggatggaggaatgagcgatgggagtggtggcggcggaatgtgtgatgggaggggaactggaggaggaaagatagggttaatgcctcaacacggcttaaagcatatccgatggtctaaaatttaaaagatggatggagggattttctgtcaacagttatatagatagtcccatataatatatttatttttgtttaatcggttttgctaaaaaactgttgacagtttttttgtttggaaaacttttgattttctagccattagatgcgctctaggattcgtgcaacatatacacccagaataaaaaagatcgcatgggcaaggcagtcatcgaacatgatgcacacgttaagctaagccatgcaccttcttattagtaataactcttttttattatatatcacttacaccctagttatatatcacttaccttaattatagagtagttacataacacttacaccctaattacatagtacttacacactagttacagagtagttacacgatagttatagggtagttatattgtataaaattatgatttgcaatttttttaggagcgcatattacttttgaatttgaaagttttttttccattctacatgtaggccaatttcttgttgttcaatcagcttggacactaaaattcatggtttgtactagtgtggattgtttccttataaccattgatgataaattctgtagttaaaaaatttgaaagttttggacctcaaaaactgtcgacaactccgtagctagtcccttgtttaattttgaggagagtctgatagtaaaaatcacgacaaagagcatatctcccgaaccagaacaattctacccacccggtctaacgggccggcccagaaagcccaccaggcccactcaaccacgtttcagttactccttaatgacccagtgagctcacttctttttgtccctagcaaataaattactcctctcctaaacaaaaaaaaagttactactactacaaactccactgccacgtcacaggtcagtagagtcgccgtggccgtggccgtgtatgtggactcgtcgatcgagcaggagcaggttgttgggtcgtccacctcactcgccttggcggctagtaggtcaaacccaaacccagctgtgcgacgccgcggggccgcctatatattccgccggagactcaccgccgaccccgccccccccccccccccattgccgtctcggttggactcctgtctctctcttgcttccctaccttctccttcctcctcctccccttgattgctaggtcggtctctaggcggaggtggtgaagtggagtggagtggagagtatcttcttcttcttcttcttcttcttcttcttcttcttcttgttcatcgtcgttggagttggaggaggtggtgccgtggtggggattga

SEQ ID NO: 8831 - DNA, 1501 bp, Oryza sativa
atgacaaacgccgggttgacttccaccggcttaatttcctgttgcatttatgagagtcgatcgatcgatcgatcgaccgaggtgatgatcgtccatcttctccatattggattgccattactgcgttcctagtctcatatatatagaacagattcttgatgagtagctaaggtctcaattataaagcacgcacagttccaaggagagcgaggcgagacgaccggtttccaacttaatttccccattattcatgtatatatgcactagccagcaagctagcagccacgcaacagtatgcatgcaacagtacgattcctcctactcctacaacgattgtacttgtactctctgccagtcttatgtactctctctgtgtaaaataaatcaaccttatacaccgatatgatacatcatactaccgtataaatctaaatataaatttcagatttacggtattagaatataacatatcgtgtacgagattgatttacctaccacttcaatttgatccatgaacatatgatcatctcgctctcgatcgatcgatcgatcgatcaaatgctgctttacagctacacgacacacacacacaaacgcgaagagatcgatgaaaatggaagagctgaccaatgtcaataataagtcatctcacatgtggggagtcgtatagtggtggattaccctactgtgtcgagtaggggaggcgtacgcatttaagccgcacggagctttcccttttctgctcggcactgcaggctgctgcattcaagtcccctacgtatactcccagttcttcacacttcttctgcatgcactcgcgcacacgtacgcacactgctcaatcccctttccttgtctttctagtaggagtagtatactccatacatccataaaaattacgcctatttcacatttaagtttttccaaataaattatttctatttatagtttttatatatttaatacttaaatgaagagataaattaaatgttttattagaacccaaggagtcatctaaatactcattggtagcatgattgtattcactccttaatttcatattccctccgtactcgtaaaggaagtcgttttggacagcgatacggtctctaaaacacaactttgactttcttttctataaaaatatttattaaaaagtgatatatgtatactttcatgaaattatttttcaagataaatctattcatataatttttttattttcaaactgaacaacttgagagttattcatgatttatattcccaaggtttgacttaaacattgtcctaaacgacttcctttataagtatggagggagtaacatccaagatgatttaatttcttcttaatcttggtgtcaatagtaatatgtgtaacttttgtagatggagagagaatatgattacctcaagctacatgctacctctgtttttttaatatatatgacacttataatttttttataaacatttaaccatttttcttatttaactgttttgt

SEQ ID NO: 8832 - DNA, 386 bp, Oryza sativa
ggatcccctttttgggttgaaaccacatacctcttgtcactgcactatcaaatgcatatcagagcactgcagcatgatcactaaactccctctccccctaacgactgcaaggcgccgcgtcctccaacccacagtgtgggtgatcgcccttcacattccagagcgccctctccccccctataaataccccactgccagcctcatcttcctccacagcatccatcgcaaaatccacctcagctagctacccaagcgcacgcgccaccgcccgcgcgcgagctgagctagcgatcaacaccggtcgaacacctagcgagcatcaccaccatcatcaccatgcaggcgtacatggcggtcgccgccgctccggcgccaccggcctcgct

SEQ ID NO: 8833 - DNA, 302 bp, Oryza sativa
ttcgtcaagtcagctgaaagggaggctgaagcgaggttgaagacgaagcagttcgcgatttggctggattcgaagaacagtctacaaccacgagtccacgagcgcagtctttaaattttggcccggccaactcctagttaaggcccactcggctcagccactcccccaaccagcctctccccctcctggcctccacgattcgtcgattccctaatcccactgccgccggccacctcctcttcctctctcctaaatccatagccctaggcggctaggcacggcggcgggcgcggtgtgggcga

SEQ ID NO: 8834 - DNA, 1501 bp, Oryza sativa
ggaattaaccaagtgaatcaagcggatttggaggagggagcgagctagggttcgcacgggggagagagaagctgtgcgggaggaggaagaaacgcctggcaggcgggtcccacgcggggcgcgcgctcagcgcgcgtgcaacgcacgtgcgcgggagggaggggcggctcgggcagggggcgcggcttgggccgagcggccggcccaggaggagaggagggagaggcagcccgggagagagagggaggagggagtgggccgggaggggaggaggcccaagaggaggagggagagaaggagagggagagaaagagagggaggagagggagactttgggctgggcttggcccaaaggaggaagaggattattttttaggtttttctttttaataaactttgataattgtttttgttgcttaataattatttccggtgctctgaaaattcaagtaaaatttaagggctctttttagaccaaggagaatttaacaaaaattctccgggccacattcgaatttttcttgtacgtattttagtgtttgccaatttctttccgaattttaattaattctattattccttttagaaaatgatttttatttcgggatgaatttatgaggacgtgacaaatccaccccccttacaagaatctcgtccccgagattcgaggaggctagcaagaagataggttgggcggtcttctcttcttgtctgacttcttccgtcgcgtcttttataacaaacttgcctagcaaaacttcgccactctaggctgcttggctcgatcccttgttgcagatggaatcttctcttcgcctgacttgtccctggttgaacctttagctgacttcgactgggttgcggcgcttgaagatggggcttcagttccagaacttcgcatagttcatatctttggagtcaacctcatacaagttacccacttcatgtcatgcgtcgagatcagctcgtcattactaggataccatgcttgtcatttacttctaacttgccaccaactgcctcatattagctttcctgctctccaggtgctagctacttctgctattcgatgcaagggtcggtaactttgcctttgaattatgtttctaaaaagaaccaacttatcccacttgacatgctttgacgtctccccaaatgactttgctgctggacttgttatggtctgatcgttatcctgccaaatctgaagcttcgttgttagatgcgattttaatctgacctccatagactatcttcgaacatatcacttggttcataactgggaatagctctcatgaacaagcaactcggattcactttctttacatttggttcacttcccactattctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttga

SEQ ID NO: 8835 - DNA, 1501 bp, Oryza sativa; identical to SEQ ID NO: 6927

SEQ ID NO: 8836 - DNA, 1501 bp, Oryza sativa
aatcacacgagctcatgcctgttcacttcattatcaggcagtttcgttcttaaggttacaatatcatgatttctttaaaggggtacaactataaataaaatcctgtgataattcacgggggggagattgcttgtgataattttattgtgcttaagaacgaacgttatgcatactatggtaaaaaaaaacgaagcagatgcgcacagtagaaaatgatgatacaatacaaaaggttccaatttggtctgccagtcagacccaagttgaaaaggttgcccattgattcaaggcttcgtttgggtgccatgaaaagatatttttgatttatcctcaaaactaaatttaatctagtagaccgcacttgcaaaaacagtgcctactttattatgtaaacgaggactatgatcaaacctgcatacatgccatatggactatacgatactatttcttgcgcttattatggtgtttctcctgtggccatctccagttatgtatcaataagacaattatacttttcccctaaacaaaaggacaaaccatgtttaactatgaagagattgatcattctcttgattggtgaacaacggacaatattattatcatttctttacaattacaggcttgataagctgatcaaacaattggcttgcaatttgcctcacaggcttgcaagctagggtagcatacatttctgcaacagaccttcgatggggagaaaatgttgcatggtacgggtaccaaaccatttatattgacattgttgcgtccttcattcatggtggcactcttggtgtaatccagattattacttgaaaaataaaaaatattttactaggaaagcatgaaagataaagaaaaaccgtatgcaatacatggatatgttaagatggatgtccagaagaaaattggaaacacaaattttactctgaaagatatgtttctttaatacatcgtgattaccaaagaagaattgaataattgtgaaatcaaaataaaccttggattcaccattgagattgaatattagatagtagattaccatacacgtggccaggaatgctaaaacagcctagaagggccaacaacagaagcagaagtcctcggctacagttcggcatctgcttgcccatttgtgtgattgctttgtatgaagatgtggcttgtgtttcttatttgacaacacaactgaaataaataggcaaaaataatccaatgattaatagtatccaaatataaggcttatcctgaacatatgtacagtttttgtcgcctcccaaaacgaccctaaaatacatcctctaaattatgcctagaataattaaaatacttgtgaaagccttcaaaaattaaaatgtgcaaagttaaaagtcaattaaggcttggaggatttttgtatatttcgtaaaagtctaaaatgtgtaaataagttttagtggaattttcagagcataaataataattattaagaaataaacaaagttaaaatgattttataaaaaga

SEQ ID NO: 8837 - DNA, 1501 bp, Oryza sativa
gctagttggatacattattttagtacccactgtgtcttgtagcaaatatccacacaattatagtgcccataagcaaaaaccggttttcattgtgtcttctagtaaatatcacattattaagtgttcactagcaaattttacataaaaaaaattgtgggagttagatcgatctcaactacccatagaaactgcacgtacgttgcctggagaaacaatataaacttccattggctctaaatgattaattccaaaacctaaacaggctgtagcgcatatttatagtgttgattactcggcgtatcgatcggagctcttcatactagcaagctagcttgtgtcgttaggatcgaattgcacaattcgtgcagtccaacctaagatggcctgcctgcagctgcaggttcttctcctcctcgcctgcctgctgcttgatgctcctcatcttagtagtgctgcagccacagttccaacaccacccttctccttcaacttcgacttctccaacatgtccacatacaagccggatgacttgagatttgagggcaacgcgactgtgcacggcagcttcgtcgacctcacctgcaacgcatatgggctggacatctctcagtgcacggctgggcggatgtcgtacaatcacccggtgcccttctacgaccaaaccaccaaggaggttgccagcttctccacacagttcaccttcaagattattgtaccaagatttaacaacgacaaggagaagggagatggtatggctttcttccttgcacgttacccatcaagaatgcctccagattcaggcggcggcagccttggtctcatcaccaacaacaactatagtagctttggcccggaccagttcgtatccgtcgagtttgacacgtacaacaacacctgggagcagcctaagcagactggtgaccatatgggcatcaacatcaacacagtcactttttcgactaacacaacaagtgtatccagcttcagcccgaatgagagcatgatgaaggcgtccatcacctttgacagcaagacctcgatgctggtcgcctctctgcagtataccggtaattattctaactatgcccctgttaacgtcagtgcgaaactcccagatcctacgaccttgctcccgtcggaggtggcagtgggattttctgcagccaccggggcagccttcgagctccatcaaatacactcatggtctttcaactcaactattgctgccccggtacaaaaaggtatatatgcagttactacatctcttgaattgattgttggattaatgcattgtactcgttggaggtacttctgacgcagcaattgacaccttagtagtttgtattttttttgaatgaatttgtaatgcagcaattgacaccgatctgccgtaacatcgatgcagatcacaagaaagccattgccgtaggggtctcaattggaggaggtctcatattggtgctcctggtgtggtctattctctcatggtggaagtggagaa

SEQ ID NO: 8838 - DNA, 1501 bp, Oryza sativa
ctaaacacgggctctatctccccaatccaaaattttaccgcttgttgaaaagatagctatgtcggttagagataacagtcaaatacaaatatagaggtaagatatttcctagagatataatcctagagataagatagagtcctagagataaatctactcttacttatattctctatcccctgtgtacttttatatataccccatgaaaggttcgatgtaatagatcagaaaacaaacaaaatacaataattagattttttccacaccgcttccaactgcttcttcttccaatgcaagtcgtttctctgttcgcatttcccttgtcttctttgtatcaagaaacataacatcctgtatcagagcagtcgacctatcgacctagaggttttctggcaagccacgctatcattcaggagcacagatcatgacagacgaggcggagaaacaactttcggaactaagcaagatgatggccaacattcatgcgcataacaagttgatccaggtcaagtggaatcacaggaggagatcaaagtgtcggtgcgggacctctttcgctggaaaccggagatggacaaagcggtagcatactgagttaaaaacggatagtttaaggccattcctaacccaatacactagacatagctatagtttttataaactctacatcatcaagaaactagtactagatactacctctgtcccgtaatagttgtcgctttaacttttttctttcaacgtttgaccattcattttatttgaaaaatttatgcaaatataaaaaaggataagtaatacttaaagtacttttgataattaagcaagtcacagataaaataaataataatttcaaaattttttgaaataagacgaataatcaaattttacaaacaaaaactcaaagcgacaagtaatataggacggaggtagtaattttcttccaatacaaacaccactatttcatacttaaatttaatgctacttatctcacatgatgtcttagatattgtgtagaaatcatgtcttatgcgagacatggtttccttctctttttttatttattcacttgccacatcattattcatcctaggtggtagcttctttaatgctataaacatcatcttataaacatcatcctagttattgggttgggaagttcttgcatggctagctagcttgcccaaaaattctgggtttaatacagcaagccgagtaactaatgtatacaacatatgtgagaggtttggtagacatatttgctatggtttgaatgtggcaaaattgtgaagactgaagagggttgaaatttagggttaattagatccatgccactaaaactttgtgaaattaaaaaaataccactactattcatcatatcggttatatgccactgggaattactaaaattagaaccatgccactccaaaccattttttcatctcctctctcatgccgtctctgtttccatcctcatcccctcccacctttctcatatccggca

SEQ ID NO: 8839 - DNA, 1501 bp, Oryza sativa
ggttggaggggggggggcatttacggatatgtgagagtgtggtgttaggccattaccaacctaagacactgcacatagttttcataaactccacatcgtcaagaaactagtactagacactactcttccaatgcaaacaccactactccatacttaaatttaatgctacttatcttacatgatgtcttggatgttgggtagaaaccaagtctcgtggaagacatggtttccttctcttttctcatttattcacttgccacatcatttttcatcgtagatgatagtttatttaatactatggacacaattctagtcattgggttgagaatggtcttatatgttgtgtagtggtgtgtgggcgtgtgcgtctgccgtctaatgggataaaatagcctcccaaatcaagaaagccctaaggctcggtttagataatgggttaggagggatgggattgggacaaagatatgagtggagggttgagatgaaatgagatatgaagaatgaatggctaagattaaaagttatccttttagaaggtgggataagatttcccaacccattttctgtaggatacaaaagacggcccagcaagtagcaaccagcagccaagcccaactctcttcgtccccctaaacccccacacatggcgctttgcctccgccgcgccgccgccgccgccgtcggagaggcgctccgccgcggcgcttcgacggcgccgtggaggcgggcggcctcggcgtcgtaccaccacacgatccaggcgttgccgcgggagacggccggcccgcgcgcggcggcgcgggagcgccgcaacggccgcgtcccggccgtgctactcgccctcgccggcgccggccccggggagggggtggcccaccggaagctcctcaccgccgacaggaagcagctcggggagattctgaagcagtccccatacttcctctccacccccgtccgcctccaggtccgcgccggcgagcgatccaccgccgtcgtgcactccggcactgtcctccctatcaaggtcttcgcccctctccattcctgtcctttccacccaccaaaaaatatctcgttcattcgttcttgcgcatcgaggaaatcttttcgtatttcagctcagttggcgttggccgtgtcgattcgtttgctcaccctgtgtacgaaatgcgcattattagtgtagtttctcctggcaaattgctggctgttaggttatttgttactagtgttagcgacttcctagtattttgtagtgcttactttggagaaattgctcagatacgtagcagtccttatagtttaggagtgcagagaaccaatccttctttttatatgattgtttactgttcttgagcagttttatcctgagaaagctgggggaaccactggtgtggtttcgcaactatatatgcgagagtgctagaagaaattggtcagatatgttgtgcgtcaggaccgggtctgcactatcttgcataaaatggattgtggttgatgt

SEQ ID NO: 8840 - DNA, 1501 bp, Oryza sativa
ctcctggcctggccttcagtcggtggactccttgggctctcctctgtctatttctcggagttttgggttgattcactgatgttttgatgaagttcacaacccctccttgtatggatgcataattctcctcactttagtctgattttcctcccaacaccggggtttatcatctgcatacaaatatacaccaacacttgtggaatatatgagattaagcacctatcactatgttggatgttttattatctatctttatgcggatgttggcggtatagaatcgacatttaacacccgccaacagccttgccaaattatccttagttaacacaaccccttttaaacaagtaccacatgaaaattttaatcttaagtggcaacttaagcttccaaatacatttatttctctcaatatagccattattaattaaagctaggtacatagacctcaccgagaacaagccattcttatggaaagtccatcttaaactatcagataaatatatgtaggccattattttgaaaagatggatgtttgctcttaaactcctctttccaatctctcctaaaacttctacgtagaccatccaaatatcttacttaacaatccacccctcaaactcacgttccatctaacaattctcctcaagcggttatttagttttataccatttttaatcctattaataattgacacatccaaatttattgtcgctcatttgattttgtagctacaaatttggcaaatgccaaatttttcagtggcttcattaaggttagcactagcctagcccaaacaatttagtaccaatttgatacttccaatttttttcattagtgacatggttcaaatcttaacatccactaatattatgcacacattcgtaaattttcaataaaattttagtgaaatcaggaatatgccactagacatgtgttggttggaggggggggggcatttacggatatgtgagagtgtggtgttaggccattaccaacctaagacactgcacatagttttcataaactccacatcgtcaagaaactagtactagacactactcttccaatgcaaacaccactactccatacttaaatttaatgctacttatcttacatgatgtcttggatgttgggtagaaaccaagtctcgtggaagacatggtttccttctcttttctcatttattcacttgccacatcatttttcatcgtagatgatagtttatttaatactatggacacaattctagtcattgggttgagaatggtcttatatgttgtgtagtggtgtgtgggcgtgtgcgtctgccgtctaatgggataaaatagcctcccaaatcaagaaagccctaaggctcggtttagataatgggttaggagggatgggattgggacaaagatatgagtggagggttgagatgaaatgagatatgaagaatgaatggctaagattaaaagttatccttttagaaggtgggataagatttcccaacccattttct

SEQ ID NO: 8841 - DNA, 1501 bp, Oryza sativa
aggccggagatgaagcttcggaggatccctacgcgtactaccaggagggtgatgaagacgatggcgctcagtaggtcttagttacggtcgttgcctgtggcaatggcgtgccgctgccttaactctgctgccttatccacttctgcttttggaatgtattccggaccgctcggtccgatgatctaagactatgcctgcgggcttatgatgtaataattcacactagattctcgtgtatgtgcatttggtatttcagctatgaactcgtgtgtaccagactacttgatccagggaaatggtactgtttacacgattgattcctgttataaaaacgggggtccacagagctggtatcagagccatacaactgtaggaaaagaccaaaaggcgccccacccctttcctagttggccaagggagaaattcccatttagtaatattttcaaaaataaagacgctatgtttacaaaactatatacgattttcatcttactcttaactattttcttcccaaaacgagttttactcttagctgactttgggtttttcttaaaattagatgggagatcaggattcactcactatctgggagatgggcgtaccccgctcagagggatatgtcattgagctacatcggttgatgaggcgcctacggtaccccagatttccgatctaccgagtgagacagtgtggacccgtttgggaggctcggattgaggttcatacacgagttccttcagagtcagactacagctttccgacacgccaccgtcgcgacttacagagaccgcgatgcaggacgcagcccgggaggccttcctccgacgtagctctattcaccgagctgagttggcaagtaccgactttgcttaccatccgtttcgggaggagagcaactatgtctacaaagtctaggatacaccttgctgctacaacccgatggtgactcgactgtcccgatgggctgaggcagtagacgacttctacgaggaggcgctattagagatcgacgaccagcagaggcgtttgggagagttggagaccgaggtgactgacctcacagtgcagcagcttcagctagaggaggagcaccaggcttggggcagtgagatagactcactgaaggtagagctctaggtccatggcgaccagttccagcagctatctgatcagtacaatgatcgccgcgggatgatggatacactcgaggagcagctgagaaagagtcaggagcacgtcagccagcttgaggagcagcttcgagcagctatagtcagcaccacaggagcttctacttcctcagcaatagggcgtgaccgctacttcttccttactccgccatacccaccagcgctccacgctcttttgggagaggttgatatgctagttactgagtcagcaccttacctggtggacccgacagtgacacagccacctgccccagagattgtgcacactccactgatccctacttcgtcaccgcagctgggttccagtttgg

SEQ ID NO: 8842 - DNA, 1501 bp, Oryza sativa
accgcaccaacccagtaaactttttacaagtgaccccgtaggcaacccatgatatgtgagcatgaccaatggttgcactataatgccaaaaacaaacattacaatctagttcctgatagtattggtggaaaaagggatgaggaaaaaacctataagggaaagaaaagtaatgtggtgctcacctcgtcgcctcatgggccctcgccggccgacatagcacgccgtctcctttttggcttgctctgtgctgcttcaccgacctccctcgacgaagacgctccgccgctagcaagtgtttggggcaggacgacctcgcactcgttttgcgaatcggcaaacctaatccgcttgaccctagccggcattttcccagtcatctccattggacatggctctagatcaacaacaaaaaaggttagcccggcaatgggggtgaggaggcaaactcatgcggcgggggataaagatatgggatgaggaagaggaatgtgtggagggtgatattgctggtacctgccggccaacattgtgggaagggaatcacttgggagaaacttcgacggcgctgacgatccccgagaactagtaacaccctgaaaattcgaccaacgaaatcaaaccctaaaattttgggccttcaaaaactttttaaataaattgcatcatgccgattttattcgcctatttcattggattttgatttcggagttcttagatcgtgaataagaaataattaattaggaataaaccctaaaattaaattggcaaaataaacaattagaatataatttaaaataaagatttggtgaggatagaaataaatgaaatattattgcaaccatatttgcatcaactaaatttaagtgcgacggaataagaattagccctaatataaaaattcaaataaattataaaatatgggtaatattaatctagggtgaatccattggttagaataacacaaatattgagtaaacttcatttatgcaggatttatagaataaaatttatataggaaataggctaaaatagggataaataggaaaagacactattcattcaggcataggtgttcgatgaggttccctagccctgccccctcctctgccgcgcgcgcctgccaccccgagccccgcgccaccatcgccgtcgcgtcacctgtcgcagcgccgccatcccgtcgccgcgtcgcgtgcctgccgcctcgcgccccgctgcctgccgcacgctcgctgctgccgcgccgcaccgtcgtcctgtcgccgtcgttgtcactgtcgccgtcgccgcgcgcccgtcccctcgtcgcctcgagccccgctccgccgttgccgcgcgtcgccgtcgcctcgagccccgctccgccgtcgccgtcgcgtcgcccgttgccgtcgcgtcgcccgtcccgtcgccgtgcgcccatcccctcgccgcctcgcgccccgcgctgtcgcgtcgccgcgcgtcgccatcgtcccgagccccgtgcgccgccgtcgcg

SEQ ID NO: 8843 - DNA, 1501 bp, Oryza sativa
ctcctcctagtccttgccttgatgcatcacaatatataacaaagtctttcctattgtcgggaagaactagaataggcgcagaggtcaacttttctttgagctgttcaaagctttcctggcactgttctgaccacacaaacttcttttccttcttgagtagttgtgtcattggtcgggctatcttagagaatccttcaatgaacattcgatagtatcaggccaaacctagaaaactccgaatctcagtcacagatttgggtgccttccattccgtgacggcctcaactttagcaggatccactgccaatccaccggctgagattacctggcctagaaaagtgacttcttttaaccagaactcacatttactaaactttgcatataatttatgcttccgaagtttctcgagtaccaatcgcaagtgcttcacatgctcttcctcgtctttggagtagattaaaatatcatcgatgaatactaccacaaatttgtccaagtaatccgtgaacactttattcataagattcataaagtacaccggggcgttggttaaaccaaatgacattactgtgaactcatacaatccatagcgcgttgagaacgtggtcttgggtatatccccgatcctaatcttcaattggttatatcctgatcgaaggtcaatcttagagaacactttcgctcctttaagttgatcgaaaagatcatcaatccgtggtagtggatacttgttcttgatagttacttcgttcagtgagcggtagtctacacacattctcatgctaccattcttcttcttgacgaataacactggggctccccaaggtgacgaactgggacgtacaaatcccttctcttgcaactctctgatttgctttttaagttcctacaactcattgaccggcatctgatatggtctcttggatatgggggcagttccgggtatcaggtcaataatgaactctatgtcacgatctggtggcattccaggtaaatcttctgggaacacatcagggaatcgctgcactacgggcattcctttcaggggtagcatggtaaatatgcctccggcacgttcggttagtctaggatcttgatccatggttgctctcatatccgatccccagggtgtggccagggtaacttctctacgtctacagtcgattactcccctattctttgttaaccaatctatacccaatatgacatcaagggtctgaggcatcagcaccataaggttggagggaaacaccatatccctaaggcgaataggtacgtcaatacaagctgtatccacggttatttcacccccaggtgaatgcactaacattggttgccttaatttaactctggtcaaattgtgttgttggcttgctttcaaagatataaatgaatgcgatgctcctgaatcaaagagaagtttaactggaatggagttgatagaaaacatacccatcagtacgccctggtcttcctgggcctcttcagctcgaacgtggtg

SEQ ID NO: 8844 - DNA, 755 bp, Oryza sativa
agggtgggtgggtgggaagggggttgggggtgaggtgtgaggtagggatgaaaacggagcggatatggacggataatgtttataccatattcgttttcatatttttttaccggatacgaaaacgaatacggatagctcgaatacgaaaacaaatacggattatctcgaatacgaataagaatcgaatatgatcggacacgaatacggaaataaatttttctcggaacacgaaaaccaactcaacttctaatagaaacaaatatcaacatatataattagctcattttatataaaatgaggtataatttataaatattttttaaaatttaaataatattaatagtatggactagtgttagagataaactactattaaaatctataaaggtatattgaaggttatagagttaaaaagaaatggggtatgtctcatgggtcctgcggatatccgaatagcactgttcaccggatatccgaattattatccgtatccgacggaaaccctggtaccatattcgtatttgtatccgggagaaaatatccgtattcgtatctgtatccgaactatccgagaattatccgatccgaaagttatccgtatccgtttttgtccggagcggacggaaactatccgctccgttttcatccctagtgtgagggggagtgttttagttattaggatgcggtatagtatgtctatatatagacacacatatatatatatatacacagtggcgctcacatgcgcttcgcgc

SEQ ID NO: 8845 - DNA, 1501 bp, Oryza sativa
atgactaaacgattcattctttattatcttttaaaaagcggcagacataacaccaacatctaaaaactttaacccttttggactatgggtaatgtattcataaaaacatatggtctatcatatgtaatggtttgtggcaaaaattaaatagacatatcaaaactaatcacgtttatggcgcttgaaccgggttactggtgactgagcatctcttggcggggtctggtcatatcgaaagttgtaaatgtcctcttgtataatatcaaggtcaccgccgtcgtcgatgaaagctgggtgcagaataatcttgttgttggggtcttccggcggatttagatcgtcaacgtcagaagggggggaagggcatagggtagacatgtaccccaagtcctcgcgtagatcatgccatcatcttccatcgatggcgacagcgggtaagggggtggcgacagtggaggagggcttgtcaccccaaactcttcggggagatcactctcatgctcatcctgttgcagcgtggcatcggtggtggggttgtgagtgggatcgacaaaatgtgtctttgtggattcggtctcttgtttatcacccatggttgagttggctgcgtaatacaaatgatgagccgggcagtttatattggggaaactgacaggatggttgattcccacatatcagggcaaacaatctcagcgattttgtagcgattcttgtttgcatgcatgcgcgatatatctggagtaatgtgcgcatggataaacaaccataatgccaccacagcatagcgacgtaaagttattaaataactatatttaaatcatgtcgtgtaaagttattaaataacaatatgtaaatcatgtcgtgtaaaaaaatcctctgatacgtctttcagcatctataggctcattccagttattttttaactttgccaacgtttacttaaattctccccatggccctatagtactcccgaaacaaagacaaatttttaactccttacatgcgacatcgaaaggcaaaacaattatctcaatcagttaaactataacttctcacacacggaacgtcttcatcaccgatcggtctatgcaagttaattttaaactatttgacctcatatgcacaatcaaccaccaccgattttaacataaacatgactctgtcgtacgggtggaccacggtaaaaatttaacttgttatctgcaacatcttaactcatcaccaatatttaaaacagttaaatttttactatcacattcgctctccctttgacatgcgaactgcaggtatcgtttgcgccacaatttccgtcagttaatttttaactctctaataggttggtttggttttggtgggctgacattcctcatttgtgtgtggcgccatttaaaccgtggcgcgaagcgcatgtgagcgccactgtgtatatatatatatatgtgtgtctatatatagacatactataccgcatcctaataactaaaacactccccctcacact

SEQ ID NO: 8846 - DNA, 377 bp, Oryza sativa
caatcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcgaagcttgccagattaccgatcgaggtggttggagtttgatttgtgaaaactgatctggcctatatttatgtgaaggatttgatccttctatgtggcatgaggtaaccctgggtcggcttgggaaaggctttgttgcgaacctccgataccgacaggtgttcggaataagttcgtatcttgtgggtaaagtgtacccctctgcagaggttaactaactgttcgaacag

SEQ ID NO: 8847 - DNA, 428 bp, Oryza sativa
gaaaatatattcgatgtttgggacaacgattggtcatgcttttgaaattttgagatttagcaatcgatagttaaaattttgaaatctggttcaaaacattaaacatacatgacttatgctgtcgaaagacaaatacttctgctgaagcacatgcttcacttgaggagtagagcgggaaacagtagttgtatattgatttctcaaaaatcatatccctattatacaccttttggggtttatttataggtttgtagtcctgggttacaaccctagggtttggtctacgtgggcaattatagtagtgccccctgatggggatgtttacaagggtttaagcctgtgtgggcaatttggttcctctttgcggtgagtccagagaggataacaattgctgacaaccaaatttttcattggaccaaatttttagg

SEQ ID NO: 8848 - DNA, 1501 bp, Oryza sativa
tgtttggtttgctatttacttctttgaatgaaaacgtgattggttgttagatgcatactctggattattatccgataatgcattgcaggtgaattctctcgtacaaaagcagcattatcaaattagctgtgcttagcaacttggatattggacatctatggtttacttggattgcctaaccctttgagaaatgagctggaactgcttgtgctattattttttttctagcagctgcttttgtttttaaaaaaaccatgcgcataaagtcgtctaaacattttaacattgtgtttttcagtgctaccgaaatcaaggtgattctgcatctccacatggacgcaacttcaggaaaggtggtatatttaaacaaagctggctcgttagtagataacaaagttacaagacaaggaaaccatggatgtgcgtgcctctgtttcagtgctatgcgtcatgaaaggagagcatatataatttggtggtgaagcctcccctttgcatttgaaggagcattcagcagcgatacggtctgaaaccatctgaaatgaagcattatcgttgatcatggcgattggagggagacagagagagcagtggtcctggaaggtgataccgtagcttccggtggtcgaccagaaaccatgatgtttttttgtccataggattgttgttttgttttgataggataagatgggctacataattttaggtatcgctaggatttaatttacactgtagacaaaacataaggccttttgtgtctaatagaagaaagaaagatggagagcatttgcccctgttggaacaattaatgtgctgcaggcaataacaatccagttggttggccattacgattcctgactcctgtgctgagtgatgagaattcagtgcctcctccctcactagaagggctgttaatccgtgaagcatgcgtgaatactggtgttgcaattggccgtctgcaactatctgtccacgcaagtaagcatccatcgatggaaaggccggcgaaatactagtaaatgcatatccatgtcagtcagattcagatcacatgaggttaggtccgcaatgcaaatgctactactgggtgaaatatctgagcaattagtaagtgaatgtcgctactgcattggcgttgcatggcctggcctgcctccatgtatctttgtcgcgcacttgcctgcgctttttcccaatattttaatccaaaattatctatcttaattagcttctttatctctgtctcagtagtgcaggtgctcccaacttaataaccttttaacacctgaaaaagaagatctcttttcagtcgagagagagagcagggcccaggcgaggctatatatacacggcattgcatgcaccatatgcatctcaatatctcttgcgacctcactccaattgcacaaacatacatacatacatacatactcgatcagtcggcaattgattaagcagctagctcaagctggtaaaattaaacgaccaatatatatgatga

SEQ ID NO: 8849 - DNA, 1043 bp, Oryza sativa
ctctatgagtcgtctagtcaccaccgcttttttttattattttatttaaaggccaaaaacaaaagggccctcctcttcctcctgtttattccctggaatatccaccaagccccaaatcccgaatgctccatgactgctccctctatgcctctacacgttcaaactctatacggtcttcaaacatagtaatctttagttttatagcaacaatattatcatcgtataaaagtaaattcaaataataatattttgtatattttagaaaacacatcctacccctataaatatatctaaagactcatcgatatatcttaaggtagataaagtcatcatcaaatatctgattgtcgacgaatatatcgttaccattaaaagaataataattagttatctctatctctatctctactacttataaaaaataaaaaataaaagatgtttccaccgtccgtataaaataaaaagggcgacaaaaatttttgtcttaaaataaaaggaaaaaaaaagaatgtccgactcccctaataaaagaaagcgctggactcttaaaaaaaggacttctcgtacgtggaaaaaagatgtccaactcccctaataaaataacgcccgactcccaaaaaaaaaagacttctcgtccgttaaaaaaaagtccgtccaaaaaaaaggtccaccctaaattctataaatatccatatattttctcctctaattaattagaaaatctgttccttccacatcctttgctacatgatttcccttttcaatttgtctttaatttgccggccgtttaactattatcaatgatggccgaccgacgatattttttcttttttatcctattatttttttcttttttatcctattgcagattcgctttgattttggaaaaaaaatgaaaataggagatcaagtggatcaaaagacctcaataaatttttagaggttgggtatatttaatagggatgatcggctatgccatcatacatatacaagactgtatttggaagctaggagaggcatgtcaggtgaagggtcctcaactc

SEQ ID NO: 8850 - DNA, 1501 bp, Oryza sativa
cctctacagaggggtacactttacccacaagacacgaacttactccagacactggccggtgtcagaggttcgcgacaaagcctttcccaagccgacccagggttacctcatgccacatagaaggatcaaatcctcacgtaagtataggacattttaggcattcacaaatcaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcataattcattttattttcaaacacaccgacaccacatgtcgggttttgaaggcttcacaaacccatttcccaagttttcaacaaacaacggtgtatgtgggatatttggtatacgcgctcagagagcacgaataccgaggtaccacaagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcaaaaacctaaacaaaagaccaaaagaaagatcctatttagacctattagtagtgccattaaataggtctcaattttacggaattactggaagtggaacggaggcgatcggagctacggatcgagggatatgaattttggaggtctaaatggattttctggacaaggaaaaggaattattaattcccttggaaaagaaaaggaaggagggatcggatttagacttcctcgggcgacttaggcgcggcccgagggattcacaaggcttggccacccattgggccgagcgcggccacggggaggcggcccattagggcgcgcggggagagagggaggcccgacggggtgggcgcggtccaccgcgcgggacccacatggcggtggttgggttcacggtggggagggcgcacgcgggggcaggcgctagggtttcgggtgcgcgcggttcgggcgcggcgcgccgggtggacggatggcggcgagcccacgtgcagccgcacggcttgctgtggaccgcgcgcacgggagggaagacggagggaggaggctgactgggcgtgacttgacccagtcaagcgggcccggggctgaggtggctgccacgtggtcggccacgcgggcaggggcgaaaggggaggaggaggag

SEQ ID NO: 8851 - DNA, 333 bp, Oryza sativa
gtcatacattaaaatacggaggcagtagtatactcagatcagatgccaacggttgccttacacaaggggatagaattatatgtactctgctgccacttgtgcgttggttgcttgagagtaccatatgcatgatgcatcagagtatcagacatggctggtagcccaacaagtcatctttcaatctcccggccgttttctttttcttccttttgctatgttttgtttttatctcttatccattgcaaattgcagatagtgtttgattgggggaaagcaggaagataatgcgaccgcagacagcaacacattttggttttgcacatcttcttcagt

SEQ ID NO: 8852 - DNA, 1501 bp, Oryza sativa
ttaattgcaggcttgtttggaaacttcacacaaattttgccagacgtttgtccaccaattgcagcacaaaaataacttttgtctgcgaaattcggtgtcttctctgcaaaactccgaacaccgacggggccacgagcaccacctcgtggtgggccccgcggcctgctcagcgccacgccttcacctcgcccccgatcgccgcctctcctcgcctcacctcacctgtcccgctgtccgccgcgccgcccggttcacacggccacacacgcaccgccctctctacccgcaccaccgtagcacgtggccaccgtgtcactgggccccacacggcagcgtcacgcctccctcgcgggtaagatccgaaacctgtgccaaaaaaaaacaaaccccgccccgctttgctttgcccttggccgccccggtccaacggagtccaggctgtcaccgcgagggagccgagcttatcagcacgacgcggccgtgggacccaccgtacacgacgctgacatgtgggccccaccttcggctgacgtcccccccgcgtggaagtagcctagtagggcttgtgcggctgcgtggtggggccgtgaggccacgtgcccggcatgccacggtggagtggacacgcgtcgggcgctcattggctggggtggggcatttctaggggccccgggcgcctcctcgcgtccgcctccccccaaaatttcgacgccagagcgcgaggagacgcacacagaggtattccttcgctgcgatctctctcctccccctctcgaattttgatctcttcccgtagaattttcgcttcgtgtgtgtgtgtttccgttcgattggatcggtgctggtagtacttgctagcatgatcccccgcgtgatctgtggccgtttggtgggatcgttttccatctgaattctcagctaaaccctgctgttttcgtagcgatttttttttgctaggcgtgctttagtggtaggtttgtctgcacgaatcgggtgggtctctggtggttttgaagtgatctgtgtgcggttgatgtgattttacggagtatggttggatccgtcaaaaacctgagttctgtaggggttctgtggttctggtccatgtttgcttctcagaattttgcttataattttgatttttctcgtcttgatctattgttagattgactctgatgtacagttagctcgggaatactgaagctacgattgcggggcagtaattcaaaattgctctttgaaatgtgctacggtaccaaattcaaaaatcaaacttgagatcattggcttgcccacttgaaacaggaattggatggatttcccaacaatgcatcattttctgttttttgcttctgaatttatgcctttattctgcatcgtggattactctttaaattgtttgtatggatcctccaaagaacggttagttcatcaccgtttttgttctttgatcttgcagacttggcatttgtagagtttttagatttatagatagcaaaga

SEQ ID NO: 8853 - DNA, 792 bp, Oryza sativa
ctccccgagctattgaaaccagtgcaatttgaatcgctcagcggttttgcagggcggttttgctgatgtggcaccgacatggcaatgttgacctagtcttcgtcccatgtggtgctgacgtgacattagaattaaacaaatatatgtgggacccatatgtgattcacacataaaaatatattgtgggtcaactgacatgtgggccccacatgtcatcctccctctctcttctctctcccttccctctctttctctctcatggcgcaataagccggcaggggcggcgacgacgggcgggagccggagtggcagcagcgatgggcgagggccggagtggcgtcgggcaagcagagacatcggcgagcagtggagacacgagcatggcgcaggggcccgttgagcggcagagacgcgggagtggcgcggcgttggggatgacgacggcggtgctcagcctcgatctccgccgcggcggcccccgctccggctcaccaccgaattgcgccaccgctgcctccgtcgcccctttcacgcccacctcgtcccctccatgctcgcccgctaccccgccctctcccgcctcgatctctccctctgcccgcgcctccccgatgccgccctcgccgcgctcatcgccgcgccgtccatctccgccgtcgacctctctcaatctcggggattcgctgccgctgcgctcgttgctgcatgcccgaactcaatgacctcaaccactctaatggcccaacgccgctccggcccttgcccgctgccgctgccgctccggccatcacc

SEQ ID NO: 8854 - DNA, 1501 bp, Oryza sativa
tcttaccataactgaacccaattttgatgtttgtggtggagacttgtccttgtcaggatcattgagtcggattgccatgtaaggtatcaggaaagctaaacaaataaaaattgttgttagataatctgaagtgatctatccatgagctgcaaagcacttcttgtcggttagatcatactgtttgtgaggaacatctgaaaaccccacagtaggtcgagtgatcccttgaaccgatccctcctagaatccgtgaagagaagcggcgcaaagagcagtgtccaagcgatcacaaaattgaacaatccttcagccacctaggcgagtaataccaaatttagcacaaatgctgtacccacaagtcatggcaacaatcacaatgtgataagtggatgcagatcgatttcttactgggtgcaacaccggggattcgagcaggtgaactccagctacgctgcccagaaaactcaccaatagaatcaatggccgtaatgctgtgaacttcaaattagagtgcctctaaagattcttaaattacaggcgtaccagaattgagcaatggcaggattaagaagaaattgagcgacaagccaatgaggtcactgatcgttgcttgcgagataccccacaccgggtcaccctgcatgatcttaacgaatcaaagttttgccatacaacgatgttaattgctaactacgtcgggacgcactaatgaacgaatcaaaagtattgccatacaccgatgttgctaactacatcgaagaagcactaatgcattttggtcttaaactgtacaaatacaattcatagatgcaaatgtaccaaaattgatgttgagtaatcaaaagatagtcatacacaaaatgctagtaatccctatttgtaagtacatcggaacgaactaatgttgtaagcctgtactgtaatgcattactggcggcaaaattttaatccagttcattgaagcaatgtccaaaatctggtgtcttcgaaatctacacaaacaggagcaaaaaaagttcgtgtttacgtacagaccggagcgtatggtaggaggaagagccagaggatgtaggcggcctcggcgccccacagcgtcgcccgaagcagcgcgcgcgccccgccgccatcgtccgaggcaaactctccgccaccgccaccgccgccgctgccacgcatggccgcgcacggcgcaagggcccgccccgctgctcgccgcggcgagggggagtggccacgcgcggggcactgggctagcgaggccagcggtcgtgccgccccgcggcggggcaaggcgagtggggtggcgcggcgcggggaggagacggcgcagagggggagggggaatgcgagggcgagggttcgcgccgccatcgccatggccgcggagcggggtggagaggggcgggggataagcgcttttttccgggcgcgacgctgcggcgcacgatttgtgtggaacaaggtgtcgtatacgtggcctatatggtcacggcatattaca

SEQ ID NO: 8855 - DNA, 1501 bp, Oryza sativa
tactgattaattgtgaccaaatatctcatcatgtttttcagtactgtgtgttgacttcggtgtctaatccagcattgcatcactaatcataagtatcaaaatcgcgcgaagtgctaatcctaagcacgaaactaacgtaactatttccatctcgtaccagcatttgatggcactatggcaggtaggcagctccacccctacaccgtaatagttgctaatcatgcggtgatgagattgataaggtaaaaatctaaaaagaaatatggagtaataaatcagaatctcagccatatatgttactctatccatctacttttgatagtcatgtttcatcttggcacacagatcaaggataagtaattctacttatcatccatttaaacatgctaccagtcatttctcataaacaagcgattcattaatatttacatttctcgatgcacatgtagccaatcttatgaaggaatggagagtcacgcattatatctgagaaagtcattaagatgatagattgttggattaaaatatgtctataaaaataattttttcagatttaaaaatatgtctatcaaaagtagatggagggagtaaagagtagcaaacggacaaaaaaaatctaaatgttggattaatatttatttttttggtatgtttgctactcttcactatatatgcagtgagctaagatgcttgtttattactccagttttttttacctcctacaatacctctaccccttcaccgccaccacccatcagccgaaaggagacagagctgttgacagcttaggggtggcaatttcctcgtagggaccggggacgggggattttctaacccatggggaagtcggggcagggtcccggtcatttgaggggacgggggatgaaacttacccgcgaggccccggggtatttgttagcacttaaaatatagtacactgcaagcccaggagacccacttggtagaggcaagttggcccaaatatcacaatttagagaggaaagcccacaacaactagcccaaatatgaaccgtagactagcacaaccctatctgtatatctcttttttatagctgcccccatctctccgtgactccatgtctccatccctctgtccgccgtccgcctctcgaagaggcggagcgcacatgccgtgcccccaccaagctttgttcccgcgacagccggcgctcttcccagctcaacgcaaagttctttcctgcagtacgaagcttccccaccttctctgctcccatcttcccgacagcgtccggggctcctcccctgcaacattccaacacatgtgtcgaccacgctcctcggctacaattcgaaactcctctggctcctacgtctcctttcgaggtgccagtagtttgccatccctcgccccaacccaatctgctgtcactggtagcctgatatgtcgtcggttctcctcttctttcaccacccgaggggccccggtcagagtttgggaacccaccggagccggggaagg

SEQ ID NO: 8856 - DNA, 1501 bp, Oryza sativa
catcaatgtaatatgtccagaaagtttatagcaaaagaataattttgtctaggacccaagaccttggaccttacacctctaattgtgcctcttaaatacccatgcactttcatgttactaacttgtaccaccggatagaatgattattagttatgtatatcagaaaaactattttatactaatcacgagaccttgggtgataattacatcataacttgtttcaaataattcttggaatatgtaatgtgtacttcactaggttgggagcgcctaatcccccgagatatgaaaatgaaataatgcatgcaaagacatggaaaatttcaaaaataaagtaaaattcatgaacagttccaataataatattaacatactacctctgtcccaaaatataacttttggctatgaatctggacacacggttgtccaaattcatagctaaaaatgcttatattttgggacggagtgagtagagtatgatggcatctacaaggagacaagtgtcaaagggagtgaattaatcatgttttaatagtgtgtggggtagagaagataatgttttggtgattaactacactagcaaaataatttagcgatagtaataataagacttacgattttcttgcaagatatgcagttgctgtctctagcttgccgcctccacttgcagcaactagcagagaaggcaaaggaagaattagtcagctggatcaaaagggtcatatttgaaattagttgctagtgctattggcagttaaaaaaattgcaaacatacaacaaaaagttcattggcatactacacaaatatttgcttaacaaatttaaatgttgcagtaatgcagccttcccctttcccttactatgaaccgcgagagttcgtgttaaaaacaagtttatgtttcagtaaaaaacaagttgatgtttgctcaaaatgcagaactagaaaccttcagttgtagctcaaatggcatggaaaactatttccatacaaattgttctacaaactagcttttgcattgcatgtgtttctagtagcggtgcagtgctactacaaagtacaaactgtcctgaataataataatcatcaggaaaatagcatggaactagcaaaggttttgtatgggaaacttggttaatacaattgtatattcagtatttcttcactgaattagaaactttagtaaagtggtaaatgctcaaaagcagagggcatacaatgtgttcatcaaagcatacaaaagctcatatcagcgaagaaagaaaaactaaaaatcagagatatgaagaatcaactgctgttctcagctaaattcaccccatagtaccagtaggtcaacccacccccccccccaaaaaaaaaaaaaaactaatctatttggcactggtaggacatgctcaaaacaactatattcataatttagtgactaatttgactggcccatcaaacattaaaagacaatcatgatacagggctgtaaaaatagaaggcctgatcatgttg

SEQ ID NO: 8857 - DNA, 1501 bp, Oryza sativa
tataaacccagataaaaaaaagcccaatttaatatcaaacaatagaaaactaaaaaacaaatttgcacaaaaaaatcttcaatagcccaattaaaagggtcagcccaattaaaagcccatttagcccaaaaagccaaaattggaaaactttactgcacgtgattacagctcacgtttttccagctcacgatgtaccacttctttctggaatagagtacatctccaatcccagatcaatctcgcgccatggaagaaagtgaggagaaggaaaagcgaagcttactccactagataaaagatattggatatggagatagtaagaatcaaaatccagattcaaacaagccttcaaatcgaaaacagaagagatccaaaccttaagaaaagttagaatgcaagaatcaacaagaaggtaggaaaagaagaaaagttgcaaatcaaagccagaaaaagtaaaatgcttaattctttgaattaacaggacaaattcaaaaattacagtaaatttctaatagaattacagtactattaaactgtaactgcaatatgtttgtactgtaaattgaaatacagagaacaatctgaaacttagtaaaagtcagcctgtcttagtcatgtaacaatctaaaatcaatttgaaactaatatgaaaaatatctacgagcatcaggaaatcagcctctatgactcattttgaaatcgtcaataacttttgttctttactcatgcaagattgtcactgaaagattaaaaatacctaactaaattgcacatagcatatagcatttgcaaaattatagcctcaaaaacaccctgaatgcttcaatagaattagtaactgtcatcaatcataaaaattcagaacatcaattatatttctacctggtctagcaagaattgcacattcttgtcatcaacacaaattaggtagcaatgcaaattgtcaccataatcaatctttcaattagaaaaccctatttaaccatttgcagattacataaaactgttcaaatgcacacactgtacaccctaacaatttcaaggttttcagctattatacaactgaagcataaaactattcaaatacacacattgtacaaaattacattgtaattataccattggagatgatgtaattaataaaaaagtgagttaaaaaattataccattggagatgatgtaaaattatcattatcttgaacagcttcattaacatcatcattaatttcattctctggttcaacaccttcattccaaattaaaaaaatgcatccattacagttaactatgtattattttacatgtttcaaaacatattacagttatttagttaaggaattacaacaaaagaaagagtgtaatttcagtaataaattactgtaattgatgaattaatgcactatagtaatagtaatagatatagtatttatagtgcaaaatgataaagtacacatgcatactaatttcaaaccatgcatttaacttggtgacataaaaaaga

SEQ ID NO: 8858 - DNA, 1501 bp, Oryza sativa
cccgacattatcaaagaggccgaagagaaggttcgcctgattcgagaccgtctaaaagtggctcaatcacgacagaagagttacgccgacacctgaagaagaaacctggaatttaaagaaggagattatgtttatctaaaggtttctccgatgaggggaacgaaaaggtttaaggtcaaaggaaaactagcgccaagatatgtgggaccctttcaaatcacggctagacgaggagaagttgcatatcagctacagctaccagaaaacatcgccgatgtgcatccagtcttccatgtgtcccaattaaagaagtgcttgcgagtgccggaggagcaagctccgttggaggaaattcatattagcaatgatctcacgtacccagagcatccagttcggatactggatgaagtagaaaagaggactagggccaaagtgtggcatatgtacaaggtacaattgagtaatcacactgaggataaagccacttgggaaagtgaagaattcttgaagacagaatacccgcatctgttcgaagaccggtaagaaatctcggaacgagatttatttaaggggggtaggtttgtaacatcctgaaaattcaaccaacgaaaatcaaaactctaaaaatatgggcccttcaaaaactttttaataaattgcatcatgctgattttatttgcctattttattggaatttggtttcaaagtttaccgatcgcgaataaggaataattaattaggaataaacactaaaattaaattggcaaaataactaattaaaatatagattaggtgaggttggaaataaataaaatattatcgcggccatattggtaacaattaaatttaggtgcgatggaataagaattaaccctaattaaattcgaataaattaaaaataaaaataaaaataaaatatgggtagtgataatctaggttagagcaacacaaatattgtgtaaacttgatttgagcaaaaattagaaatattgggacaagatttgaataggaaaaacaaccaagttggaaaaataggaaaagtcactgttcattgccccaaaggtgttcgattgaggtcactagccctaacccccctcccactctgccccgcgcgtggccgccccgagccccgcgctgccgttccatcgcctcgagccccgcgccgccgtcacgtcgccgcccgtcgccgcgtgtcatcgccgtcgccgtcgccgtcgcgttatctcgcgccccgtgccgccgctgccgcgccgtcgccgtcggccgtcctatcgccgctcgcccgtcgcgtcgccgcctcgcgccacgcgccccgcgcgccgctcgcccgtcgcgtcgccgcctcgcgccccgcaccctgccgcgccgctcgcccgtcatcgttgcatcgccgtcgccgtcgcgccgagccccgcgccgcgccgcccgcccgtcgccatcgccgccagccacaccgcgcaccgcctgtcgcgtcgccatgaggccgtccgcccctccccca

SEQ ID NO: 8859 - DNA, 218 bp, Oryza sativa
atccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatc

SEQ ID NO: 8860 - DNA, 1501 bp, Oryza sativa
caccggagggatttacaaactaataaatggtttaagagaaaacaccctaaaaagtcagttgtcccagaattttagcaaatctgaacaaaacctaaaacttaagcaaattcgaatctagcaagaaacaatcaacggaactttccagatctgatctatgaaatattagaaaggtttttgatggattaacttgaacaaaatcacagcaaaacgaacaatcacaagttaataccaaaaccaaacataaaagtaaaacttacgaaaccggaagagatcgttgatggcatgatgattgaatatgatattgattgctcaaatatattgttcacaaggtgcagccacaacacccctcacaagtttatcacagaaccctatctaatttctcaaacttggcttacgctcaaggcatagccccgtaccgtaccatatataagtctagagcttcaacctctttagacatgtggtggaatacaaccatgtaaagtatgtagtactcctatatgtgctccatttgtacttagaataatccagcagcttgcacatatataattgtgtcagacaatatttgcactaccacgtcatctgtgaaatgcgaataaactaataaatattactaaagcagcacctttctcgcggtgtaaagcagcacctgctgaaactgacgtttacatcatcgatctctgacgaacaagtgcatacggccatatatgctcaatatgggaagtgattacgtgcgtgcatgaagaaaagcagggcaactaataaagagagtaaaataccaaaaccaaattaatcaacttcagtgccggctgacaagtatgaaacatcgaaccaaaaagcaccatcggaatcttacgtcctcatcgtttaccctatataagtatttgtcgccattcccccatcttaaaatatacgaaattttagggttgaaaagcaggtagaagtgagtggtggagggttgtgattggatgagtagtggagatagatgataaaagtgaatggtggagggttgtgattagttgggaagagaattttggtggagaagttattatattttaggataaatcctgataactaaaagttgttatattttgggagggaaggagtactaaattttaagtttttaaacttaatttttatttaaagatatttttaacgtagttttttaatattggattttaagtagttaaaaacacacatacaaaaatttaaattataaattattttttatcgatactaaaccgtttagatttacaattaattccaatcggtagggtcgttcctttctgccaaacgccacgtcaagagatggaactatgtatatatacggatcacggagaaacagcgggacacgccgcatgcggcatgcccatggatagacgaagtaaagccaacgaaatcgtttaaccaaagcaattataagagcgaattaagcacagaagtcctgtctgccaccaccggccatcgcatcgcacattgtcatcgtcgctggtgtggccaccaa

SEQ ID NO: 8861 - DNA, 1501 bp, Oryza sativa
tactagcgttaagcctcgccggtgtgatgtctaggcggccatgtgcttgttgctgaggatgcctttagaagaagctccgcaacaccactacgccgagctcggaaaatgaagcgcacggtcgctggcggatatgagattacatgccgtgagcagcgtggccttggtggtcttctgcgaggagacagtgctcccaataacgctgacaagcgggccgcacatgccgtgcgttctcgagatggcatccagaatgaggtcgagatggctgccggacgaggtgagctcgtggagcacgatggctagctgcattcgtccatgtggcaagcattgcaagatcaccatccacggtctcccctgtgagctacctacagaacacaacaggctcctcgcaaagagagagtgagataagaaagagagagtacaagcgagaggtggaagatggttctccttattttttttattgaaaatatcttgattggatcgccatatcggtgccatgcatgtggacagatcatttgtcgaatcggagcaaaactgcctcttattgagtcagtggttgtgtgtctggtttgcaaagtttaaggttgtaaatatctcgtattagagtttaggtggtaaatcaaacttttacggctacctattggaaccacctattgacgtgaacaatggttaatatccaacatggtctaatagatggcttactactcgtatcatgtatacaatctttgtgtatataagaactaaatcattaattgtattatagacaacttattgttataccatcttgatatgatgtagaaaggttatataggcaggagccgtttaaccattgttcatttccttagtatatctcatttcttttgttattggttagtagacctcgattaaacctctaaaatgcaagttatggtccgagtttctttgtgtaacattccacttggctttgtcgaaacggcattatgtttgtgaagaaaaaaaaaggaaaaccggtagtcctgtgcagatcatttttgtatgcaccaattgcctgaggctttagcacaaggattcttaaactgtggcggtccaaactccaaacaaaccactcattggagcaagtggccatggaactattcaaatggcggcttaatagtagtgaattcttctgagagagaatcgtgtacaattattttaggactgtagtgtacacctacccacaaaaattagtaatacagtctgggaaagccactagctagggcattatcgaaatcctcacatgcaaccaacgaaccagaccggtttatgcaaataacgtcacaacgacattaaccactcgaacggaaagcaagcggtcttctggtccaaaaaccagaaatacacggttgtggatcaatgagattgtgagaatcttctgaagacgaatcaagtttcgtgttagcgcaaatcgacgtggaagatcgaccataagaaactaattaactcaacgcaagagggtctattaattctcgcactcgagccaagcttc

SEQ ID NO: 8862 - DNA, 615 bp, Oryza sativa
tgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaa

SEQ ID NO: 8863 - DNA, 1396 bp, Oryza sativa
attggtgccggctggcaaaccggcaccaattgccggttgggaaccgacaccaataggggttttttacttgtggttgcttgtttatgcctattcacttgtctggggatgatacggagtgggaatgttgtgctgagccctaagttcttgcaaaaagtttcggaaggtcttatcgatgaaatgagaccctccgtcacttatcaccatccgcggagttccaaaacaagggaagataatctcatggaacatccggcaggcgtgcttggcctctgtggccctgcatggcattccttctacccacttcgacacatagtcaacggccatcaggatatactcgcagtcataggactttgggaaaggtccaatgaagtcgatgccccatacatcaaatagcttgacttgcaggttgtatgtcagtggcatcgtatcccaagcagtgatccctccatgcttctggtaccttgtgcatcttcgaacgaattcctttgtgtcatcacacattgttggccaaaagaatccattctgccagatctttgcgtgtgtcctgaatgctccatagtgacctccatatggggtagcatgacacacttctcaatgatcttcatgccttcatctactggaacgcatctccgtagtagaccgtctgaacagactttgtaaaggtaaggtgcatcccacaagtgcctgcggctcttgtagatcaacctcttcttattctctcccggtggcacatgccccgcgaccatggagttgatgatgattgcataccacgggtcagaatctgtgactttcaacagcatgtcatctcacagatagtcatttatcggtagctcctgcatgttagtgatttgcatacgcgacaaatgatctgcaacaaaattctctaccccttttcatccttaatttgtatgtcaaattcttggagtagaagaatccacctaattagccgaggttttgcatctttttagtgagtaggtattttagtgcaacatggttagtacaaactattaccttagctcccactaaatatgacctaaatttatcaatggcaaacactatggctaggagctctttttccgttgtggcataattaagctgagctctagtaaaaattttactagcatatgtgatagcaaggtgctttttatccttagtttgcccaagaacagcgctgacagcaaaatcactagcatcacacatgatttcaatcggcagcaaccaatcagggggttggatgattggtgctgagatgagtgattttaaaggattttagacactcatcatcaaagtcaaacggggcatccttagctagcaaggtagttaggggtctagtgattttagagaaatcttttatgaaacgcctatagaaccccgcaagactcaagaagctatggactcc

SEQ ID NO: 8864 - DNA, 1501 bp, Oryza sativa
ataatagcatatatatttttatttttgtattattaaaatatattaaaatgacaacataattttcaattactgttctggcctggccaaactattcgatacgtgatatttatagtgtattgtatataggcgataattaataattattttttgatttctaattttaattattttttattatatttctgtatggactctaaattacttatctttcaacagttcttatttttataatttcaaattttctttatttataaattttgttcctatatggtctctaaacccttctttccatatttcttatttttaaatttcaaatttcagttatttaaaaattgtatttctatataaactctagacttctctttcaacactccttttaaaaaaaatttgaatttccgttatttgtattgctatatggactacactcttcttttaatatttctcttttttttatttctagtttcatttatttataaattatattcctatatggaatctagaattttttttaatattcgttatgttttaattctaaattttcgttatttctaaattgtatccctatatggactatagactcttcttacagtattccttttctaattcctttattgcaggagtattactataaggtttctagcatcttcttccaatatccttttttaaaaattttgattttagatatttctaaatagtatttctacgtggactctaagctctactctttgttttcttatttttttaattttgaatttcagttagttctaaatgaacaattgttacatggatcgactagcctaggctgtaggagatatgcgaaatatatactactcatagaacacatatccaataaatgaatacacatactatgagcataaataaataaataaataataagataattccattaattcaaggggcaaatgctatttgaccctaaggagcttttaactatttgccactcttacaaatgttgcttaacgatttgccactaggcccacatgtcatatacacatgagagcccacatgtaattgatagagtatggtaaatcgttaattgccatgtcacaagaatggcaaatagttaaattttgcccaactattaaattgaccctattttttttaaggggcaattgcatctgtgcccctactttgaaagccaattgctgttttgcccccacttttagggtttgcatttttacccccactttttaaatctgaagtagccttctacccccacttgtgacaactgtttggtgggtcccacattttgtgttaaagaaataaaaacaaaataaaaaaaggttttagaaattatgtaatgacatttgtacccctgagggaaagggaatggatagggttcttcccgtgcgtctccgtgagtcgggtcgaaatcctagctagctagcgcgggggcggcggcgcggcacggaggcggcggcggcggcggctgcggccgcgcgaggaggccgcggccacgcgggcgtgcgccggcgcccgc

SEQ ID NO: 8865 - DNA, 987 bp, Oryza sativa
tgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttctaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagtcttcgtcgttccggaggttcccgaagcgtggttttcggtcgtcgccgaaggttcggaaggccgttctctctgagcaaggcaagtcacatcatccttgagcatattgaatcccagtttataaaattattttaatttaaattaatgcattatcgctttatttaaattcccgcgttatcactgttttatttagccatgcctatttacctttgttatggccttattattattgctattgttattattaccttgttcaccctaggataaacaaaccccccccccccaactagtgggtactctatttatggttccactagtgtgaacttaggtagatgcttcgctggttaattaggcaacattaggtggttttataactttagacattgggaaatctcatatcatttggacattatggaattgttggattatggtggaattggacatacccctctcttcctctttcaaagcccctaaaacctgtttttcggtggggtttgggtgcatgccagttgtgggaagtagcaccccggccactataaggattaa

SEQ ID NO: 8866 - DNA, 1501 bp, Oryza sativa
agatgatgtcacactgttcatccatttccacatcacgcagaatctggttgggatcgttgtacggcattttcaggttccacccagtctccccattagggttaaataaaggatacgctaaagggtcataacaaccatggtatgctttgatgtaacagggcttatcaccttttgcatgtaccaagacttgtctatcaaaagttctcattggatcatccccatcttcgttggtcaggcgttacattagtgttgagctcaatcatgtagtcatctatattgggcatggatccaactctgctgaaggtctgtacgtacggcttttgcgccaaaatacgtacaatgacccgaacaaggttgatatcaaggtcaggagacctgcgaaccctatgggctagtgcatcagcatcttctgtatcataaaagtaaagctgcatatggcgcggcccttgagaacctggaaccaaattatccaggcgatggtacaatgcaccgtgcacacgaaatgtatacacaccagttcccactacagtgctgactcgttggtcaagggtaactccaaggctcgtgaatgataaatgggagttgaaatactgtatatgatttctgaaatactttgcatcattatgcacttggctgataaacaaccgtattgcatcattatactttctgaaatactttgcatcattatgcactttgcatctaatgatgcgttcatgcttgtttacatctgcaatgtcatgatttatttatggaagaaattaaatcattatgtgcttataatttcaacaattacattaacatttttaagctttattttcttctctactcccaaccattgaactcttttttttaatgaaatctcaacttgctttctgcaagttctctctgtttttttttttgcaatcggaaaaccgttacatgttcaacacgaaactcacttataagaactgtaactagctgagtgatgaactttgataggttccttcaccaaatttatagatgccccttacaaacctgaatgctggagttatatgagatgatagatgaatatcgcagggtaaatattatgtcacgttttgacaattaaatttaatgtagaatgattttttttcatgtatactacattttgtttgattaacttgatatccgaattgtgttttaggagcctatataaaattatggtgtgaaatacaaaagggtcaagcatgtttctcacggaacttctgacactagatatttttttctgtaccttttatatattttgcccttactatttttctcaacattggtagggttagactcggagaaaaaaataattgtagttgctattatttaatattgctttgcgtgcatccggtacattggaaaaaaacatttttttcatttccttcgggtataatactacaatgttcagataatactcttcatctcagtggatgatgacaattcagagctagagtttctagagccaaagggtgaaaatcatgggcttcaaggtttaagt

SEQ ID NO: 8867 - DNA, 1501 bp, Oryza sativa
tatagccaatgtaataaccaatttatacaatagttgcttaatatactgttaatatctggtcccacctatcatacacacattacatcttggagtccgtgttgtagctggctacagatttgttgcccgctgctcttctctctctatctttatctctttaaaatatatttatagctggcttatagcctgctattgtatctgctctactgggttttcataaaagcaggactgatccaagtcgagttctctctcttgccttttattcctcacccttctctcactttttttgggaagctctcactatcggtcttaaattctcaattctcgcctcctcccttctctctccccgatctctctctctcacactctcataggcaaggcagcgaccgccctcgctggcactggtggcaagactcagtagccatgcagttagtgatggagcaaagaacctacaggtaatagtcaagttaacccgtgcatcactgatagtttcaatgcttacaccacaatttcattccctgtaattaccgttggaattaaatggatgggctaaggcccactcgaagattaattctttgtaaaatcacaaaagctcacttcatgggatggcatgcatgtggagtttagtaccaccttacttatttaaagagagggggacctccttaaaagagaggatgccctcctagtcacttgaagcatgtgtgatggagaaaagagaggggaacacacgcgcgcgctcgctcgcctcgcctggcaggcgttgcgcgtgcatgacgtacgcctccttttgcagtgttttgtcatggtgtgggaaaacggcatggagtccggataagttacgcgcgacctatccggttcagttacgcggagtggagatcgtgtaggcgccctgatcaagcgacctatctctatataaaccgagccgccgccttcacgcaacacacgcgaaatcaatctagggttttccctgatcaagcgacctttctctatataaaccgagccgccgtcttcacgcaacacacgcgaaatcaatttagggtttgcctcctactctgtgctgcgccgtcgctcgtagactactccatcccgctcgccggcgtgcaccggcaatcgggagagcaggtctccggaacctctgccttcggcgtcctgcaccgggagaaggcggtaataaggtttttgggaagcgcttcgcgcgactgcttcctgttcgtccacgacggctgccttcctctctgctcgtgtgctgcgcgccttcgtcgatgcccgcaaccgcgagtagttcctgccgagcaaccggtctttccgccacctcgatacgtgttcgacatgttgcacatatttgatctgttcatgttttactgcttaatttacatgtgtagatctaatgatgcgttcatgctagtttacatctgcaatgtcatgatttttttatggaataaactaaatcattatgtgcttataatttcaataaaaccttattataggcgttgtgattttacta

SEQ ID NO: 8868 - DNA, 1501 bp, Oryza sativa
aataaatcaatcaggattggatggcatgttagaacaacgaatctaaacaggatcttctccaaatttattgtattagattatgtctcatctaattgtaagtttggttaattttaagacagaagagtaatccatctgacttcatgtcttgtcagtgatatcgttcgatcaaagcctctcatctggttggtgtggtactttaagtgcatgctagctagtgtacctcgtcaagcgcctataaataaactagcgcaggttgagaagaactatagcactaccagtaaatgtaaaccttggccatcaccttcctctatatgtggaaaagcagcggtgagagggtagaacatttgtctcggcgattcaacgatgcaaatgtctttgagaatgggatgtgccgagaattcgagatgagcagcattggtgttggctggcaccagttacccaaccactgctcacgttagcccctcgcagattcacactgccactgaaaactgtgctttagttcattctacatgcacaccacatgatgtgatccctgcagggtgagttccaatggcttgctagacacaccgatacggaactagatgtgcctatccctccagtgccgacgactccgttcgattcaatggtacatagggatattttcagcgcataagaaacgagaaaactcattattttctcattatcatatgattaatttcattagcacatggttaattaagtattaattattataaaatttaaaaatacattatgtgtttttttaaataacttgtgcataggaatcatttttgttaaatatgtgatccgaattttaggcccacaatatattcggattagtttcctagtaggagtcctattagatgtctttcttttatcccctatatatatactcttgtaagccgtacgggaagtggtgacgttcccattgtgattcccctacgtctgtaatcaactcctctatagtgatcattgccggtcggcgcccgtggttttttcccgcaagggttttccacgtaaaattcgcgtctccattgtgcatctatttccataacaagtggtatgagagctttggagatcgatctacaggtcacgcagccgccgccggttcgtcgaggcgccggatcgatctgatcggcgtcatccctaccgcccgcgcgaaattagggcagcagcagcccacgtcctggaaacggcgcacgcatcagaagattggcaagcagcagcagcaagccgtctacgcgcacgtccaggagtagcagcggcgtcaatacatccaactaaatcgcacggttcccgaggctgaaaaggaagtcaacgatggaagcgatcaggttcctgttcacgtgattttctattcacgtggaattgctacgcgcacacaagcttgtgtaccaggaagtttcagatctacgctacgtgcacacgagaagcgtaccaggtttcgcatttttttgctagatttaccctaatttctttctagcaaattcaggattaattccca

SEQ ID NO: 8869 - DNA, 1501 bp, Oryza sativa
taattcactgtagaaaataaaatatactgtccttgcgttgtactttggttatatatatatgtgagtatgtggccaaataatgtgttaccaatgttcagatcgaaatgttctcctttttctcctctcgtctggttggtgtgaggcactgaaagtgctagcgcctcttcaattccaagtgcccataaataaataagctagccactactcctcagggcagaaatcggcaccataaaattgcaaaccatgaccatctccttcctctgttttgtgagaaagcagttgtgagaaatagtagaacgctatctctgtgattcgacgatgtgatgcgctaagaatggaatgcaaggggaatttgaggcaaacaacctcaatgtagagaagctcgtgcataggcatcctatgtaatgttagcctctcatagatttcctacctcgccaaatactgtgctctagttcatcctgtgtgctgagagcataagaaagaagtcatagaattagtcgtagcaagcgaagttatcgttgaaactgtcatagtagaccatagtaatcgtcgtagcaagcgaagttgtcgaagtcgtactcatcgtcgacgtcgctgtagttgatggtctcggtgttcgcacaagagccattgcttgaagggctgagatagctggcgatctcggtagatgagcaagatccgagtggctggaagataacaccgacctccctggagccagattcaatatgagccaaagtcagattagatcgagacctgcggggagaggatgtccttgatccgaatatggtggtgaggtcgtctaggagtcgcatggtgatcaccgggtaaaccggtgtgtcttgagctgggcttagtgaagagaaagaagtcttgggggtctcgccctagtggttcgaagccaactcgggagagatgatgttggagtagatcttggccgagttcgggagaccaaacggggccaagccgccgtctcttctcgactggttcgaatcctagtcgagaagagtgatcttgccgaagttgtcggtgatgaagtcgagcactacaacaaaaacattatataaagacacttttgtagaggcattttgcaaattgcctctaagatcaggagttttatagcgtagagacactttatataggcactttcaaaattgtctagaaaacttttactctagagacactttagaaatattttcagcacattttattagattttatcttgtaaaggcattctttcggcactttaaaatgtgtctaacatgtaaagacatttgcttgagacactttaaactctgtagagacacttcttacaataaaagtatactaaatggctaaatataagtaacttaaggcataaacatatacaatgaatgacatggggttgagttggttagtgccttgaagataagaatgatttgttcaagagatcatgagttcaaggatggacaaaaaacaagggaaaatatttttttctcatttctacattggtttcatatggttg

SEQ ID NO: 8870 - DNA, 1501 bp, Oryza sativa
ccggaaaggagtagggtgtatatatatgtatatatatatggttattggtcggtgtagggaagtacacatccaagtgttttaagtcctaaaccaaccactcaagtgttaaatatagtacagtatgttcatcgcacaaattttgacaatttgaccctttgcaaaaactatttttacaaatgaaccgctgctaaaacttgtttcaaatctgacccttttgctcaacgccaaatcatgtggcgctgagcttagacacctcagcgccacgtcagctagcgctgaatgccgtgccacgacagatgggagactaagtcagcgtgccaacgtacattcagcgccatgctatttggcgctgagatgtctaagttcagcgccacacgatttagcgttgagcaaaagggtcagatttcaaataagttttggcagcggttcatttgtaaaaatagtttttgtaaagagtcaaattgtcaaaatttgtgtgttcatcatagaggtaagtgttctgaatttatgactgcacggtagtctgcactatggaatgtgtttctcatcaaattggtgatctaggtgtgggccactttctcaaagacactaaatggagagatataaaaacggacggaaacaatatatcattttaatgaaaaagattatggtccaatttttttcttgttttttagataatggattaaattaacctagcctctacatcccacatggatgtgcgttgccaaagaatttttatatttaccaatttaactataaagtaacaataggatttggtgttaaaaaaattagaagaatcaaaatttagagatggaaactgtggaaaatggtacccttttatggaaacgagatctgccacagttttaaccctaaaacaaacacggtaaagacggtcggtaattagtgtgacttcgtcaatatatcggtttttcaaatgtgctcttaaagataagatgtgcgtgtgcgcattcaaatgggtgagtgcgcacatgttgtttacgtcttcaacaatactcaattttactttaaggtccagaacaaaagcacaggttttacatggtagcatggtgaatttttttaacgtggtttttgcaaaaccaaaaatcaatatagaaaatgacttgattttggcaacaattggcagttcgtcggtaccgcgatgcaagggttggctgaggtttgtgactggcgagtagcacggtccatggtggcatggtccctcctgctgcagaagcctacggcagcaacactccaaccacctcctagctcttgtgcatagaaaacgaaatgtagtagagcataaccaggaccgcattttcataaagctaagatgaaacggagcatatgcatatcgttgtctttcatatcgaattccctaccccatgagtcctattcccagtgtatcgtaccttatctcgaattgagtcggtgcatcgagctagcttttttgatatgcgtgatgtgtccttactccttacatacgcagacaataacagagtca

SEQ ID NO: 8871 - DNA, 1501 bp, Oryza sativa
atattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtatcagagttacaacaactcatggccgatcgccgccggtagccggtccctctcgctatgctatgtagccatgcggttacaacaggcacgtccctctatttatgagagatcttatgacagagtccgactcttactctagtcctatacctagtacaactccaagtcctaaactgtaaccgactatgtacacatattcgacataaactctaacacggccgagaggggaggcaccggcccggcacaaggtgcggctgtggcctgacggcaagagagatgacaatggcccgatgggagttgtgttctttctgttcatgcttttctttctgttcatgtgtgttcttgttgttcttgcatgtatataaattaaattgttgtatgcaatctggttggggcgaaggagatttactcgatgcatcgactcaaatcaagccgatgcatcgagccgtttttttattcttgaaacctcaaaggtgtcggttctaaaccagcactgaaaccaacatccattttctcttcataacagtgccgccttcgttgtaccggttgaaaaaaccggtacctatggggtttcccaaccggcatctatcaggtgttctatggtagtggatgtaagaaaatcaaagagatgcatgcatatgcctgctggatggtgaacacgatccgattaacatgaggcaatcctagctaatagatcgtcttataagcaacaacgctccatgtttccaccatcaaatcaatgcactctgtccacacattcaggctcggctaaggcttccccgcaacaattggcacggttcatgctattgtcccttgcaagacgaacaggaacaccatttctgtggagattaccatatacgcacaaggcaatgttattcgactggttatagagaataacttatatgagtagaatatgtatagatcaggactcgagtattatgttaactggcgtatcaaggaaatatcttgtagttctagtcagttatgattgtaaagtatatatagagctttagactgtaagggataaagtctcttgtaatcctgactacttcgcctatataaggaggggtcgggtgccccttgagggcataaccacaccttagatcgtcagatcaataacataatcagcagaatatttctccggacaggagtaggtattacttctcatcgagaaggcctgaacctgtataaatcctttgtctcataacccatccactttcctgcttgttcgctacccctttaatattgccgaaatctagtttcgacagttagcgcgccaggtaggggtagcgtcaagtttttttgccaactagtgcga

SEQ ID NO: 8872 - DNA, 1501 bp, Oryza sativa
cgaatcaaatccaaaaccaaatcaaagtaagaaaattaagctcgagtttggattcttagtagatttggagccctaattctaccggcaaaccccaccactgtgtgggtctcgccgagaagcagcaccgccgcacacttcacctcctcgtggtcgcgtcaagctcctagagcccgcagatctaggagttcctcctctgtcccatgcgttcgcgttggcttggcgccccacccccacactccatcgacgaagcccggccgctctcggagcccgtcgccacttgcgcacccgcttcgtcggacccccgacgccgtggcttcgcatggcgctgccctcgggagcgcctcccagcctgtgaagccatagccgctcgctgccgcgtgcgtactccacctcaacggaccgtcgtcaccaccatcaccgccatccactctctcgcgtcgccagagtttgcatcggggagagtaggtgagaaaggggattagggttaaggttttcggacccatcccccctccggccgatgatttcatcgacgcgggaccgatctgagccgtccatcagatcagacggctcagatcggccccgcgtctagccaccactgctgttgggccacgcagtctttgggccgcggaagataactaggccgcactcagttcgccttgcatcgagctatcgccggtagatgggtcgcgcaccgcttgctgcgcgctcgtgctgaatgggtcaggccgatattttgggccagttacggaagtaatgggctgaaataagattttatttaattcctgttgatttaattcatttagtcatttacagaattttctttggcattattttgagccaattttgatttcctttaccttttctgtacttgtagagtatattataataaatgttatcaaagtgcaatatcattttattgtgaactttttccttttaaactcgatgtttaattcagagattgttgttttaatttgtcaatatttttctcaccagtgttgaaattagttgttattgttcgtcacatcatcctgtgtgtacctatataatatgattttttttccgtcacattgcaatgtaattccctggtttgactaaaatatttatcaaatatggttcatattttttaaattaaactccgttggataaatttctaagtaggctcgaaaaataaatctaaggctgaattctaaatcctatgctaattcatcaaattagactcgattctatcgattaatttggtaatatatcaaattagacttgattcttaccgatttgagattctcaaggcgtggtagatttttccgttgcaacgcattggcatgtacagagaagatagatggagataagataagattgatatttagtattaagataacaagataagttgttcacgaaatagtagtaattacttaccgagttccgacttgtatctggactggatatgtagtaagtcgaatgcgggttggtcacgacacggcgtcggtctcggctccttgtatcc

SEQ ID NO: 8873 - DNA, 1501 bp, Oryza sativa
ccatgatttgacaatgtggtgctacagagtacatgtgctaatgacagattaattaggtttaataaattcatctcgcagtttacaggtggattctgtaatttgttttattattagactacgtttaatactttaaatatgtgtccatacatccgatgtgacacgccaaaactttacacctctggatctaaacacagcctttgattattattgacatagtagactgcttaagaaatagtacagttaaacttcaatcaccgcgatattacccggtgcaacgcacgggcattttgccagtatacatataaactttgtatttcagaaatacaaagtttatacgtatgtatataaaatatatacatatttgtgtgtgtgtatatatatatataatttttgtgtatactataaaattgacgtataaaaaatgtacatatatgtgtatgtaaagtttgtatacgcatatataaattttgcatatgtgtatagaaagtttgcatacacgtatataaactttgtatatgtacatattaaaaaccgaaagaaaaaaacacgaatacaaactttgtatatgtacaaatacaaaacttggtatacatactagtacaaacatcgcatacatataacctaaaaaaactggaaaaaaagaaagagaaaccgaaaaaacccggaaaaacccgaaaaaaccagaacataaagagaacagcaaaacggaacaaaaacagaaagaaaaaaaaccggaaaaaaccaacaggaagagaaaaccgaaaaaaaccggaggaaaccaacagaaagagaaaaggaaaaaaaaacgaaaaccccgcggcgcgccgtccgccgccccctctccgcgcgtgacacgtgtccagtcgcacgccctccccgcgcgactgatcgctagataggattttggcccccccccctccccactatctatccgttccccttcctctcctctattctacgccagcatcccgattcaccgccgtgcccttccgcggaggagcaccccctctccagcgccagagaaagagaacaccagagttattgaagtagcacttaatttgtagccaactaattaattagtagcactaatagtactactggatgactatatcaccatactacctcatgcacgtgcagcatgcagttgtgacatgcttgatctgaagtttctgaacttctatctgaaccggccagattttattttagaaaatagattaaaacggggcctctacatataaaacagatgtacacagccaatctaaactaagggtgtgttcgctaacagcagatgggaactttgcacagtgcacacggaaaacggagcagctcattagcacgtaattaattaagtatttgctattttttaaaaaaattagattaatatgtttttttaaataattttcgtatagaaactttttttaaaaaaacataccgtttagcagtttgaaaagcgtgcgtgcgaaaaacgagggagaggggatgggaactttagcatccgaac

SEQ ID NO: 8874 - DNA, 1501 bp, Oryza sativa
agccaggcaggcctaccgaccaggcccagtaagtaagaggatctattttccctaaattattgaagcatacagtaattcaggtacaataaccaagtagttcagactttagaaaacaaaatgattggttcaggaatcacatgtcggagagcctgtgaccgagtaaaattctcgatcgcccctctgtttaatacaagtatgcatgacaacaatcctaggaacatgcatgacaacaaaattgaataccatcaaaatataaattacgatgaaaaacatcaaaatataattaaaattaaattttaaattttggctacagctgataaaccgattgcagcaatcgatcgagctacgcaataagatgatgaaaatttagaatttgaaataaattgataatataatttaatatgtaatatgccacttcataaacatacaagttaaaattcgacctatataattagaaaaaaaaaataacaaatttgactgttgtgaattatgtgttctcttcaaagtcagaacttctatttttgtttctactcgtataaattaaattttaacttacatgtttgtggaaagatatgtcatatattgatctctcttgttaaattattttaaattttctgatgactttttggatgacaagcaaaaaaaaataaggggtattaggtttatggataagatatataccatctatccttggggttacacagtatacaaagtatacggcaaggttgtcttaatagtgaggaatttgaccaatgtagaaagaaactgtccccttgaatagaattcaaaggtgttagaatcctattcggaggggatgccaactttatgatcttatatatgtgaagccctctctgagttctacttagaggtatataaatacaagcccttcgggggtacgggatcatcgaatcataatctcaccaccaaccataccataagcaatccggaggactgaaagacctagccaccgatcgatcttattttagtcatttcttcatccgacaaagtgataataatatgattcaggaatcggacagcagccatcacctgacctgaattattaggggtgcgttcgatgcgatgattctgatgggctgaaattatggtgcgcaaaaactactgtagcgcgttttgggctggcttgttaaagtaccgtagaagcccaccggacgtatgatggcatgtatgggtgttagtccatcgtcttcttctgtcgagcatgcgtgcattgctttgtccattggatattgccgagtctcctcctttctcctccaagcactacagctaccggcggtcgaggaggcggctccagatctgtagcggcagaccacacgatcgacgtcgacggctcgggcaagcatggttggtaggcgcatcggagtactcagcttgaccgaatctctgcctccatcgcgcattggaggcggagaaagacgagcgccgcagtcggcgtgggcatcggcgtcgattccagccggctctgcatcagctttcgctgcgt

SEQ ID NO: 8875 - DNA, 1501 bp, Oryza sativa
aatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaatgaatttcgatcacaatcatgtggtaataatgggtttgaatcagagagactcgatctggaaactcctcaatgattataacgtgaactcgttgaagagaaggagacaagcagaaatagacgctttttttgaaccatttgagagggcgcagcgtatccgtttcaataactggcagaacggaatagagttgttagatggggctgaatggaggaacggcgatatagttatccctggaggcggcggaccagtaatttcaagccccttggatcaatttttcattgatccattatttggtcttgatatgggtaacttttatttatcattcacaaatgaatccttgtctatggcggtaactgtcgttttggtgccatctttatttggagttgttacgaaaaagggcgggggaaagtcagtgccaaatgcatggcaatccttggtagagcttatttatgatttcgtgctgaacctggtaaacgaacaaataggtggaaatgttaaacaaaagtttttccctcgcatctcggtcacttttactttttcgttatttcgtaatccccagggtatgataccctttagcttcacagtgacaagtcattttctcattactttggctctttcattttccatttttataggcattacgatcgttggatttcaaagacatgggcttcatttttttagcttcttattaccagcgggagtcccactgccattagcaccttttttagtactccttgagctaatctctcattgttttcgtgcattaagctcaggaatacgtttatttgctaatatgatggccggtcatagttcagtaaagattttaagtgggttcgcttggactatgctatttctgaataatattttctatttcataggagatcttggtcccttatttatagttctagcattaaccggtctggaattaggtgtagctatattacaagctcatgtttctacgatctcaatttgt

SEQ ID NO: 8876 - DNA, 1501 bp, Oryza sativa; identical to SEQ ID NO: 8875

SEQ ID NO: 8877 - DNA, 1501 bp, Oryza sativa
taaaatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaatgaatttcgatcacaatcatgtggtaataatgggtttgaatcagagagactcgatctggaaactcctcaatgattataacgtgaactcgttgaagagaaggagacaagcagaaatagacgctttttttgaaccatttgagagggcgcagcgtatccgtttcaataactggcagaacggaatagagttgttagatggggctgaatggaggaacggcgatatagttatccctggaggcggcggaccagtaatttcaagccccttggatcaatttttcattgatccattatttggtcttgatatgggtaacttttatttatcattcacaaatgaatccttgtctatggcggtaactgtcgttttggtgccatctttatttggagttgttacgaaaaagggcgggggaaagtcagtgccaaatgcatggcaatccttggtagagcttatttatgatttcgtgctgaacctggtaaacgaacaaataggtggaaatgttaaacaaaagtttttccctcgcatctcggtcacttttactttttcgttatttcgtaatccccagggtatgataccctttagcttcacagtgacaagtcattttctcattactttggctctttcattttccatttttataggcattacgatcgttggatttcaaagacatgggcttcatttttttagcttcttattaccagcgggagtcccactgccattagcaccttttttagtactccttgagctaatctctcattgttttcgtgcattaagctcaggaatacgtttatttgctaatatgatggccggtcatagttcagtaaagattttaagtgggttcgcttggactatgctatttctgaataatattttctatttcataggagatcttggtcccttatttatagttctagcattaaccggtctggaattaggtgtagctatattacaagctcatgtttctacgatctcaatt

SEQ ID NO: 8878 - DNA, 1501 bp, Oryza sativa
agaaaatcgcatgatacctcataagtatcacatgatactttgcaggtatcacctgaaacgtgtgtagaatcgtctgatacctgataggtatcacacctgatacctactcgggatcatcctgttgcgtagaatcgtctgatacctgataggtatcacacctgatacctactcgggatcatcccgttcgaaaacgggattctgttatatagcagcccctttattgtattagtctgtgtatatttttttcatattagttgcaaatgtcatggtagcaactttattgtattagtctgtgcaaagttttttcatattatttgcaaaattacagcacagcgtcaattttgtgtgctgattttcatagtagcaccggaagagggtataaatttatgtcatcggtttcacaataaatttgattcacttatttttgtgtgaattgtgtgataaatcatttcttcataattgttaccctagtaatatttccggcaacgaaaataatcattttcttctcaatatattggtagaactcatcgaatcttatcaaaaaataatttcttaataacaaatacctcagactaatgaaatggtttaagaatttacatcgcacaattatgaaattgaagccatataaaatcgatgaaattaaatcaatgtttaatttcattacttattttttttcattgcattataacccgggtgagttcatccgcatgtgcgtgtagcatttgctgctgtgcatttacttgtgctgcaccggctggcagcctcgcgcaacccgcgccgtggcctgcgtccgacggattttgttggcagccaaacggcgtggtcgacgccatcccaggccgtctgcatcaacggtaagtgcaacagtgcatgtacaatacctaggttcccatcaagagtaagtgcaacggtgcaaaagtacagtgcctaggttcccatcaagagtaactgtaacagtgcatgtacagtgcctacgttccccacttctagaatgagcagcgaactgggcatgtttagttggtgaaataaaaaattttaggtgtcacatcggatgtttgatcggatgtcggaaagggttttcggacatgaatgaaaaaactaatttcttaacttgcatggaaaccgcgagacgaatcttttgtgcctaattaatccgtcattaacacatgttggttactgtagcacttatggctaatcatggtctaattatgctcaaaagattcgtctcgcgatttacatgtaaattgtgcaattagtttttctttttatctatatttaatgctccatatatttgtccaaagaagattcgatgtgatgtttttagaaaaagtttttaggaactaaacaggcctaagccaagttggtggtttcgtttgtggccatgtatatatgagcaatccaagttccaggaccaggacgctcgatccctctcgtccacagtttcacgtcattggatacatgtttctatatatacacactcctaatcgataataaagtacta

SEQ ID NO: 8879 - DNA, 555 bp, Oryza sativa
ttccgggcctccctgtccggaacctccgggtgtcggggaatatatatactcaaggggagttagaagccctattctctctcctcatttcttctctctccccgacgccagccctagccgccgccacagtgcttctagtggcgattttcactttcatccaatcaaattcgtttcttcttcgtggattcatccacattggtggctgggaggttctttctgtgatcgattcgcagtttcttctctcaaggtagcacttcttgattccctctctcggttcattgtgtttttatcccgatctctaaatctgtgaacctagggagaaaaccacttggatagtcttgtttctgctaccttgtagatcaccgatctataggatttgttcacatgcactggcttttttttgagtcctctgttcttcttttttgccggccggaagttccggtgttcttgcacccggaacctctgggcgctgtccagccagcctgtcattcttacttctcttaatttttgcctaactactgcactccaaattgttgattcctgttgcagtaagcacta

SEQ ID NO: 8880 - DNA, 1501 bp, Oryza sativa
aacgatgaggacgaagagcgcaacacgacatcgctcgttggccatggttattgcacgagctgactagcacatgagctcgaaaactgtttgctcaagcaacagctgcatgtagtactttattatcgattaggagtgtgtatatatagaaacatgtatccaatgacgtgaaactgtggacgagagggatcgagcgtcctggtcctggaacttggattgctcatatatacatggccacaaacgaaaccaccaacttggcttaggcctgtttagttcctaaaaactttttctaaaaacatcacatcgaatcttctttggacaaatatatggagcattaaatatagataaaaagaaaaactaattgcacaatttacatgtaaatcgcgagacgaatcttttgagcataattagaccatgattagccataagtgctacagtaaccaacatgtgttaatgacggattaattaggcacaaaagattcgtctcgcggtttccatgcaagttaagaaattagttttttcattcatgtccgaaaaccctttccgacatccgatcaaacatccgatgtgacacctaaaattttttatttcaccaactaaacatgcccagttcgctgctcattctagaagtggggaacgtaggcactgtacatgcactgttacagttactcttgatgggaacctaggcactgtacttttgcaccgttgcacttactcttgatgggaacctaggtattgtacatgcactgttgcacttaccgttgatgcagacggcctgggatggcgtcgaccacgccgtttggctgccaacaaaatccgtcggacgcaggccacggcgcgggttgcgcgaggctgccagccggtgcagcacaagtaaatgcacagcagcaaatgctacacgcacatgcggatgaactcacccgggttataatgcaatgaaaaaaaataagtaatgaaattaaacattgatttaatttcatcgattttatatggcttcaatttcataattgtgcgatgtaaattcttaaaccatttcattagtctgaggtatttgttattaagaaattattttttgataagattcgatgagttctaccaatatattgagaagaaaatgattattttcgttgccggaaatattactagggtaacaattatgaagaaatgatttatcacacaattcacacaaaaataagtgaatcaaatttattgtgaaaccgatgacataaatttataccctcttccggtgctactatgaaaatcagcacacaaaattgacgctgtgctgtaattttgcaaataatatgaaaaaactttgcacagactaatacaataaagttgctaccatgacatttgcaactaatatgaaaaaaatatacacagactaatacaataaaggggctgctatataacagaatcccgttttcgaacgggatgatcccgagtaggtatcaggtgtgatacctatcaggtatcagacgattctacgcaacaggatgatccc

SEQ ID NO: 8881 - DNA, 1501 bp, Oryza sativa
cgattgaaaccgattgaaacgattttatgcttgtctgaggcacgctgatcatgttatttgcccaaagtttcaatcggtcgtaacataatttcagtttgggactacaaaagccgaacgccatgtacagtttggtcggtggatcggtgcgcacgaagaatagtcgggcaccgtcaatttttcccctcagtataactgtaacccaaaactgattatccaaattggtcatggaatgatggaatcatcgggcatcaaaaatccctcgactggtatatactctatacgacgtcacggctgacgccttaaaggcaataataataatacattgatccgatgatccccatctatcactcacctatacagcccaggcgcatcgtactatcatagtaccacaagtctacaggcagcccaaacagcccaactcccagcacgcgcgcgggagctgcaatgggctaaaggccacaagaccgcaaggcacaggcccatgccccgccccctcgacgccgcttgtccgcttcacgtgcttgtgaacacgagaaagcctgccgcaacaacgatcgtcaggccaggcgagcgcggcgccgaatctatcgaaggcggtgcaacgtacgcttccgcgtccgcagatcgcggggagggaatcatcacgggccccggccctacccagaacacgcacaccgcgcgggatgagccgctcccggccctagctagcgtgcacgccatgagtccaggacgcaggctcaaaaacctggacgtccaactgaacactcccgcagttccgtgcatgtagcacccggcgccaatcggcgatcacgcgatccagtggcgatggtttatgtagcaccttcctacctggaatgtctctgtcggatcaggactcagcgctcgctttttggtgaagccaagacatacggagtacaccctccatcctaaaataaaatataagaaactagaattgaatgcaacatttcctagtcctataaatctggatgatatcacattcaattctatgttcttatattttattttgggatgaagggagtacgttcttatctcaggccatgtttagttgcaatttttttcttcaaacttttaacttttccatcacatcgaaacattcctacacacataaacttctaacttttccgtcacatcgttccaatttcaaccaaacttctaattttgacataagctaaacacaccctcagcctgtttttctcttccttcttttggagtgtgggccacaggcaagtttttgggtgccggtcgcgttcagctgtatcctgtagaaaatgcggtgcatgcagatcatctcgtgaagaagatgagaaacgaatagctgccaaaaaaagaaagaaagcaaggaaagaacagtcttcaccgtctgtagatttctatttgatatatagatgcaggtcataactttcatatgtatcttgtgtttggtctcaaactcatcgtcaacaaacaaaaaaaagtgcaattcccacagtggagcgtattc

SEQ ID NO: 8882 - DNA, 710 bp, Oryza sativa
ttgataaaataggttaataataacttttattttatttgattttaatatcttgtgcataattatttgtaggattaaatatattctcgtaaatcatatctattgcttaaatgtagttcttttctttactttcttagtgatcatttatggtttggcaagcaataggaatcataacaaccagcatgatgtaaaagttttaaaaagttcgaaattttagtgatttttattgttgggaattttcaggatgttacagatagtatcggagtttcagccaatcttacctaatatacatgttattttactggttttatgtatatttgccacttatatagactgatcaccctatataattgtatcaagtcagatcagtatcggttgtgctatctgaattactaactaatcgcgatttgatatgtttatatagattgatttgtttatataagtttgtactagagtattacctagtactttatctttatctatatatataccctactctgaatattgttccatcggctattttcataatattgtcctaagcttctttattaaacattatagacagtattatagccgatgaggcatgtttagggtcttttgttcctttatctattcaatccatagccgatttagtctaactacatcggctgagaccgccaacgatatgctatcggttgactaactctgcttttatctttcttgctgattgcagg

SEQ ID NO: 8883 - DNA, 1501 bp, Oryza sativa
gatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccttatgtgtgtggcgcacccggtctagatcttgttgcttggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagttagtggtttaattcttaaaatttacttaacaactaaaatgtggaaaggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaactgctccatgatcccaacttagttcccaaacagtagatttatcaagaaccgaacttcctataccgatctaatacgatattataggcaaaattacccatctaacctttcaaccaatcaataagctaatacctgacccactttttttaagtacctttttataggtaccttgtattgtagaaggttggaattggatcaacggtcatcttcatttccaagcacaccggagaaacacttgtacaaccaatggatcttaatttgcttgcgatgcagagaatgcatcacacacattggaggttataaattcctgatcagcagtgagaggtttcactgaattaattcagcaaagcttcgcagcagcttagccaggataggatgtcgtcgtcgtcgtcaccgcaggacgggcaggcgagggcgcccgccggcgacgccgaggactggaacgcatggttcaaggaga

SEQ ID NO: 8884 - DNA, 1501 bp, Oryza sativa
tcgaaaattacttgtgaatttttgggcgtgacaatcaattccttaatgggccaattaaaaaaatagcatatatatgacttttagcaaataaattttacattctcaagggaaaaaacaacttccaaatatttacactcaataaagatagaaattacagtcaaagttacaatgtaaattcaactaaaacaagttgtaaataatattttaaataatgtatagcactttaaatattacattaaaattaaaccatagtaaattaaacaatagaaattatgtaatcacaaaaaaataataacttacaattatattgataaaaaaatacataccatttacactgtaaatttagtaattacacaatgtaagtttagtatttgcacactgtaagtttagtatttactccctctgtcccttaatataagagattttgacatttcatttgcaccgtttaaccactcgtcttattcaaaaaatttgtacaagtataaaaaatggaaagttgtgattaaagtactttggaataaagtaagtcacaaataaaactaataataattccaaaattttttgaataagacgaataatcaaacagtgcaagcaaaatatcaaaatcccttatattatgggacagagggaatacatccgttttcgctgcattgagcagagtactacatcatgtcaggctcagaataaaatcaaactcctacatgacaggacgggaaccaaacacccgatctgaccctaaatcacagcctcagcacagatatggaatccaacggatgaaaattcgacaaattttgactgagaaatctgtcgacagatgcgtaataaattcgattttatctaatacaaccctctatattttaagaaaataatcaatgtatttaagcatagaattacattttagcttgcacaacgaaagagttagcaactagctagttttgattaacggacgtatgcaatgcaaccatgagaaataaaaatgtactttcaaaacaaatatttgtttaattaataagaaaagaaataataacaatatcgcacaagattcggtagactacaatctagcagatccatacaatctgcacaagaaatttcttatagtttgtaactatgtaaacatgctaaaaaaattatctaaaaaaaaacatgttagaaaaaatgttgggtgtaaactccatatagacatatccttcgtgaatacgccctagatcagagaaagttaaagttggcatgattgtctcttttttccaatcacaaacgaggttgccagatatgttcttttctcattcgtgttagttagccctcctgttgatcctcatgtcgccatggcagccttatgatgtacttgtatcaatatatcatccgttgatccgtacactgacagcattttatatttactggacagcaacacaatcaagaaaagttgcaattcttcagcctgaacagcctgatgaacgaaaatcccttccttgtccatgctgaattaacctaaagctacataaca

SEQ ID NO: 8885 - DNA, 222 bp, Oryza sativa
ccaacgccaccgcaacacctgtcccaccctccccgcctataaatccccggcgccggccgcgtcccccggacaacgccgcatcattgtgtccggctccggctcccgggacacgacacagcgcacgcccagagcgcgctactacttgctttcgagagggttgcgtgcggctttgcatgaggaggaggaggatgggggcactgcacgtcggcgagccgcgggtca

SEQ ID NO: 8886 - DNA, 393 bp, Oryza sativa
atttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 8887 - DNA, 1501 bp, Oryza sativa
catgtctagaaaaaaaacattggttttctaatgactacaagttaatagggcataaatagcaaacaacaggatagagcccccagctaaatttggagggggcccaatttgttacaataatcgataaccatgctttcgcaccgatgatttcattcgcaggccagcttggtgtcgaaactactcaagcagattgcaaaggcctggaaggccgaaagggggtaacgatagtccattgtgaacatatccttcgcaaccttaccaaattgtagtatgaccttgtcatgatcaggtggaggcggcggggcaggttgcgatggcgtcggggctccagcagcaggctgtgttgcagcaacaagctggaagttcttcacagacgcgacggttaccctgcccttgaagttgaggcaccagcactgcaactgctcgtgccatcttggggccttgttacggagaatcaatggcctctccttggactcatcactgtcacccaatgcctggcctccgaccatggggccacctactgagatgtcagaatatctgctactgctgaaacggatagagcggtccataatggatgacttggaaaaggagatgctgccaaatgactcatcaagagagcgtgcaagcacactgtctggctggcatgggacagtgccaccagcctcaagcgatgaggcagggattgagtgcatcacacagttcatccgcctaggaccccgagtccccaagacattcagttcatatgaaacttgagctatgctgtaggtgctggaagggttctttggcgacaccttcctggagtagaacctacggcttgttttccctgactgtgaaacattggctgtgttgcatggaggttgggtatcatatattacaaactttgttccgagaagatttgacctaaaagtccaacacagtaaatatatcagattataccattaaaacacttagacgatgtaccttctctaaacaaagttgccattattttgggttattacctcaattttccaatgtacatgttgcttgacctagatgtattgtcagcactcataaatattgtatattctgtacaggttgcacgggagtatcttttcgccgataaaaggaacttgccactttcaacgagcacagctacatgagatgtgttacaacatgtgaagtcagcaaatataacagaaactaaaaaagtatgctggtgggagggatatatgcagtaagaaattagctcacaacaggacgaaatagctgcaaaaggggggggggggtaacaaaggaggtggtatggtatgaatatccatatgcacaaatgattagcacgcgtgggaattgcaataattaagcaagatcagtatgcaataattaaactaataccaaacaagctgtacggtcatacataacttatatgcctcaataactcatacatactggctaacagtgcaaatcatacattaacttttggttgatatttatgcaaggagaaatactgtcatgtataatatattgt

SEQ ID NO: 8888 - DNA, 1501 bp, Oryza sativa
tcgaggccagctccgggaaggcccaaggggccatcccagccgcttcggcccgttggccattgggccagcgatcgccaatttggcccattagaggcccatgcacctcaattgcactgtatgcccatgtaaatgtcccttttataaggggaaccatgtaaattcccctgtaaaacctaaacccaaataggggggggggcctgtaatagggttataaatagatccctagggccatgtaaagggggatttttcgaagaaaaactctcaatttaatacatttttactgctttccaaccactgttgagtaaccacgtccttcgatgtatgcagttatcatttcgacaacagcttgcaccgaccgtggggacctccgagcgaaaccactgagggcgaatgccacccaagagggtcgtgaaggagaaggttgcgaagcgaaaggggagcgaagcaggagaggagatggccgccgaagagggagccgatccttcggcgcccatcatcgaagccgggggggcaccgtcggcttcggcacctgcaccgcaaccgccaccttcggctcctgccgcttcgtcggggctggtgccgaacacggtcgacacggcgaaggcagctgtggcagcaagggcgctccagaccagggcggagatcctttcgacaagccagctgctggtgccccaagctgcttcgtcacagtcggcaacggcttcgactgcgctcgccgctacgcaagtcaaccccaacctcgaaacacaagccgaagccgacatggaggccatgcgccaaaacatgacccgactccaagacatgcttcgccagatgcaagaatagcagcaggcgtaggaggtagcacggcaagctaaggtcgcttcggccccaatcctccagtattcagcaggctacattccaccctaagtctacccgtaagcatcaactcaggcctttccaccacaagccatacaagcgccagtgtacttcgttgggcagccttcggccgcaatgtacacccgacccctcatgtacaaccgcaggttcggccggtcgttgcccaagtacacctaggccaaatgtcacaagcaatggcgaaaggggcctcggctttgcaggcacagcttcaagctttccttcagcaactcaactaaccccacaacatctcaagtacaagcccttcggcccgaccggaggggaacacaagtcaaggtgcacccagttggcagacgtcgaaccagcctggtccgggggcttcgccttggagtcaagaccgcagttcgactccagcaacgctgctcaagcaccaaccattcaaccacaggcactgacactaggcttcgaaacaaatcaggcgccgaaccaggccgctatggcttggacccagccttcgttcgatccatccatggcggcaccccaggcatcgctgtttggggccggacagccgaacactgtggtgcaaccacacacgcaagccatgacttcgcccttcgccacgccatatccacagacaaacagg

SEQ ID NO: 8889 - DNA, 1501 bp, Oryza sativa
acctcctcaatttctctcaaattttctattctttttccctttcctttttctctcttctttctttctttttctttcctttctttcttttatttttcttcctctttctttctttttctcttcctcttctttctttctctctctctctcccggcttctccccacctctctctctcggctcacggcctacccgggcggcgacggcaaccggacgagggggggggcggcttaccggcggcggtggcgcaaggcggcgacgcacggcgtggcactcggcgcggcgcggcggcttcgaggcaacggcgcggcggtacgaaggcggcggcacgtggagaaggagggggaaatgaagggggatgggtgtggggtggagaagggggggccggggttttatagagcgcgggggaggggtggccggccctaatggcgacgcgacgggcggcgcgtggggctcgaggtggcgacgggcgagcggcgcgcggcaagtggcattggcgacgcgacgcgtgcggtggcacggggctcgggacgtgacggcgacggcgcgcggcgtgacagcggcgacgagacgcaacagcgacggcgcgcggtgacgcgcgaggggcgcaaggcagcgacggcgacgcgacgggcggcgcgcggcgcggcaggcggtagcggcaacgcgacgggcgggcggcgcggcgcggggctcggcgcggtttggcacggggctcggcgtgacggcgacaggcgatgcgacgatggtgcggcgtggcagcggcgcggggcgcgaggcggcgagcgcgcggcgcgaggcgacgggacggaggcgcggcgcggcagcgcgatgagacggcgcgcggcggcaggtggcgatggcgacggctaggggcgcgaggcgcgcgcggcaggggaggggacggggctagggaacctcatcgagcacctagtgcgcaatgaacagtgctagctcttatttaaccctaatttaacctattctctttataaatcttattctttaattcctaatttttccacaaatgaagtttacataatatttgtgttgtttcaaccaaaagattcactctagattaacattacccatattttatttttatataattttcttgaatttaatcagaattaattcttattccatcgcactaaaatttaattgttactaatatggtcgcgataatattttatttatttccaacctcacctaatctttattttaaattatatttcaattatttatttttcccgtttaattttaggctttattcctcattaattattctctattcgcgatctatgaactccgaaaccaaattccaatgaaataggtgaataaaatcggcatgatgcaatttatttaaaaagtttttgaaggcccatatttttagagttttgattttcgttggtcgaattttcagggtgttacaaacctacccccttaaataaatctcgtcccgagatttcttaccggttttcgaatagatgcgggtattccgtcttcaaga

SEQ ID NO: 8890 - DNA, 1501 bp, Oryza sativa
caagtttgaggatctgaacgatcaatttgcgagtttagggaccgggatgatacagcggtacaagttcagggaccggtgatggactttactccattatttttaagccatttagcacgctctcccttccctgaaattccctttaaacgatgcacttcatctttcagctttggacagttactctttttgtttgctggacaaaaaggaaacaagagagataaatgccaacagaacatacaaatccagttgattcgagtatgcaacctgtaatttcaaagataatcctacgaaggaagactttttatatagtcattggcacttgggaggtaccgagaaacaatgtggagaatacttgcaaaatagaaacatcaggcaaacaatctactgaatacaccagctgcaattctgaagaaaaacttacatttgtttcgattaacctgcacctcaacaggctgattcatcacggcttccttaatctgaagcccagctttgtcactgctaagaacccttgctgccagaatgagctttttacttccagtcttcgaagatggcatattgaaagagacgtcagatagggaggcctccccattcttaagcttcactcgaagaacacctcctaacaccgccccttttgaactacttactatgtgggcgtcaaactcacatgcagtccagttatcaggggcagcatcataaaacttatcatgaagaaccaaaatttcaattcttaatccactaagactctcgcgtcgtcctcccctggggcggcacgggaggcgacgacccggccgcccctctccctcccctccttcccctccgcctcgccgccgctcgagcggccgccggcaaagccggccggccgcaaggacggcggcggcggggcccctcgccgacctttcaccgggcgggcaggggagccgccaggcgggacggcggtgaccgccagatccaggccgctccggccggatctggcggggcggcgactggcggcggggaggacggcggccacggcggcggggatggcgacggcgaaggcaggggcgcgcggcgccgggcggcggcggggatggcgatggtagcggggaaggaaccggccgcgggcacgaagatggtggtggtggtcccgtgtgagcttgtggtggcgacggcgcggtgctcctcggcggcggcggcggcggtgtcccccagatccgcgcctctcggccggatctggagggtggccggcggcagttggcggcggctgtgcggcgacgacggcggcggtgcggcggcggtgcggcgacggcagcagcggcagttggcgacggcgacggcggtcgcggtagttggcagctgcggtgtcggctggcgatggcggcagtggcacacatggcatcgggcggcagccagccgtatgctggtgaagggtgacggcacagcggcaggttgcggatgcgggggctggagtcggtggcagcggcgacggcggctgtttgtggaggcggtggtgacatcagcggcgagg

SEQ ID NO: 8891 - DNA, 1113 bp, Oryza sativa
ctccgcgcgcaagccgccaaggacggaggcagcgccccctccctctgccgcgtcgccccgctcccctcctcctttttcccgaaccggcaaaggggcaagccccctttctcccctcctttttcccctttacctctccgccggcgtcatcctccctgtcgccaatttggccgctagccgagcgccagctcgcgctcttgaccgcgcaagtcggttccccaaaccgacattgccgcctccttaaacccccggcctccccttctccttccctccccattttcgcctcctccactgccgtctctgttttcgccgtcgccgatcgtcgccgcgcgtgtcggaggagccggcacgagcaaggacgccgaagaggactccggccgcgcctcttcttcctcttccccggcccgaggccggagagatcactcccgcgccgtcggcctctcgtcacagcgcctctcctttccgcggtgatgtttcgcttcgttctccctcctcgctccgtctcccccccttagacttcggttttagctcgagtagacctcccgtagttggccggcgccgccccgaccgatgccgttgctcgccatgtgctcgccgccgtcgccgcccagttccgtagcacccgcacgtcgccagcctccctcggcgtgttccctccaaatccgacgctagcatcgagttcccgtggccgcatagatgctcccaccgccgggaatcggcccctcgtgacctcgtcgccgtttccctctcctcccgccgccggttgtcgccgccgcgattcgccgccgtcaagctccctccggtgaatccgagccgttggctcgcctccccgcgtcccgtgcaaccacccggtgtactcgctgtcgcttgtgtcgccgtggctcgctccgccgatcgccgccgccgcccgccgtccgtttcggccgggccttcgtctaccttccgccgacccgcgtggctgccacgtaggcgccacgtcggcgccacctcggccgcgaccagataagccgacccgaccagccgctccctccgtttctccccgtgcgcgtggtccgcggtaagccgtgaggctgcacgtgggcccgccgcctccgccctcaccgcgagccgcgcgca

SEQ ID NO: 8892 - DNA, 1501 bp, Oryza sativa
aactttttcattggcttgcgttgctgcatgactaatcttcttctacagaagcgagatatagacagccacttagcttgccctttttacgcccagaaactaagaaacggtgaatcacattcttctcgactgcgtgtttacccgcctacagatctggcaccatgtcctttccccctctggctgaccaaaccttgccccctccaacggctgctctcttcaagtttggtgcccttcgtctatggtttgtttgccggagcatcatcttcataaaggttacgactccctggttttactggtttcctaacagttgtggaaggagtaatactctggggttttcgacttctctcttttttcggtcttagtgattttggattcgtcctgtaagagagccgtctgtggtcggcagcgggcgccgccacgtttggggatctgttggagtctagtggagtacaccacaaacctccctttgtttaggagcagccttttcttagttgtaaaagtttctttcctttttttcggttttccttttttttttctccattgtctcctagtaagggccattctgccggttatgtcatgtaattgaaactttaatttcttgctgtgcaatccttttgcgcgttcgcgaaaacaataaatcatgtgttcacacatgtcacgccccgagctagtcccgaccggaactaacccgtgacgctccaaactaacctgttaatcgataccagtcccaggaaacagtgctggtatcacagggagacagaatatcacagcaacagaagtctctttattatagagtagaagtacagtcatgttgggctgcggacagatcccgagctcacaactgcattacaaaaggaaagcggaagccaggacttggaccaaacaatcacaggcgcgacttgggaactaggccgaaaccctaaaactcatcgtagccggcttgctcctggaagaactcctcatcagcaggatctgcttcatcttcttcagcaactggggggggggatatttatatagagcaagggtgagtacgggggtactcagcaagccatgggaattaagtgtttaatgcaagcttcaaggaaaggctgtctgtttttgcgattggttttatttgaactcttttctaaaagcaactaagtgagtgcttctcaaacgacacggatgaggcagtgcgtctcgtccggtcggagtatgtgcaatgtatcagtctttagattttgaaacaaggttggcacccggccaaaagctttttaaacggccacccgggccaacacctttcaaacggccacccgggccaacaacttttaaacggccacccgggcctagctgatcccatcagctgcaggttttccaaacatcgaacccagtttctcaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 8893 - DNA, 1501 bp, Oryza sativa
attggccttgttaattcccgtcaactatttgggtctctaatgaatttggcctacctactgtccaatcaacgaaattgggcaactacggccacgaaagaatttaggaaaaagtacaccaaagatccctcaacttgttagccagatataaaatcgtcccccaaccataaaaccggacatctaacgtcccctaacttacaaaaccggtcacaatagatctcttggcgttttttgacctcggttttgtcccacatggcggctgactcaacgttgatctatgtgggccccacatgtcagatagaccacgtcaccaccaaggttgttaggatcgggatactaggcagtatcgttttgctcaaagtaatatcgtatcgtagaatcgtatcttagtatcgggatactatgagattttctttttttaagtttaattaatatttatattaattatatatagccattatctactactacttaaaaaataagaggtgcttctatcgtccgtcaaaaaaaccgagcgaaaaaaccaggtttgtccgataaaaaaactgggcaaaaaaaagtgcgaaaaaaagaaaagaaaaaccaaaactgtccaatccagaaaaaaaaagggcgaaaaagaaccgggccaaaaaaccaaagttgtccgatccaaaaggaatcgggcgaacaaaaacaaaccggacgaaaaaatgtgcgaaaaaaagaaaaatcaaaaaaaattccgattcctatggcaaggcggaaaaaaaatgtccgattcttatgaaaaaaagtggcgaaaaaaacacagtagatccgattcccttaaaagttggaaaaaaatcatattcctatattatcctatttcccgtacgggtgtttttttttcttcttttttttccgtttcttttccctttttttctttctttttctttcttttttttatttcttaatactatgtatgtatataaaatttatatacacgtatacaaactttatatattgtatattttttcttttttatacgtatgtatatgagctatgtatacttctctatctctactattaaaaaatttaaaacatttccttcgtccgtccctacttaaaaaattcatattaaaaaaggtctgtccgatttataagaaagtgggaaaaaaaggttcgtaaaaaataaaaaaacaaaggagaaaaaaagtacaaagggcgaaaaaaagcacggcaaaaaaaaagtccgatttctattcgtttttagtccctatatatctcttctctatctctaatctaatctaatctaactatttaaaaagaaaagttttcatagaacaactaaaaagaaaaaatgcgcgagaaaataaaaacggttaaaaaaagcatgagaaaaaaaaagcaaaaaaacgcgtgagaataaaagtcagaacagaaaagctaaaaaaggtttctgccgtctgtaaaaaataaaaaaacatgcgaggaaaaaactgttagaaaaagcacgccatttctaaaaaaatggtttgaaaaa

SEQ ID NO: 8894 - DNA, 1501 bp, Oryza sativa
aattagtatcaaaagattcgtcaaacggtttccaggcgagttctgaaattagttttttcatccgtatccgaaaaccccttccgacatccggtcaaacgttcgatgtgacacccaaaaatttctttttccccaactaaacacacgcacaatggatctcctgagaaattaacacactgacagataacatggcaaaatctgcaagacaatttcccagccatgctcagttgttctaatatttccccatgtatatcaaaagtttggctgtcctgttaaaaaaggacttgttattattcccgagggagatgtaatcatagctcatcatgcattgtgtttcttgactttttattctataaataaattttcatgagtctaatggtgtgtttggttaggtaaatgggactagatgggagatggctatccattttattggggtgtttagttagagggcaggtagtagcggattaggaagatatagcgggagagtctaaacaaactagataaagttatagcctttctttccatctacatatagctaaaaaatttagtgggggttcccatagtattcgagccagtagtgggggctcgagacccgttaaccccatgctagatccaccctaagaacagtgtggatggggcggtctagaaaaggaaatatttactcaacatactggatgaagggatccggttttttgggcggatgaagccatccaccttctttaggatgttgattagtacatgattagtgagttgattagaatatgattaatgatattagcatgttttgctattaattagtaattaaaatggtaagattagttgttgacaagtgctattaattagtaactagaatgctattattatgtttaggtatgtatgttatatggagcatcataattatatgtattttttaactactttaaaagcataaccatactcttccttcttaaaaaaacgctcactctcattttaaatgaaccgcttaaagaaaatctcccaaaatccaacccatggtgcaacgcacgggtaacctccctccaattttttttatgaactaagggtgtccttcatatggtaataggagatattatattttctagtgtaaaatttggtatcttcagttattagttatctcgaagtaccaaaatttttagtctaaaatcttagtacctttagctaatttctcaagaattataaaatttttcatgaactaaatagtgttatatattaaataaacctaatattaaattttacactcattcgtaaatttgtagtactagaatagaatgcggaagtttgtttaactcactcgccggtgcgatgacacacagccacagagatggaaacctgtagcgcataacgagggcctctccaaacatttacatacgcgacgacctgacacgaaccaccgcgcaacggatcggcacccgttccacgcgtctacgcgggcaggaaaactcgccgattcccaactcccaagcgaaccaaaaccctacatatgtga

SEQ ID NO: 8895 - DNA, 1501 bp, Oryza sativa
ttctttctaagtttgggccgaaaagagacttgcgtctcgattcgactttaagagatatttttcaacagctcatttagtaatgtaccgacctcccgggtcagatcattacttctcggctcccagagccattccacttgattaatcggctcccagagcctttttcattttctcggactcccagagtccagctgcctagcagcacaacaatccgcttccactcgggaagcctagtctatgatgcccgcagacatcccgaatcacacagattcgtttcttgaccactcaggtcatccatctgccacataggctgattctggttacgattcccacaccacaacaacttttcacaaagcacaggcaaacaactctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcatttcccaagccgacccagggttacctcatgccacatagaaggatcaaatcctcacgtaagtataggccattttaggcattcacaaatcaactccaaccaccttgatcggtatgtgagcaagcttctcgtccttgccttaccaggaacccggtttgtccgaccccgccccggcgttcccaactattggcatgcgaggtttccctgaatcgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaaacaagttaagtgtgtgattctagtaatgcaagttgcaaacaaaataataatgactttttaattataggggcaattgatcaaagggtgacttgccttgttcaaggtcttcacgaagcttcatgaatcttcgagaaaacccgcgatcgacgaaaatccgataaccgcaactatatgcaaataatcgaaaacctaaacaaaagaccaaaagaaagatcctatttagacctattagtagtgccattaaatagatctcaattttacggaattactggaagctgaacggagtcaatcggagctacggatcgagggatatgaattttggaggtctaaatggattttctggacaaggaaaaggaattattaattcccttggaaaagaaaaggaaggaggga

SEQ ID NO: 8896 - DNA, 1501 bp, Oryza sativa
ttctatctattaattacgtaggatttagtaaatttcctttatctttagaaagttttatctagtatccgattagtacttgtatattttcttttgtatttaggaaacatgcgtcgtgtccaatatggactagtatctacccatgagtataaatatgtatatacagggtcattgtgatctatcctcgatcaatataactactcccggcgtatcgccaccctcttttccaatgtatttatttattatcactgacggaacttagcacctgacgcgggctgcattgacttcgatctccggcgaaggggtaagccctatgttccgttggccctggtgaatatatcggctacattggtgttgttcaaggctacatcgcttcgatctcttagatcgttctagttcggtcgatatatttgcctacctgatgtttcgattctattttaatagcattgtgtttagagacacatcggtttagttgggactgtctcgattaggtctgattttatgtcttagcctatatatctctacaatcacaatgttgttttaaatagatttgttagatccatcatattagacaaatttatcggctcattgagtattagattattatatgcaatctcgtgttgcatcgattaggttctacctactaaattgttgttaataatcaaagtcttgtcaagctgatatgttcatgctaatgtttcattggagggttagccgcttatataatatgttaaatttattgttgatggttttattgtcttagttaaatttaagacatgaccactctgaaaaacaatgaaaggcttggttgtttagatcttatactttcttttatacttagtactgcattagtcgtacttggaattgtaagaactaacttgctctttggttgacgataaaggtagcatcagggttttcagccgatgagttgtctcaatattgcactggcttataaggattatatacaagttgattttagccgattggatcattacttcattatatcatcatcgactcttggattatttgttcaagttctttcattgcttatctaagcatcggaatatacattgaacatatagccgattatttaaagccttatcgacatcggctaagtaccattacatcggcttgtcaaccaatcggttatttgatcataactatatatatattgttgttacataatcaaattgactagcacatctgcatgtaatcaaagtttaggatatgcactagagttaagcatttctttcattcattcgttttttttcacatcaataagttgtaaatttgttaagtagttaagattttcattgctcgagagtgaacggtctttacttgggcctcgccggtgcgatgccacagagacggaaacttagccgcgtcatgacgacccgacacgaaccaccgaatccaacggatcgacacccgttccacgcgtctactcagccaggaaaactccccgatccccatcccaagcggaaccaaaccgttcatggcgatg

SEQ ID NO: 8897 - DNA, 536 bp, Oryza sativa; identical to SEQ ID NO: 3027

SEQ ID NO: 8898 - DNA, 1501 bp, Oryza sativa
ttgataattaatcaattcattgttgttgtggtaaaaaagagaaactaaacaggtttcttttaggagcaacaattctttaggagggcatatatactatgaaaaaatgaagaaaaagatggttgtttttcatgtctattttcgaaaaatatccaaccacctattttctaaatgtatcgattcacatgtcgaaaaagagaagcattgggccagatatgggtaacatattatggtccaatacaagaatgaatcaatacatagattgtcggcatttttctcgacttttctatgctcccgcaattcgtggaaatcttgtaatattttgggtccatcattttgatcggcccaaaaaaaaaaagaggccttttacggtgcttggaaggtacctcatgtacttcctaagatacttaatatccaccgttgatgctccaaagggcattttagggatagaaaataacttaagaatcactaatattctaactaaccctcctgattttctgtcatctaattaactttctcacatagccattagccgcttaagactaactaattttctatatctcgctgttattggcatcgttgcagcaatctacacatgcttttactactgatttgaaaccattttttttaatcgagatgaacgaatggaaaggaatatatagatctttcttttcctgcattctttcataatcaagatgaacgaagggaaatgagtacataatttataattattgatcaactacctagttgtttttgaaagaaactgcaagcattattcttctgtcaacaaaatataactgtcatctgagtttatgggatagagatactaactattcaaagagaacacagcgagaaagagggagatgtcaacgatactacatccatcaaagaataaccgttcatttataaaataatagatgcaaaattacatatctaatacggatatctgacattccaagcagcgatctagccaggccaacctgtaattctgctaactattgactcgaatataagcgcgcataatggcccatcacaatccaactaatatgacgtcttggtttttatggccatatttggcggagttcgtatattcaaattaagctgctttagattataatctgaagctgggccaaatatggccttcctcctactaacctagtttatcggtcgcattgttaaaacggctttatatttcattcaacatcggtgtctgaaaatcatttcgtacatgagaaactaaatttgcacaattttcattatcaacagttacttcgctaaatggtagagcatttctaaatgcctgttgaaaattatatatccattaggatacgaattatacatggacatatctgccttgaatttgattgcaatcctcagttttcctaaactgtaatcacttagctagccacaattacttttatatcctcactaagtacacatttgttgcatgcattggcatgatgcatgcttttaaggagccacaagcccacaaatcccactaatt

SEQ ID NO: 8899 - DNA, 1501 bp, Oryza sativa
cacagagacaacctccccaaagagaacaaatggcgtttgccacctgcaaacttacctagccgaaaaccaaatcaacctagagctggcaccctagctcaacaacaaccaattcctcatgcagacttgctaacaccaaagactcaacgccggagggccaatatgccacgctcaaactgacttgaatttgtggcgatcgaaggctgtggaattcgaagaccaccgacatcaagccatcaagaatctaactttgtcttgttgctatttggatcagtgcctgccgacgtcctttgggggaaagaagccccaaaggagagaagaacacccacatctgcaatctttggttctccacttccactttaggttgaaatttttttccgcttctgaactgagatatccctttgtttttagttagcatactttccgacgttaaacggtatattttatttgaaaattttgtatatatgtggctccgttcgtttccacttaaaaactggattaagttttggatattcgtggcacgctttttaaactgttaaacggtgtgtttcgtgcgaaaactttctatatgaaagttgttctaaaatatcagattaattcatttttcaagtttgcaataattaaaatttaatttatcacacgttattaccaccttattttacgtaaattatttaatcttcatcttcttcagaagatacaaacaccacctaccacctagtcatgtgcgacttgtttgttttatataccggtgataaatctgaatcgaacggggccttaagacttgtggtgttcgtactcgtactaatggctggattaagctagaggggattccccaacctaacaccaaactttgcgatgcaattctgggcttaataaggcctgcataatatagttcggtcctgtacgttccagttgaagcccaagtataagcctgatagtagcagtcctaattaagctgtaaaggaattccggatgtaaacaatctagtctagtctcgcacaagccatgaagcaaccaacccaaaggaatggcccatgaagcacaagtcttctctgaataagttcactctaggtccctcaagtcgcaagtctgattttcatcctcagtccggaaaaccagatgcaaggatccgccacttacaaaaccatgcaaacgagtaccctgcgcagtattaaccccggtatggctgacatggcacttacatggatcctttgactaggtcttcgtcctacgtggcaattagatccgaaaaataataaaacatgtggggcccacatgttaggtacacacaaaactaataaaaaagggtgggcccatgtgacatggcccccatatgtcatcctcactactcccctcctctatcctctctcttccctacaagaaggcgggagtgggcggagcgaggtgggtggctggcggagcggcgacgaccgctccactcctctctcccttccctattttggcatgtgggtggcggagggcatggagcgcggagtggcggcgg

SEQ ID NO: 8900 - DNA, 1501 bp, Oryza sativa
ggcatttggagaagatactgccatcgtccaatgacacatcaatgacgaccactaatccttcgttcagcacattacaatagcgcaggaatgtgcatttcctagccggtaccaggggcgatgggaacatcatctcgacagtcatctgttgttctcaagaactgttagtaccaactaaaaagcacatgaatatatatcaccaaaaggtaagtactgctgattttgcctgcactctatttccccataagatatactactagtctatacataccagttgtataaccccattataaccatcactggtaggccacgtgtagatcctgttggttactgccccggaaataacttcaggaaagaaagttcggtagttgtactgcagtaaaaatttaacattgagatcaaattgcaacttgaaatattatctaaaaagaattgatacgggcattcatattcacatctttttagcaaggcactattaaaatctatataccacttacaggatccatgaggaaatccacaacgcttttgtagtccatcatcaccatagaaactgcacgagtagcctctgtcttgaatccaatggcgtttgcactgttatccccaggatatgcttggtcataagccatcttgttcaatacttcataagaacagccagggacgggaaaccatagagcgacatgggattcggccaaaataatcaatgcgtgcattgcgtttttggctagttcagcaatcatttgttggtcatgttgccctgaaaatacatagtctgctgatgaattaagttgaaaggcaaggtttgcagccgggggtgttccattcgaccgtgcaatctgacaaacaaacaacacagcattagttcaattctagatacagtctctataggactctggagcttgggaaataaattccagacaaactatttaggaggtaaccacaatctatagttagatagggtgcagattggtaatcacaaggtagatcagattgtgcaaataaatgaatcatattgagaacatagtttaacatgtatggttgcagctcgaacaaatccattcaagatactgaattgaaaattcaacatgccaagtaattgtaatttaataggagaacatatcagaagatgatgtacctcttgttgcagccactcactctgccccattaacctttccatctcaacggcaagctggttctgtactgatgaattacagcaagtgaggcatacagcagtgcagtgagctatcttaactctcctgttctcatccctcagaatttcattctccaccgacaacttatagttctcttccttccagcacatagtctacattgtgtcatggaatttttttttaatcattccactaaacttttttgttcatcagtacatagcaatgttttagaacaaacctttacttgtgttcttttattctgaaaccaaaacttcacttgatctaaaccaagacctgttgtctcactcagatgcctcttttgtccatcatcgggatgc

SEQ ID NO: 8901 - DNA, 1501 bp, Oryza sativa
cagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaattttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtcggttacgggccaactggggtagatctgtcagattttattgtatcagaaaggggaattgatagaccggctgagaggagtgtaccctctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtggagtggccgacgagggggagactgtcggtgctattgtggatgaaatggagagggaggattctgacaacgagcgtgtagaggaaggtgattcgtcagatgatgagacggatattaatccagcagaatgggctagtgaggatttttctgggctaatcgtctctgaagaggatagtgtgagatgggagtacaaagaaaatgaggttattcagggagcgatttatagtagagcagaagatatgaaggaggcggtaaaacattttgcagtgtcacttcatagagagtttagggttgccaagtcgaaccggtcgcaatatgaagttcggtgtgttaaggaaaaagatggttgtccctggagagtgcacacgtataaggggaaatggaaggattattggacagtgtcagtcgttaccaagcatacatgttttctacctggtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacattactattttttgaattgttctaacacgaaacactatatttttcagagatggcacgtcagg

SEQ ID NO: 8902 - DNA, 1501 bp, Oryza sativa
ggaacagattccatgacagtggcaatagaagacgatttccttcggacaatagcatataaagatagatatttatccttgaaagccaagttgcctagccatttatttttccaaaatctaatttgtttcccatcattgacaatccaagaacccgtatttaagaaagtacttttgactttcataagtccagaccaattcttgtttcttgtcaacttgggttatagacttattataaagatactttctctttattaagtcttgccaacccccttcctcattaattaacttaaacaaccatttacttaaaaaatatttattctgaatttccaaattatgtatccaaagaccccccctcccccttggtgctcgggttggcaaataatatcccacctagtgagcctgtacttttcttatgattatccccttgccaaaagaaccgcgatctataataatcaactttttgaagaaccccttttggtatgtaaaaaaagataccataaacatggctaaactcaaaaatacagaattaatcaaaaccaatctaccaccaactgacagatgattgcctttcgaactactaagctttttctcaattctttcttcagaaactttccactcttcatttgaaagcttcctaaaatgtattggagttcctatatatttaacaggaaaagaacttaacttacaaccaaagatattagaatattgattttaacactcctttgcctgaccaaaacaaaataattcactcttgtgaaaatttatttttaagccagacaacttttcaaatacagataaaatcaatttcatattctttgcctgttgcaagtcatgctccaaaaagatgatggtaccatctgcatattgcaagacagacaaaccatcatcaacaagttgaggaattaccccattcaaaagtcccgcctctttagccctcttaattaataaagcaaacatatcagctactatattaaaaaaaattggagataaaagatccccttgcctatgacttttgtaaatttgaaaattgttaccaatttgatcattaacttttataccaacatgaccacattgaataaaagaagctatccactcacaccatttaggagaaaagcctttcattctcaacgtttgttgtccaaaagaccatttaactttatcataagcttttttaaaattaatcttaatgagctgaaataatttgaggaagtaaaattttatatatatactccactttaaatgaactaaagtgcgccaattattgaatgaactaaagcgagtcaattattacccgtgcatatgggtcatcccactaccatccctattccctaatctgaaatttgaatgagaggttgtaaaatctcattttcataccaccagtttgaactttcggcagtatatgaccccatggggggtctatatattcctaggccgatcgtagaggtcgccccgtcgactcgcgggaggctggactacgtaaccatacgtgatacacctcctgtac

SEQ ID NO: 8903 - DNA, 1501 bp, Oryza sativa
tggatttaatttatattaaattctccatgattaattatactctctgaaattttctcggaattttcggagctcaattcctaatgttaataatacaaagaacagtttagcaattatttaaataataaattaatcagtaaatgatctggatattattatattaaatactttgagtgtccatgtatattcaagatttttcttggaattgtttgagcattgaaagtatttttaacaattgaaagatcatctcattggttaatttatttggaaaagtaataaaagtcctcctcctcagcttgggccgaatccagcccattgcctccccttctctctcccttcctctcagcccgcatagaagtctgcttttcgtccctgtcgctacagtgctccttcttctacctccagacagagcccgagctctccagcccgtgcacagtgccgccgcctcctcccaccaatccggccacatcgttgctcctttctccaaattagttgtgggaatggaatcctctcaatctcctcttccttttccccaagaaatccccaaaagtttatatggaaatccttttcaatttcgcggctcaacctttcctttttccggcgaagatctaaactttcccgagtttttcctgtcgttgtgggctcgatcccggccttccatggctataaataggaccccctagtcctcctctttcgtttgcccctctcccgtggtctcccgtgccccgtagcctctccgccgccgcctccgtcgtcgccgccggtcgccgtcaccaccgttaggtgcgcgggagggtggagaagctcggccgctccctccccgctgtcgccggtcaccggagccccgtcgccgccgtcgaccgaagccgcgccgccgctagacctcgtcgccggccgtcgtcgttcgtcgtttggttcgagggtgagtaccgttgggttcgtctcatcgtcctctacgtgttcatgtcctccaaagtcgcagccgaccatccaatctccggcgaggtcgccatcttggtccggccattgatgaggtcatcatgacgtcatcatcatttttctttttcctgtttttctaatagattaaatcttcggaaattcataactaaatcatcgtaactcggttttgagtggttcaagttgctaaattcatctaaaatcatgatctacatgttaaaaatatccacatgtactgtttatgcttgtttttgtactgtttatttggtttctattagtctttttcttcgttttgcgtgttagcttgtcgtttccgtcgttgcgaaggttcgtgagtgcgttgggagtgttcagaagattaattgaagaccgattattgcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattccttgataccttg

SEQ ID NO: 8904 - DNA, 1386 bp, Oryza sativa
ctcatagcctagcaggaacacgattggatgatcaaatataactatgaaagcatcaatttttttggaatatgatttttgatgattgtttccatgatttaattaatattacgaattatgtactcgaagccaacctctctacaaataatttgtttagctagactacactgggcaataattaagtacaatgagattatataatcatacatataatgcttataatgcctatccacttgccataattatcattgttttcatgctatattagttagaaaccatagtttatgataatcttttaaaataaatggctaattttatcaggttatgtcattcgattatttataactaatttgcagttaaagaaccatattaacacaactaaattaaattgtttgtatttttacatatgtagattcaaattagtgttgtatatttgctaagtaatatttgaaactataaaatatgatttgaatttttaaatgttgttatggaatttataattacatgtcaaatgtcatctgccacattgtagcttgcactaaaatatagccaacataattcatcaaagtaaaatcacaccaaaataagtgataattacataatttgttttagtcaaacgaatgatgaaaacatagatcaaaagtcaatagtgtaaaaactggaggtaatataaatattttgtggcaaaaagagcagggccggctctacatattttagggccctaggccaactccatgacatgggcccttaggcatacactctctctatatatacacatatgcactttgaatttttaaagtatacttttaaagcattcatccgctaatcacgctgaaaataaatattgataatatcctctatatatgttgctaaaaataccaaaagagcattaaaatggaattactacggttaccttgaaatcttgactaaggatcaagctccagggacttcattaataatacttgacaaaagataagatgacagacatccatttgcttctcataaaaaaatactccttcggacatttcttgatgcaaaatcattaatgatggtatcaagatcaatattgtccaagacatttttctcaatgcaacacatagccaagccatttaatctttcttgtaacatggttgatctcaaatagtttttcaataactttaattttgagaagcttctttcagctgaggctactatcacaggcacagttaaaaggataaatgctttttaggtaacattgcaaacctaaacgtatagatgaaactgatctttaattagtatttactagttactactgactgattaatactttgctagttcaattcaatggagtatggacaatatggttgcagcacagcagtacgcaagtacctgtaaattgaaacctgcaga

SEQ ID NO: 8905 - DNA, 1501 bp, Oryza sativa
cactttaagagttcttagatttgtgtttcaccgggtttcggcggtctaaccggcaactcaccggtggtcagaccggcggcattgcggcggtcagaccggcgggagcgaggcggtcagaccggcggcggcgacaggtgcggcaagcgacttcggcggtcagaccggagattcaacaccggtcagaccggcggcatccacttggtcagaccggcagatcaatctcggtcagaccgacttccgtcaatttcgagggtaacttttatttccgctaaaagttttcgatttttgggtataccatccattcaccccccccccctctggttggcttagttcttgtggttcgatcctacaagtggtatcagagccttgttttcttctttggatttttattgatctagagtttttgccatggctagtccctctaggttttcaactaagcctcatgttttcgatggaacggatttttctcattggtgtagtaggatgcaatcttacattatggctgaagattatgatatttggagaaaagtttctcatgcttatgtgattcctgaagctattaatactgctgctgaaaaaactgcttttgaacaaaattgcaaagctcgcaacattcttttgagcggtatttctcgttcggattatgatcgtgttgctcatcttcaaactgctcatgagatttgggttgctttgagtaattttcatcaaggaacaaataacattaaagagcttcgtcgagatctttttaaaaaggagtacattaaatttgagatgaaacctggagaagcttttgatgactatctttataggtttaataaaattttgagtgatcttagatctgttgattcttcttatgatgctaattatccacaatctgagatttctcgtcactttttgaatggtctcgacatatctatttgggagatgaaagttacatctattcaggagtctgttaacatgtctactttaactttggattcactttatacaaaattgaaaacacatgagatgaatgttctttctcgaaaagttgattctaagtcgaatgctttgatttcttcttcttcctctttggatgttgatgcttcttcatctaagtcgtcttttcttgctgtttttaatgccacatccgatgatcaactcgaacaaatcgaggaggaggatttggctttagttgctaacagaattgctcgagctatgaataatgccaggaacaggaaaagaggtggtccaaatcgttgctttgagtgtggttcaattgatcatcttcgttcgcattgtcctaagcttgggagaggcaaaagagaagacaaagatggtgagaagaccaacaacaataagtccaacaacaacaagtcaaagggttcataccaagggaggaagatggagaatcttaggaaggcttttcaacaagtttgcgccgccttcgagccactaagtgatgtagatggtgaaagtggagatgatgataagggaaataacgtctccgatgtttgcttca

SEQ ID NO: 8906 - DNA, 1501 bp, Oryza sativa
aaaattgcatgcttgattttttttatagataatacatagtatattttgtaaaacgaaaaaaaattatgtactaacaagtgtatacgatagcaattgcttaagttttatgtgcacatattgaaataatgggaagtacatctgtaatgttgtttattcatgttggctttctcttttctagtatatagatgtatacaaattaagggcaaaaaggatattttctaatagaaatattgactagaaatagccatatggcatattaagtggacctaaggatgatttcaagccaaaacaaatatttgaaggacctatgtggacaaaatgaaacatgaaggaccaaattgagccttcgctaaaacttgagggactaaattagctattcacccaagaaaaaaaagaggaaaaatgtaaaattctagaacagagttgttacgtggcacaaagaaacatgagcaaaacactagctagattgtcaatgatttagtgtagcatgaatgagaaaggaaaaaagaggaggaaaagagaaacaggtcgatcattcctaacatgtacatatacattatacaatagtaaactttttttatgaaggggaaattttttcttcatctcagaaaatttactgtaagaccacttctgacctcttcatagctaggatgcgaacatcctataattattaaggccctgtatattccctggtacaattttacaccctatcatatcgaatgtttggacgcatatatagagtattaaatatagacgaaaaaaagctaattacacagattgcgtgtaaattgcgatacaaatcttttaacctaattgcgccataatttgacaatgtagtgctaaagtaatgtcacgtcctgataaattcatgctgaaataaaaatcattctctaaaaggaataatagaattaattaaaattcgaaaagaaattgacaaacactaaaatacgtacaagaaaaattcgaatgtggcccagagaatttttgttaaattctccttggtctaaaaggagctctcaaactttacttgaattttcatagcaatggaattatttattaagcaacaacaacaattcagaaagtttattaaaaagaaaactaaaaataatcctcctccctcttttgggccgagtccagcccaaagtccttctctcgtccctctcttttccctttttctcccgggctgcccctcccctcggcccagctccctcctcttctcctcctgggccgcctcggcttcgcacggcccaagccgagccgagcggtgccctcctgccgtgccgcgcacgtgcgcgcgcgctgatcgcgcgcccgaccggtgggtcccacccacccagtcgtctccttcctcccgttcggcatcctctctctcttctctcccgtgaaaacctagtcattccctctctcaaatccgcgcgattcaaaccttggattccaaaatttattgggggaaattaatcccctttccctcctctctctttccccttgattcccccttgat

SEQ ID NO: 8907 - DNA, 1025 bp, Oryza sativa
gtttaagtgttggtgaagaagacgagggcgcaccgggaatatatatacccctggatctttactcccggttgttctcaacaaccgggactatatcacttccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattctaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgtcacctgtgtgatttaaaacttttaaaaattgtaagtatcacatataactagcatatacatgatttaaacttgttgaaacctctaataatcgtgcgtaattaacatatgccata

SEQ ID NO: 8908 - DNA, 223 bp, Oryza sativa
  unsure (1)..(223): unsure at all n locations
gttttttaatagaaaacgccgttgactttttttcatatggttaaccatttgttttattcaaaaattttatgtaaatgtataagatataaattgcacttaggtacatgcatgatcaacatggtataacatgtttgaccatgtttgacatatttaatctttagtcctggttcaaatgcnantagggcctgtggccccccccccccccccccccgtgatctttagt

SEQ ID NO: 8909 - DNA, 890 bp, Oryza sativa
atggttattattttagctaatgaaattaacttctagccttttcttctaattagagatgcatacatccattacacaaaaaatgttaaaaacgaaagtggcaaaaagaaaaatacatgaaaagttggcctagaaataaaaccaccttctgttgccgaatcataaccacttacgagaacctattgagtacgacatacagacaacaatgagttggtgaagcaatagtcgtagcaacaccctctagaaaggatgcaactcgcatcaccgtcaccaaatccaaccaatcaatgatatatcaaaagggtttcaagttggattgcaagcaaagtttctccatgacaacgctttcgggaagaaaatatttcctaggtcattaccattcctagtttcctacattgaaccggttaaggtcagatgtactcgctttccaggagtacgcattagcataaatccattatcgttagcgcattgattgatctatctggatatctatatcaggtatagttggctgctacaaagtagtccatgcatgcctcactacttttttttttgaggggggcactactatagaaatgcacaaagatgacggcactataggtgccgcaagtgttaaaattggcatctatcgatcttttcccacctccacaggctgaaaatatatttaaccggcacctttatgcaactataggtgtcggttctaaataaaaccgatacagatactatatatgccttttttttaaaaaaaataaactttaatatattatagttatcggttaaaacatatcataggtaccggttttttaaaaaattgacacccataaaaattgagccggatctcccctttttaatgcaaagggagatggagcttatccactcgcccctctctctctagc

SEQ ID NO: 8910 - DNA, 1501 bp, Oryza sativa
atgtttctctaatttaacattgtcataccacgatttagaaatatttataagatgtttaatgggctttaacacctatttttgagattattttcaataaagttaattttagttttaagtgtgacagggataaaaaacataaaggaacagggagcctactaattgatcactctagcgtggtggactgtataggggacgtgggtggttttggttttctaagatagatctaacaataataggttcaccgatttaaataaaaatcgacggagatttatctattttattagggtgccacgtggcgatttgagagtatttatagggtgccatgtcacggtttgggagtgtttgtaggatatttaatggatttttaagtgtaagatagatagatagtactacatacatatggtttttctctttatcttatatggtagaaaattatattttatatttttctcccgattatactatgtactttattttactttatcacacatattttttcttccgacgaacggaacgtaagctttattgtttttttttctgaatcatcgtattttaccttttatacagggaatgtattatatacacacctaatgattcgtaataggtccaccaatttaaaagaaaatcaactatagatatagatataatctaatggtctaaaatgatgggtccaccaattaaatgaaaatcaatagtgccacgtggcgtcataggagtgtttatagagtaccacgtggtggtttgagagcgtttttaggaagtttaatggacttttagtatataatagatagatgcccgacatattagaattcctcagcaataggaaaatataaattataaaatatatcatgagtagtttgatgcatatgttatattaatgttgtttttaatgctatagtaatttgttattaaacctatttgccaaagaaaaaaatgtatatgataattgattaaggaataattgccaaggaataccaatcaaatagtaagagggcttgtagatgcgtcgtgactatatttgaattttattatttgaattttattgttatagtatagaaaatcctaatttaaaaaggccatctattttgttttcgatggttttagcaccgtacttatacttactttttagggttttatagttcttttttatcgtgcttacagcatacatgtgcatgttccttttttttttcaagtgaacggtatatctcaatgtttttttttcttgatagctttttttcatcgtatacgtacgttagttgttttttttcaaacgttatcggtatatctttgtacgttcgtacttaatttctggtaatccgattctctggtatatataggaagcacaaaccaatagatataatctaatggtctaaaataatgggtccaccaatttaagtgaaaatcgacggtgggattgtagaatgacacatggcgatctaggagtatttgtaggagtgccacatggcagcgtaggagcgtttgtagaatgttttatgaactt

SEQ ID NO: 8911 - DNA, 1501 bp, Oryza sativa
ctatttgtagtcaattattgtttgttgtgtcttggtggtgtcaatattcacctattatttgttgatggtttcccttagtattgtcctttatcggtacttgataacagccatgcttattagatgccatctaattataggtgcacagtgcacagacacctcataagcaatcttgatgattggtggatagtggtttatatatgaaacttatttatatagggattagtagggatatatgattgatatatttggctattcctaattgacaaaatatattttatactatatatttagtaaaaatatatagtataaaatgctattcccacatttatggtgagcatgtttcctgaactattaaaatgatgtgtgttttacaaatactttatatgcaaagttttctaaaagatcaaacaaatccatattcaagtttgtaatatttagtacttaattaatcttacgttgaagacattatttgtttcacgtgtcctagagaagctcatccgattaggtaaaccgaatgaagcctaagagataaaaggacatccacatagtgtaaaaaaatatgatcgttaattttccaaaaatatatgaataaagacatatatattatatgaaaatacgttcatgatatatttaataatgtcatttggacatgtcagtattacccaatagggagtgagtaattttttagaatgctactcacaatttaaattgtttttacttttcaaaaatacaagttcaatttaactatgttagtaagtgatatacaatcatgtaatctacatttttaatttattaatatttttatggacgttttgatgagatgtgatatatagaataaaacatgaaataatatgtatttttacaacttaaaacatatagttaacatgaacttttttgttttttttcatctaatctaagtatataagaagaaaaaaagaaaaaagacatataggggatatgtacgtatgtacggacggacgtacaaaactacagataaatggggacacgacgaggtgatgtgggatttttttgagatagattaatttgatagtttttttataatgatctgatgattaaaaataatgggtccacaagattaaacgaaaaccaacggttggatgttttgctttttttttataatttctaggatttattaaagcgccacgtggtaatataggagcgtttgtaggaatgacatgtgacggtttaagagcgtttgtagaaagtttaatggacttatagtgtaatagatattatagtgtaatagatagctgtcgccaggacccaggttaacccagtgtgaagtatccacagttattttgtcagtgcaaactatgagggatgcgtttatatggacagaaaatatctatttatctagcttacaactactactgctggggctttcaaattcaaatggtactatttgataaccaaaggatattaagtacatatgatgcactcggtaattaattaccacttcaattatgtacgtttttacagt

SEQ ID NO: 8912 - DNA, 1501 bp, Oryza sativa
atgctaaaagagtaaaataatttaaaattttttgtatgcagtttacttagtggtacttaactcagtgtgaaatttgaactaatcaatacacaagtttgttgttctcgatacaaataatattttgtgatcttactttaatgtaaacaagcaataataggcttaggcacttgtgggatcaccgagattgggtctaggcatatggatggtggtggtgatataatgatctggtggcaaagccttcctcccacatcatcctgagtggtttccgcagacatgcagagtacagctcattccccgtggaagctgtaatgcggatgggcagcactgtaaagggtacgcgatcatctcctctgttgtgccgccaccgcacgcatgcctagatgtggttacagacacatcgtcggctgcctagtctacatgattttttttttaaaaaaaatatcaatgctatggaaatactctgtgcaaactttttactaaacgatatgtgtttttgtagaatacacatattcataactataaaatacttatattaatattagtgacataacctatttagatatattgtgctaaaaatgggtaaaacatttttagccaacagtgttggagaggtaactatatgtggagcatatttggtaaatataaggtatagctacttgcattgtgtcatctagattttgtgagagcaaggatagtatgaaagttatggagcgagaggtgtgctggatttggtgctaacaactgccaggctgacgggccattttatgataatgctacaatccaaccgttggctcacaaaaccagacacagattaatggatttcattggcataccgttttcatgtaagccatgagccgcctgtggttttgatagtacacataatcatgctagttaatctgctttgatccttatcacgcacatgtctatatatatcgattcataactcataagacaaaaatcactcaactttttcttcatctctcctttcctcttcctctattccaacagaactgatttagagggaagcagtgggtaaaaacaccttggtcgatagcaacttaccagaggaaacaaaggaatcgagtgggcataagaaggtaggtcactcgtgtagaaattctagttaaaccatatcgatgactgatagtgagcttattatcatagtgatccaaactttttcggatcgatgaatttgaatttgattcctcaattgtgtttgctcagggaaaacaacaatatagttttttagggacaacaaaggatgatcatgttgatcattcagagctagaatcttcaaagtttcttgatcctggaaataaagatgtaccataggaattgcaagctctggaactgcctaccaatgatgtacctgaggaagtggaagttgttgaaacaaaatccaataattttgtcaacaagacaacgaggtaacagtggaagtaaaacaaagattagaaactctttctctctctctctctctctctctctctatatatatata

SEQ ID NO: 8913 - DNA, 1501 bp, Oryza sativa
ctcgtatatgtgcatttggtatttcagctatgaactcgtgtgtagcagactacttgatccagggaaatggtaccgtttacacgattgattcctgttataaatacgggggtccacatttctacgatgagtttacaggagttgataggcggccttttccagtacatacaacaaataaattgtgccgaaaccttggagtaagccacttctatataatgtatctaccctatagttcaaacatgcactaacttatttttttattgattgacaggaatatatgggtgcaaagttcatggccgcacaccataaaattaagtctcaaaacacttcaatcagtactaaaggatggaccacttgaccgtgattgcttcaacatggccatacgcaagttcatgtatgaaaacatccggtcgcttcacaaaaccagctaagcaataacaaagcattgcctggacttacaattttgggtaagtttttataatctacccaatattgattcttttgctcatattttaaacaattattgtacatcatatagactgctactggatttggtataagtccaatgttccataaggatatagatcttgcggggtcggttggtagctggtcgaaaatccattatgaagttgcaaaatgcaaattggtaagctagctatcctttgttcttatttgaatgtgtttttttatattatcttgacggttgactttttccatattcttataccagtatgtgctgttggaagctatatcttggtcatactggaccaagaaagcagaacactttatctactagaccctaatccactaaatccaatgtatcagaacaacccaactatgagatataccaaaaaattgttaaacgttaccaactattacaacagagccatgcgtgtggcatgtcctggctctaggtggactgaggatatcgacttgtggggccatatatatgtcacaaatccggtggctaactcgtaagttttcttgtataatcttgtttgatccaataaattatttttgtctaacgcatggtgcctaactattcaaatttcataggaatttgtcgggttgtctcgtgcatctgttcatgcgatcctggaaagatggagcacttcatttgccgtcttttaaggtcattccgactagcattggcatttagaatattatattatattttataatacagtcatttattttataaacatatgcatttgctagtcgattaattcctgttataaatacgggggtccacagagttggtatcagagccatacgactgtaggaaaagaccaaaaggcgccccgccccttttctagttggccaagggggaaattcccatttagtaatacttttaaaaataaaaaaacgctatgtttacaaaactctatacgattttcatcttactcttaactattttcttcacaaaacaagttttactcttagctgactttgggtttttcttaaaattagatggcagatcaggattcacccactacctaggaga

SEQ ID NO: 8914 - DNA, 1501 bp, Oryza sativa
ttaattatggatgatgggatgtaatggatatttgtgacgccccacacttttaacaatgaagataaaagtgccagactgtagattattatttaacaaccattattttgccaaataataatccaccatcagagatcgcaacagaggaatagttagagctacctttaattcgtccctaggagtattaaggccatctctaatccagctcactcttgcaagggatcaaacctgtacaaaggggttatatagcaagggtgagcactttcgtactcagcaagtcattagtaataaaatgtatatgcatgaataataatatataaatctatatactataatactataccttacgtaacatcatcaccttcattgtcatcaaaagtaaagtatatttctattttctaaaagagttttcaaaaggagatttataaaagctagagtacactcgtaacattgaatagagtttgtaacaactccccgtagcctccaatccaggagacaggcgtgaatcacgatttaatttagcactgcgcaggcttgtatcactgtacccatagctagtcttaacacgtttgactgtcgcacttcactagatgcggcaccacgctaagagtacaaaactttttccctacttcaatttactatactccacgtttgtgttgagcctatcagctctccacaccaccgcgctactatatgaggcctggaatgcacttcatcggcattcctggggtttatatcatctcccatcctactactacgtacccatgtggagtataataaacttgataaggtactaggtccagcccgtcttaagacggatatatggtcgacacggtatatacggttctttgatacgagtgaggggatgattagtccttatatttatacaccgtatgtagggagagccctgtcctgccctcatcatcaatcatctcatccctgagctccccatacccaccatactagtatcccaatgatctccatcatcatcagtttgtcaatcatatcatcatagttaatctcattattctagaaaatatatttggatgcaatactaggagaaatatttttatgaaatagatttttaagttgaaatagaattatcatctatcaacatgatcaaaggagagacttgcctgagtttctgtagttgaatcgaaattatgtagcactgccgattgacccaattatcattctactcattcctgcattatattatatatatacgttgaggttttgataaatttaaatactagggatacaaatgatctaccaataaaatgtgctctgtagagtttattttaatgtgcaaactttcttccagataatgtgtagtaataggtaatgcgtaggttcaatttaatatcttgtgtagcctagtagtgtacatccagcaattaatcccctttccttctctaatctctccttcctcgaacagataaggcagcagcagcagtaattcctcttcttcttcttccttgctgctgttcctaaggcacttctc

SEQ ID NO: 8915 - DNA, 872 bp, Oryza sativa
  unsure (1)..(872): unsure at all n locations
gggtgagagcatgggcatccctgtggttgggcaacagtgcccntagaccaccccacaccacactggcacacttggccaccagggcaacacagtcgggcatcaccccctgggaccacccacaccgcatctgcacaataatattggtcacagtctgattcatttagagcaagtttaatagtatagtccactactagctacaattcatctatagccaatctaatagctaattcatacaatagttgcttactatattattaatgcatggtcccacctgtcatacacacattgcatctaagaggccgcgctacagctgactacagatctgtagcccgctgctcttctctcttattttttatctcattaaaatatgtttacagctggctaatagtctattattgtacctgctcttagcttgagagtgcgatgattggttgagcatatggctgaaacattcaggcagccaattttaataagagcaagagctagctagatgcagttacaaagggaaagcaattactcctctatttgatgtattcttttctggataaattgctcatatgaaatgtccatatgcttcagggatacaactaattaatttacacgtcaacaacgtaattaataatattatttacagatgtatacgtgctcatttatagatcatgattttattgtaaacttttttaatcgacaatgtgtatctacagttgcacgcacagagagagatatccatacttaactcaattctagtcaatttagtactatttcataggcctatgttattttctataagtagtgtttgtaggtatacaaattttcagtcaatatttatacctattaataggccaaatttactataggacactcaaaacata

SEQ ID NO: 8916 - DNA, 1501 bp, Oryza sativa
gaccattcgtcttattaaaaaaatttaagaaattatttattttttcatatcatttgatttattgttaaatatactttcatgtacacatatagttttatatatttcacaaattttttttaataagacgaacggtcaacatgtgctaaaaagtcaacggtgtcaaatattttgaaacggatggagtacaagaattgaataatatcgtgcactaggaggtttgcagccatccaatcaatatatcttacgatccaatcaaaaaaaatggggcaattgcttatttgaccctattttgaaagctaactaccaatttgaccaatttgaccctattttgttcagtttggttatttgaccccgcttttcaaatcgaaaggaaagctgaccctattccgttaagacgagttaacaccgtaactaagtggtaaaatgacaaaaatgcccctaatacatccatctatcctccaccactcattcttatccactctctctctactctctctctctctcaccagagcactgccgagaagcggcggctcggcggcgcgacgcggaagagcggcggtagctcggcgacgaggcggccctccaccggcggcggaggagcggcggcagttcggcgacgaggcggccctccgctggcggcggaggagcggcggcggcggctgcgcggagcagcggctcggcgacgcggaggggcggcgggaggagcggcggctcggccgacgatgcggaggaccgccactggcggcagatgcggagggctgcatacgagcggcggtggctcgatgacgaggcggccctccgctggtggcggaggagcggcgactgcggaggagcggcggctcggtgacgaggaggggcggcgagaggagcggcggctggacggtgcgacgcggagggccgccgttggtggcggatgcggagggctgcggaggagcggcgacagctcggcgacgaggcggctgtagacccccgattttggaaatcggaaatcttctgtgtttatccgtaccaatccctggatcagtagttggtacacacatacatagttggatcacaacatatcacgaatgaatttaggctaaaagagttaaatacttacattagggccaggtaggccaacaactatcagagaacaacagcggaagacaaaataatagaagggcccggttaacatgccacaggcagtcgactggggaacgagacctagaacaagaccacactccgatcatcttgtgggatacgcaagcgtaccgacaagggcttctcttcaacactctcctaaaagatatataaatagcaagggtgagtaccaaccgtactcagcaagccaccacaacaacaatgcatatgatagcgggtatttcaaggaatggcttcaggttcttttgcataaagctaattttacaattcttttcacaagcctaaaacctagcatagactgatcaaattttagtaccagtgttcactttaaacaacgacggttctgtccaccatccattgt

SEQ ID NO: 8917 - DNA, 1501 bp, Oryza sativa
ataaacatatagaaacactaaacaaattaataagatcataaaagataaatatgctactttaaatgatcaagtgtaatatacgaacgattatttatagatgataaaaagaaggttcaatcaattgctaaaaatggagtttttatgctcataaatgataattgtactatgtatcgcgtcaaaaaaatagttcatgcccattgtaggtacactgggtaatatatcgtctagtgtccaatgtgatcaccacatgtatttggatcccactcatccaaatacatatgatgaaccctactgagggcgttgagggtagtttagcttggctcttgccctggttggttgtctgtgtggaatggttggcaaatacgggtttggttttgcttatatgaatttatgagacttttgctgctatctttgtgttgtatgacgggtttatgaacccggttatgttatatgtatcttgctgctctcttatccatatttatgcatttgtgatgcttatgaacagcttgcgatgaaagtgtgaggctggtcgctttttctagggactagctaagcatgattaagtgttttgagtaattgagatgatcgtgaaatgtagtgctttggttcaagtacccactgaggtatgtaacacatttgatcgtcgtctttgagtggtttgacgggtatatattaagttgaaattgcctagcaagttattctatcgaatatctctcttactcactactcggcatcatagttcatatattgaaaggtaagtgttaaccgtgatcatggacacactgaagatgagtgactatttttgtatggataacactcaatcaaatacatgtggtggtcacgttagacactgaacggtatattacttgggttgcctacatatacaaacaactaaagtaaatgactggtaagcccgttttctacaacactggcgcaaatccgcatctaatatatgtgcatgatcgatcattcaggatgttcttttattgtgaaataagcgtagcttaactggttaggtttctctagttggaaccagctcatccggatttaagtatcacatttacgtctattttttcttttagtgatagccaatgtaccatcaacagtgagacactcgtggtgacttcgtcaatcccaatatatgatggatcagtctttcacatatgttcatatgagaagggtgtgtttttgtattaatagggatgtgtgtgcacgaactgtgagcatctatatttgtaatgtatttcttaaaaaaaagtacgttactctcacaaaaaatcatatatgcacataatgtattaatcttggggaagatctgcgaatatggtttgtcaggaggagtcttttgacaacaacagattgctagggttctggttctctcccctacaaatacccacgtactctgctgagttttcgcacctctctctagttgcagaccatcacttacgtagccctgtgtgcaacggcgcaagtgcttgtacgctttcagctagcgtagcca

SEQ ID NO: 8918 - DNA, 366 bp, Oryza sativa
cagtgcaaaaaggaacaaaggtaaaataaaaggaaagtaaaaatcccaagtcctgcgtacaaatctatagttcaagacatacacatcgccttccaaccgaggtcgagttgccccggtgccatgtcttattcgtggaattctatgtccaagtgcatactttgcgggggtaaaattttctacacgtatgttgccaaaatttctgctaagtttttcgtggccaactcgagaaaattcttacacagccagtctataaatactcacacatttcacaaaaaaatacttgcaacatcaaagctacacaggtagaatcatcgaccgtaagtaagtactactcctacgtacattaagtgtgagcttgattaacta

SEQ ID NO: 8919 - DNA, 1501 bp, Oryza sativa
accagcatcggctgcgcccgcgtcgtctgcagcaacggccgcggcgtcttcatcacatgcaactataagccggccggcaacttcgtcggacagaggccttactaagttatttatacacacgggcgtacgtactggctagtactacgtatagtagtgaataaataaagacgtgaaaatgtaaacaggtcagtgtctgatccacgccttcacggtccataccgaggattctataaagcgtcatgtcgtacaagtaaaaataaatagtactccctctgtttctttctgtttcaggttataacacctattaactttggttaaagttaaattgctttaaatttaactaagtttgtagaaaaaaaataatagcatttttaacctaagaaaaatttattatggtaatatattcaattattaatttaatgaaactaatttgatactataaatattactatatttgtctacaaacttaatcaaacttaaagtagtttgattttgacgaaagtaaacacgctttataaccttaaacggagggagttgtaaaaccgtctaaaagcatgtgccagctgctagctgatggtccattccatcgtcgcacttctctaatttgccttgtcagttgtcactgggtaagttttcttttgaattctttagggtacgctcaaagacaacccaaatatataattgttaaaaattctaaaaaaaaataccgacactcatacagtataaataaactatttaacaaaaatcaagtcaaaacttaactcacacatcgagaaataaaaatctctagtacaggatagctcatcttaatcggacggcaagcctcatctgtgtcagggagaagtcctgtcacgaaccaaaggtatcgtatttgttttgatcgcaagcgcatgcatactgttgtgagtattccaaatgtatcgtatttgtttttccgaaaggaaaacggcggtgtaaagagaaagttcatatatttgtaatcatgcatactataattgatataccatagtctaaacaggattaattgataacaatgataattgggtagtgtgatacaggagattcatctctaataaatatagactaggtagggtagtgcagaaggactaaagagagctaaggttcatatgcacttttatatgaacatatttagtatacacttgatatatacatgcttacaaggctagtaattaattctacgcatccaggtgctactgaaagatcactacctgctgatctgttagcgtggttattgcattttacgaactcttatgtcatacctagacaaaaaggaataaaaaaaaggacagggttgtcaccaccagctatctacctcacttttcgtagggcatacccgcatccaataccatttatttaacctaagcaccatattttatgttaataaacaatgtcactaattcacccgggacacataccatttggatggacaagttagaactagtgcaacccattaaaatcattggacaattaacgtagtata

SEQ ID NO: 8920 - DNA, 1501 bp, Oryza sativa
ggctggcaacgcatcgcgtcgcgcgcccaagcaaaggctccatcaaacacacaccaagaaagaagaagaaaaaaaaatcccccgccacgccgggctgctccagatctctcagccgcgcgcgcgattatgtgggattaggtagatgagggcggcgctgttcggtgccgagaggagcggggtagtggacctcggcggcatcggcggcggtaacagggggctgttttggcccgcggggaaagggggcctggtggtggtggagccgaggtcggtgcttgactgcacgcgcagcccgagcccgcgcaatttcacctcgacgctgtcgtcgtcccaaggcggcggcggggcggactcgaccggtgtggcggcggtttccgagagcagcgccgccgccgccgaagccaccaaatggggagccccccgggaacaccggggcggctgttgctgccgtggccgccgtgggaaagaagactggagcaaccgctgtgagttgcccccgataccggggaccctggatgtggggctcgtcggaggagagggctgggacaccatgctcggcaacgccgccgccgccgcagccgggcaggatcagtcgttcttgaactggatcattggggccgccggcgacctggagcagcccgggccgccgcttcttgacaatgcgggattcgggatcccggccgtcgacccgctgggcttctctctggaccactccctcaccggcgtcgcctccgacctgtcgtcctccggtgcgcaaaacgcaaccggcggcgcgggtggcggcaaggcttccctaggattcggtctcttctcgccggaagccacctctctcgagcagccgccgccgccgatgctgttccacgaaggtatcgacacgaagcccctcttctgggcgcgcagccgccgggcctcctgaaccactatcaccaccagccgcccaaccccgccgcagccttgttcatgcctcacccgcccttccccgagcacaatcaccagtcgccacttctccagccaccgctcaaacgccaccacgccatgcctgatgacctctacctcgcccgtaaccagctaccgcctgcggcggcggcggcgcagggtctcgccttttcaccactacatggcccggttccgttccagctccagccttcgccgccaccgattcgcggggcgatgaagacgacggctgcggaggccgcgcagcagcagttgctggacgaactggcagcggcggcaaaggcaaccgaggctggcaattccgtcggcgcgcgcgagatattggcgcggctcaatcaacagctcccccctcttgggaagcccttcctccgctccgcctcctacctcagggaggccctcctcctcgcactcgctgacagccaccatggcgtctccagcgtcaccacgccgctcgacgttgccctcaagctcgcggcctacaagtcgttctccgacctgtcgcccgtgctgcagtttgcaaacttcacggcaactcaggcacttcttgatg

SEQ ID NO: 8921 - DNA, 639 bp, Oryza sativa
ccaaacagtcagaagcaactcgccaagcaaaaatacgtaccttcggaggaaccggacaagaccatattgtattccataagcttttactcccctcaattgaactgccagaagcattgctattttcggaattcagcttattttcaatggctaaacggtaggcagttttaactgtaaaaataccagatttctccaggtgccatgccaagaaatcatcttccccttggcgtgatgtgcgaatggacagaatagcatccgcatccattggaagaaagatttgtctaactaattgctcattccagtttgtgtttgcatccaacagatctgccacccattttattctgcatcttccttggctggttatcactttacgagttgacgattgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 8922 - DNA, 597 bp, Oryza sativa
ccctccttcccaaacaccacgtaagtacactactcactatttgtgaaaaaacagaacactactcactaacatattctgctctgatgatgcagatgcaactatgatttttcttttttgatgttgccacatgccaaattcatcaacgattattatcatgcaaatgtgagctggatggttcattggcaagattttacagggctgaggaattttcaaggaagcacttgtgagcaggaccggctctaaatttcagagggccataaacgagcttcgtaacctatgccctcaaaataaaatatatttttacttgcaatatatatttctaaaaatcatatatcttcgaaaatgatgcgaataaaactataaatacataaaattatggtataaattaatcaagactaaatagatgcaaacccgaagataaaaagatcacaagatctcactctaagccctagccacgatgatataagggtgtggcagcggagccctgcaaggagggcatgcatgcgggtaggagccacgcgatgtgccagatagaggtggcggcgccacagccacgcgggggaaggcgagacgggaggaggaggatgaggagagtca

SEQ ID NO: 8923 - DNA, 568 bp, Oryza sativa
tatctctctcttttctatccacttagcttagataatatatatgagaatgagtagttaatgcttgtgggtcactctacccttggattaacttaaccaatgcttagaatatgattatcaaaagtaatatataaattattagtcaagttctctctacatgatcttcccacgggataaaataaatgcgatacccttggaatactctcgggtgaaatgctaaaatggtatatccgtgcgcttgcggatgaactctgtaaccataatataccaaaagtatttctgctccattgctaggaattatatttctagtaatggcgttaagaaataccaacaagcatttctggccccgttgccggggaagattcatactagagattacatgaactaatattttatatatacctatgtataatcattttcctttgcaggctaaccatggttgttttcacttttattatgaaacacagggtagtgaaatagtgcttgactggtttcaacttgccggaaaacttcaaagaaaatccagaagctttcttccggaacgtcagaccgcgagtcgctgctccacaga

SEQ ID NO: 8924 - DNA, 1501 bp, Oryza sativa
acaagccccatcccacctccaggtcgtgcacccaactcagctccatatgacaagcagctatggaaactctttcatcttcttcccctttctttctcccttgtctgatcttttctttcttgcaagctgagctcccagctcacttcttcccatcaaatctcctccaaacactttggatccatccctgcatgtcacaccactaaacccccatcactctaagctcctcatccatccgaaaatctcccacatgcatggattcgtgagagagatcgagaagaaggaagaacaagccacttgcagcctatgaggttacagcagcagggagaacttatttccattgatttatgagtttccctctccatccatggctcccctatgaggttctccattgtgttggtcatctctagtgcattccataggtcatcgattcaagatttggaggcaagtggtagctgcaactcgtccctctccattgcaggacaaccctgagattcttcggtttactctcttggtacggccttttcttttgtgtgtgtcacattctgtaggaatgtgttaactcatatcttgtaggtttagagtgctctcatgcatgtctatccactgcacccattggacctctattagattgtgaagtgaaccgagctcgtctttgggtattgtggttcccacactaactagaacctttttttttagctacaaacaagcttttgctgaaccatctagcatgttgctaatttcatatccacatgtaatagttcaacctacaggtcctgtaaaagaatgccaccacgaaaagccatctcaaatgttggaaaagctagcaatatttactgctgccctaaccaaatttttcgtagaaaattcatctgaactctgtttgagctgaaccaaatttctgtggattaagaaaaacgtgatcttcaatgttgtaaaataaaaatgaccaacttttgtactggttttcccagtaaaaatataaatagctatatgtatcccttgtgtggtctagctcttatgaaattcgtaagaaattattggtaaaagctaaaattgtgaaaccaattttgttgagcttatattttagtactctttgctgttatggtgttgtttttggaaaaactacctcttaaatcatgtttaggagtttatttagcattcctatgtttctaacttgtaagatccataaataaataatgacaacacatatagctgtgaaataatttttcttaggagctgtgagtgatgtactttactctaaaaataatcattattatgaaattttggtttgaaatgaattttacttgtaatgtactaaaggaaacgttaatatttacagaattgccattttcagcacctgagagcttgtcattttcatatctcccaaaccataagtgataatctggtgattatctacccactgtatttatttcataatttatcgatcattttgcatatgcatgtttatttggctcttattcgcatattgcttcttttcgataga

SEQ ID NO: 8925 - DNA, 1501 bp, Oryza sativa
caacccttaccaatggagaaaccaccaattagcattcggctgacgttgtgtgcttttccggcgctcaccggccgcacgtcaacctcgccttagtgattgtgtgctgctagatccgataacgttgatatattcgcctttgccggggccgagcgagcagaacataactggcgtacgatgtgcttgtatgtactgtttcctcctgcctttctccgtcgtttgccgctgccggccggcgcgatgcccatgccgtgccctcccgtatcttccactgcatctgatcagatcgatctcagtaaatatggatggactcatcggtttagaaaaagaaacaaatacccacgttcgaaagaaaaaggaaaaagaatgcgtgcgtgaatggatcatatcgatgggcttgacaatataggttacatgggctttaaaagacccaccgcgtggaacttggattagattgtaatcaacggttgacatattatggtttgtttaatcaatggcttgatcttcctgattaacgtgagagctccaaaaaagtgcccgattagtataggtatagatttactgaacctcttttgcaaggttagtttactgcctccatagttttagtcttattaccttctttgtttttaagacaaagaggcaacagactccatatttatttatttgagaactggatgtacaactagtgttgcataacagctccttaagcaagggtgaattacatagaggtccagatttaagcatggaaggacaaaataaaagatcaaaaaagcgatcaagtattcaagtctgtcttcaagctgtggccacaacgatagcctcgatgatgttcaagacgacggtgaggaatacaagcatggagatgtaacagccctaggctcataaccaggtatttagaagtgcatttgttgtcctttagattgcatatttactatattgcaaattaatcatacgcgataacaaaattaactctaatcggtaaaattgaaaccacttctatttgaacaataacttgaacagaagtatacatgtttaataatttattcaaatactaggttatttatcaccaacaaatataaattttgtggaattttagctctccgttttgacctctttaaaattcaatttagttctcagcataccactttttacctttttgctagaattaaaatatcttgaatttttgagtgtaactttgaaaaatggaaactaggtaactcaatctatctccacacctgaacacacatttttgacactcgtgtagctaggtcaaactaattacccatgaatgagagagtgaaaattcctgaaaattcactatttttaatgtgtacctatgtttctaactttcctttatctgccccatgggtccagctcgacttggccccacttgtcactgacttcggctctccaacaagccccatcccacctccaggtcgtgcacccaactcagctccatatgacaagcagctatggaaactctttcatcttcttcccctttctt

SEQ ID NO: 8926 - DNA, 1501 bp, Oryza sativa
tttagtaggatattgtggatgctcagacctttgtgttcaatttaaagattcttggactgtttcctggaatataatggataagatgtaggctcatatcttattctgtttgagaattcaaaattttgattgctcagatgtatgccaatgcatgtacatcttttttttaggggaaagcactgtaggggaaactcccacagttaaaggatattattaaggtataaaaataataaagtattacacctggtttaacaggaggttaatgtacatctttgtattatgaaagaatctattatcctactttgatcgcattttaacgctataatcactaaggaaattggacacactacatgactgagcatctgagacacacatgaatctgtagattaatagatcaatcctttatattcacaaaaaaagtgttctactacccttagatatgcataatagcattttttttccagtatgcctggcattttctgttttacgcatgtgacaaataaataattatttatactaaaaatcaatgggtattggtaattaatgttgtctctttaagtgatttactgacgtgcctatctatctccttaacgatacttttgctacgtgattttacttcctttatttactgaatgtttactacttggtggtggagagtttatttcctttaggtcagagattttattttcatgaaacaaaggtcactagggcttcggtggctagagaacttgtcaaacatgcccgacttacatgtttccagatatagagtttagtacctaattggatagagagctgaatggaatgctataaatggtcaagtccaatgatatgttttgatgaacatatgttacccttaaattcaaaagccgtgttacggaaaaaataaactatgtacaatgcagatattgtggtctacttactcgaaatatttcgttggatgatagttgggattgaaaagtagtattttcactcaatatttgttgcatgtgatctgaatctttactacttaaaaaacttgtagtggtggtggtgagtcctgaaagattgaagggctgatatccatccgaggatcctcccgcacaatcaacgatccagactccttcggatagcgctccaccgtattattccgtgtgtattcgttgttgttcctccgcctactctctctcaaacaaccactctctcctcaatgctaccccctgccgctccaagctgccacaggcctgtcgctcacctgtcgttccccatccacaccgccgctgtcgcatccccgttgctcacctgccgttccccatccacgacgccacccgggcctcccagctgcaccctccacacccccccgccccccccccccccaaaaaaaaaaataaaaaaccatttggacgaaggccagtgcacccaaattaccaacatcgcagattgaaaaatctgaccaatcaagctagcgctaccagtttgcagtagtgtttcagatgatatttcactaccatgataaatgcagtttctg

SEQ ID NO: 8927 - DNA, 1501 bp, Oryza sativa
ttcaggtcctaatctttgcttacatctaagaaatttctaatgagaggaagattctcatttcaggtcctcatcctgttattcacccttcatgccaattcatgccaagctggtttacaatgcttacctgatcaaatttgcccatgttcagtaagggaacaatatgaatgcatcatgttggtcaaatatacttaggtaactgaatttttgtggttttctttcaggtggaaaatttttgacatagtagtgcctgcaatcaaatttgatgatcaaagtgcatgcaggcaggcagggttcctgacctgggcaatcaattgagggaaattaaaacttgcgagagttccattttgagttaatagaaaaaaaaggatattttttctatttaaattgacattttccatgagctaaacgtgaagtagcttgattgaatgcaagatctgattggcagtatcacgcacgtaatgcttatcgagattgttgatcttgcttgatgagagcttttgataacaaagctttgctgggcatattaatcaccagaccagtttgattgtttcacgttggtgcttgcgtcctaccagtattatgtactgaataatgtttctttgctatgtccttcactgatttactgattttggtaaattgaggcttctactgcgctcgatcttatcaaataattaagcatgtagcgtatgtggaatgaaattggtgggtaattaatgcccaaaccttacatgggtgctgctgccctgatgtgccagggagaagaaattgaggcagttatatatggtcaagatcagctaattaattagcaaatgcgattagcacccttgtggaattattatttttgttcttccctatacgtgaacgtctcgacgcatgttacaagttcgttttgctaactcaagtattggcattagcactaaagcggcattattttatttcctaccatgattgatgttttatacaataattttcgtttttctcgttacttaatactatttggaaactataaaatgtgatacaagtattatgtatgtattaaaattttcatatagtaagcatagcatatgcttgatatttatttaacatcattttactttcctcccgttgcaacgcacgggtaaccaactagtggtagaaagtaattgtagtagtgtgaagatatctatataaattttaaattttgactttgttcacgtataaatgtgtcaactaaaaagaaatttgcggggtcacattaaaaattaattaatgactgtcgcattcatatcatgccccaaaaatcttattgctttcatttatactttgtagatttttttttctatggttgtatcatataataataattcggtatgtgaataggtatgtgttatttatagaaaattctgggatatgttcactgcatacttcggctaacttaactactattaacaatcctccctactaaaatgtatatgcacgtttctttctttttataaggttataatgtatattatacgtggtc

SEQ ID NO: 8928 - DNA, 1501 bp, Oryza sativa
acctttagtttagtagcaatctcagagatcgagattaacagagagagatgggatgttgccttgaccagctgcgcgattcccttctcgcccgcatccgccgcacacaccgatccatcatggtccacgggtgtacctcctcattacagccccgcccttggatatcgaggtcacgctgttcgcggccatcctccccggtgcagcagcggtagccacctccgcctccaccgctggcagtgccaggatggcgacctggtggggagcaaagacagcggcctccatggtggttcgtctccatggaggaggtgcagtggcatccgtaacgcgaggcggagatcggggattcgcagtaccggtagaagggtacggtttggggattgtgagcggcggcgcggtggcgataggcgagcggcaggggcctaccggcggctaggtagggtttgaagatttgagaggggcaggggcaagaatcgcggcggtgataggtaaggggaacgggcatgaatcgctgcgcacttgctgatggaagatgaagcagtggtgctgtgatgttgctgaagaaccactgcagtccgcgtcatgctggcgaggcgcctgtcgctccagccatcgcgccacctcggtttcaccgaagatccaccgcgccaccgcttcaccaccgtcgagggctcatagtagtggcgacaggggagagatgtgacgaagaccatggtgagccggcgcccttgaccacggaggattgaaggtggcggtggcaggggagagatgagggcggtgatggagaccgcggcgagcggcacgagctgacacgcccttgaaaacggaggatcgaaggccgcggcaacacgcagcgattagggtagaggcgcggttaggggatgagcaaggttgcgggttgcgaccttgcgggatgaggacagagaggagacgtggatctgtgactgggagagcgagaaagagagaaaggggcgtgccgcgtgcgcgattcaaggtggtgggagcgattcatagaggtgggaggtgggattgatctcgatcatttgattttacactggtcgatcttaaccgttgagtgatgaatgtaagagtgtaggagtgaaagatgagtaaaatgatttggtgaattatagggtagattaaggactaaattataatgaatcccattgtgaactaattgatctaagcatggctaatcactcctagagcaatcatctagtcagttataacccaagttatcaatggcataagatattcaacatgctgagtatgataggcatccatcccacatgacattctaaaacaatgcaatttaatagaaagaaggggattttataaaataggctccacatgatcaatgatgcatgtatgacctgccttgctcttgagctgactaaacctcggcgaccacttcgaaataaactagatcaccagacctgacagagtctaaacgacaaacaaagcacacaagaaataccagcaatgaggctactgaaacagcaaaaga

SEQ ID NO: 8929 - DNA, 839 bp, Oryza sativa
cccaaacccagaagaggagttcctataagatgtaggctttggtatctagctcgtgcctgccgtcaagcgcctgtggtcgtcgccctagtcttccgctgttttttgtttgtcttcatgtgtgctggtccttcgccgcccatgtaataaattaactatttacgcttccacttgttaaactctgtattgtatcaacttttggtgtaccttgcctcctgggacaaggaataatacacgcacgtaaggaacgcccgttgggttatttctggtcatgacactagtgtaacgccccgattttagttcggaattaaaaatcaattaataatgcatttcaagaaattatattaaaatttaaatcaatttaatcaagtgaaattatagaggaaattaaattttcctttaaaaatcattggccgagaatattttgtaatattctttgtgccctaatgtactctgcggattttttccgcaaattttcggagctcaagaaatagttttaatagcacaaagatcattgcatcaattaaaataaaaagaaaacaaataaaaatctccttttcctcttcttgggccgtcggcccagtccaccccgccgcgcgcaccctcctccttgtgggccagcccaagccgcccctccctctctccccgggacgccgacaggtgggccccacctgtcgggcccgtctccttcctccagccggcgccgccgcgcccgcaaccgccgccgcgtccacgtctccgccttctccaggccacgtcagccacgcccgcgcgtgtgccgcatctcccgcacccacttctcctctctctctcccgcccgcacccgcgccccgcgcccgaga

SEQ ID NO: 8930 - DNA, 550 bp, Oryza sativa
tgtgctaatgtttctaagcatggctaagcaatcatatctaatatctagctgaaccactatatatagcccaactagtcaaattataataacccaaggtatcaaggaataaagtaatcaagaacaaaagggctataacaaacaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaagg

SEQ ID NO: 8931 - DNA, 1501 bp, Oryza sativa
taatagagagtttccaaaatatgtgggtgatttgttgcaggtgggggtagagactgtggtggggccaggtggcatgcatgcgcgtggggggcaggggacggggggagcgcccgatttctgctcccccgccggtcgaccgatccctgtcattcggctaatatacatacagctacatataatggttcgaatcgtccccaacttctagtaatatacacaccacaagtttcacccatctgaacaattctaattaattccgtcctgtgtatatatatgtccaacttcatgtcccatccccacaacccgttagatcaacctgtgacgtattctctgtccaaccatctactagatcgaacatgcaccctcttggcaggtgttactcgatgtccaatatttaagggtgcaagcggctacccgtaaaaacccacttatatgctaaactaatctacgaactcgtttattttgatctataagtgggttcgcgggtgacccacttgcacccctaccaatatttgtaagtatcaaaaaacgaagcaaatatatatgaccatatatagactatctgcatcgtatgataaatatataaggtatggtcatagacttctctaattaattatatgaatggaagtaactatataaaagtacttacttgtacgactagtggtggcgtgcacacaaagctctgctcatctttatagagcagcttcttccaagacttatgaggcttggcatgccctaggatgaagtccccagcagtgaggccgggcagaaatccctcagcaaagagaaccccctctgagttgcagtcaatgatgagtttgccatcgtgctcattgctagccctcaacctaccagcgagtgggtaatagtcaacaaggactctagagagtgccaccttcagagtatccatgtcaagggtgccggtgaagacgtagatgtactggatggggaagtggaggaggcgttggtcatcgaggtttgagaggtacagagcaagcttgggcgttggtttgcttggggtaaccagcacggggggattattgtagatgcactcacctactatctccattgctccaactagttgcaccacacaggaccaatggatgtatgttcaagatttgatgttaagaaggagaggggaagtcttcaacagatagaagaggcatgcatgtgaggaaaaggacctatgtggcacgaatttgaaatttatctaacaaatgaggtcaagcagtttttctaaactatctatctatctatctatctatctatctatctatctatctatctttctatctatctatgcttatctatctatctatccatcaatcattcagccaacatgtctattgatttgtccgtctatcaatatgtttctttatatatatctatatatacactatatctatgactatgaaaaatatcttgtggacaaagctttcgtgtacacatcatgcacgacaacgaactattttatcagaaattttaaaacaaaactatacagcca

SEQ ID NO: 8932 - DNA, 1501 bp, Oryza sativa
cctgaaaaggaaatattccacgaagatgctagataagtgtatcggctggatgaggatatccacctttgctaatcttgatcattagtaattgattaacaataattaatgtattgtgttgttaattagtaattaacttatcaaaattagtgttgattagatataattagtttattttgttgttaattagtataaagaatggctatagtcatgataattaacatattttactattaattaatatgttattgtttttcattcaatccattctcattctcatgtacctaacaaaaaaaactggattgtgatatccacccaaccaaataaaaaattagacccaccatatctgatgtctatatcctatccaaccttcaccacgaaccaaacacgtccttaatggagtccagagatcatccagaacagaaccaccagtcgcatttattatattaagttccacatttttttaatcagtttgtctttgtttaacgccaagatttattgatgacataaattaaatctctatatacatgcttatactttcagcaagaactatctttggcatccaatgcattagctcacgctcggctcgccggctagctaggaatgcagctagcagccgcagcgctgctggacgagggtgcacttgccggcagggtcgcagttgaaggtggagctgcagctagtgagctggcagttgctcgggttcgccttcgagcagcaccggcactgcaggcacaacggcgccgccaacgtgcctactacgccgctgccgccgccgccggcgatggccaccaccaccggcttcgccgtcttcatcggcaccatgtcatccagctgatccaacgcccatgctagttaattgatcgatatacatgcatacacacaacatagtcagttaaatgtcatccgatccgtcagaaaatacagtacaagttcatagaagaaaccagattgagcttagaatacctcgggactgcacggcgacgacgatgaggaggacggcgaccaaactcgagagaggggaggtcatcctcctgcggcagttcgccatggctgtttcggtcgatccctatatataccacgctgttgaatgataacaacttgggaatgccaacgcttgaggagatcgaatggcgagggacgacgagatgtgctcgtttatatatagcgacgacatgttgcatgccgagggaacaatataattcctaacgtccatatgcatacatttagagggctgtaaatctatctatctatctatctatctatctatctatctatctatctatctatctatctatctatctatctatacctctctctctatatatatatatatatatataacatatttaactaaaaactttttatatgtaataataataacaataacaataatatatatatatatatatatatattaattatacacttttcaggagctttaataataataattattattattgttattattattacatataaaaagtttttagttaaatat

SEQ ID NO: 8933 - DNA, 1501 bp, Oryza sativa
caggcggcagcgtgcgtcaaggtgggtcgcatggtggctttgaatttgaaaacggacttgggtgattattatgattcaatttttgatgttgaaggagtgaaaatgtgaaattgacggggagaggaagacattagtgatgggaaataaaagaatagctggtccgaaatagaaatgtttcgtatgtgtgtgtccagggttggaaagttcggaccccctccgatacgatattacttcggccgaaattttaaattttttcataaattttggtaatatttgttcaaattcaactaaattttgttcaaaattttgaaaatttcggaccgaaattttcgaaatttcagcatttcggtgaggccccatcaaatcagcctaaccgatagaattaacatgtgtgtgtcggggggggggggaggggggaggagaatgaaagaacaacagaagaacaggacgtattgggaggaagcaggaaggaaagatgaggaacaggatttctctggaaatttcaaattttggaggatttggaatcgttgagtaattgttctcgaatgtgaaattttagtcaaataactccaattaacaaaagaaagaatactagcacggcattaattaatttatttagtaattaggccatttttatgaagttttctttaagctattttacatgaataaacacgaatttgaatttctaaaattaggcaaatttaaaaatttaaagaacaggacgtgacacaacaagtcggatcagcaaccgcctccctcacccgatccaccaccgcatcgcaacagagaggggagagaggcaaggtaaggataggcaaaactaaggactatcatgatttgttttttctagaacttagaattaatagatatacgaagtatttataatcttgattaaacataaataagttcgactagaagaaagatcaaaatgatttataatataaaattaatttgatttaaaattctaaactgataattgcaaattgtaattgatagcattgagtcttgttttcaacctaaaccctataggtcgtaaataattttgaattcataaatatgagtttcataaattaatagctccctattaatttaattctaaaattaataatttgaaagttataaatgaaatgaaatcttttttatcctaagccgctataaataaccaacatatttaactaaaaactttttatatgtaataataataacaataataataattattattattaaagctcctgaaaagtgtataattaatatatatatatatatatatatattattgttattgttattattattacatataaaaagtttttagttaaatatgttatatatatatatatatatatagagagagaggtatagatagatagatagatagatagatagatagatagatagatagatagatagatagatagatagatagatttacagccctctaaatgtatgcatatggacgttaggaattatattgttccctcggcatgcaacatgtcgt

SEQ ID NO: 8934 - DNA, 1501 bp, Oryza sativa
ggcataggagggtttcatttgcataaacagcatttaataaacatttcagaatttaataaaacagttaagtaataattaaacaatattaatccaatgctatacaacataccctgttgcataggcccaaccattctgaacaaccatcccggctgcacagttctatctccaaaccaggaatataccattccaaaccaggagctaatcaaattattaccagttatagcatcttttattatgatgagaagtgtgagactaatcacgaaagacattgttagacccgcccttaaccgcgggcacggctattcgaatagttttactctggccagaggtgtaccactgtacccacaagacacagccccacgacatgtcaccatgtgcctcaataccaccacggtaccttggaaaggagctgtgacagtacccctcgcacaacacaattcaaagcagtgcaccgttcctggatcataatcacccctttataaacaaggcatagactccccaacgacccccgtgggcttatctccgccacttctcagtctggtgctccgcaatgaaccatgctatacaaaaggtaaagccgttgcccacgctggcttgtggttggcacggttaatgtttcacaaccaaaactcgtgaaccggttcttaattgtcatgagcacgactctcaaaaccatgtgctcacaacccaccattatcaagttttagttggcaagtaattaattaaccaatcacgattgaccatcgtgaactatcattaagccatcattaagtaatagtgagtcataagttatcccaatagtgtgctaatgtttctaagcatggctaagcaatcatatctaatatctagctgaaccactatatatagcccaactagtcaaattataataacccaaggtatcaaggaataaagtaatcaagaacaaaagggctataacaaccaataggttaattccacccaatgacatttgaaaataaatgcaatagttgaatagaaacaatagctttaaacgtgatcaacatgctcaaagggttgtttgggatctgtgtgacttgccttactggccttggaactcttcaaaatcctctcctgcaaactcagactctccgaaaacgtcggaacctaaacagaaaagagcaaaatcaccaaaacagaacacaaaccagcatgaacagtacatgtggatattttcaacatgtagatctcaattttagaaaaatttagagacttgaaccaactaaatccgagctaagatgaattagttatgaatttttaaagattaaatcggattaaaacacttatatggattttaattgaattatgacgcaataatgaattatttttaaaaaggaaaagggaattattgcgtcagcgagtagggttcgcggtggaccgagtgcacggcggcagctcacggaaacgaacggccgagatcgatcctatccacaacgaacggccaagatctaacggtctacgaccggtctacgacggacggcaacga

SEQ ID NO: 8935 - DNA, 1501 bp, Oryza sativa
attatgcacatgtatgctcaaatgcttgatgacatttctagtctaatgttgggaatgaaaaggttttattttgttctcaaattttaatcatgcaatggtttaagttggtcatcacctaaattaaaacggaaatttttggctctcaaaaattggagaagttaacctctaactattttgacaagaaattttaagtcctagaatttcgggtacgttacaatatgatttgattgtcatgattatttgaaatacttatcagaaattatggtatggtattcccaaataaagtactgtagagataaaagggagacgtgggggtgcctacatgccttggataagaggatggttcacgtgggggtggatgaatacagggaaataaaggggagtgagaggaaatcgagtggtctaagataatgtgtccattcgtttaagtgaaaaccgacgatctgagagttttgttgtttttatgactttctcaactttttaaaaagtataatagaagtcctaggagggctcggatgtttaatagaccttttggtgatagatataaatatgtagatagagacatatatatagaagttgatatagatagacatatagatatggatatagacatagtaatagatatagatataaatttagatacaaacatagatatagatatagatataaatatagatatagatatagagatagatatacatgctggttgattgattgattgatggacaaataggtagatgataggaagacgtaatagatatagatatagatagagatagagatatagatatagatacagtgaacgtatcctacgcacaaagtcttctcgtgtacacgccgtacatatcaactagcaaatttcacaaaaaaaatagaaaaatttggacttttacttttaatagcaatacatctatgtgtaaagtctcatattcacattatatttagggaacaacaaaaaaaagactgaattttaatacatttatacttttcaaattgtcaaaaaaaattgatacggctaaaatataatgaatgaggttatgaatttacgcatcggtttaatactattggctgtatagttttgttttaaaatttctgataaaatagttcgttgtcgtgcatgatgtgtacacgaaagctttgtccacaagatatttttcatagtcatagatatagtgtatatatagatatatataaagaaacatattgatagacggacaaatcaatagacatgttggctgaatgattgatggatagatagatagataagcatagatagatagaaagatagatagatagatagatagatagatagatagatagatagatagtttagaaaaactgcttgacctcatttgttagataaatttcaaattcgtgccacataggtccttttcctcacatgcatgcctcttctatctgttgaagacttcccctctccttcttaacatcaaatcttgaacatacatccattggtcctgtgtggtgcaactagttggagcaa

SEQ ID NO: 8936 - DNA, 1501 bp, Oryza sativa
agcaaaaacactctcgttcatgtcaatagagatgacgagcaaaagaaaaattgcaaacaacctccatcaccggcggactccaccctatcctctgcgaccagccacatggagcacgatgtgcaaatgtaggacccgtacaacccatcaattgagataagttaatattagagattgcacgttaatttgatttgcaaaaaaaaaaagcttcatgcgtgaagttgaaggagagcacgcagatccaaatcagagtgtcagttccttacttgcttattgtatcaatgtcgccaacgtgaagcagccgctggttattgctatttggcctaggtgaacacctccttactggttaaggtgctgtccagtgtccgacagcgaggcccgaagcagtgccgtcgcctcaaccaccgccggccactgccatcaaccgccacgatgtcgtcgtcctcctccagggtgtgttgccaatctgtgggctagggtggtgtatcgattcagataaaaaaaaggaaaaaaatgaagcaggggcgagagtggttggttgggaacgggaaaaatataatatataccgaaagcagagaagttgttttttatcgaagtaaatcatttactccgataatggtgggaacacgatgcgggacgtggggtgggatcgaaagcaagaaagttatttttattatcgaagtaaatcgtttactcgaataaaggtaagtggtagaggcccgcgataggagtaaatcatttacatcgacaacggtaggagtgggatgacggcacgtagggtggggtgggtctgtgctgatgcatgtttggcgctcggaatgctgcgctcctaatagtagttctgtagattttaactaatttagtgccaaaaatttccgaaatggtaggacgggtagtggtggaccttacggtcagtaagttgaacctaatcacttgcacggttgcaccacaaatcagttcatttgacaagccaacacagtgattagagtgtagaaaaagaagctcacctaacttgttcatataactcagctgcttccaaagtcgaaagccctatttgaaaacgaagcctgagctgcttccctagaccaaaagctacagatgcacgatggatacatatccgatagcgtgcttccttgccttgcctcgcctccgcccccttttatgccaccccgtgacatcaccgttggcattgcacgaaatccaaatgaatacaacgtaaacagcttctgcccgccgggcccccatggccccatcatcggccatccgagtcaaccgagtgagccacccaccataccagcagctcccactcgaggcggacatcacattatcgtctcgtcttcccaccagcacctgccgcgctctcccccctcgattcccatttgatcccacacctccaccaactagctgccacgctcgctttcccctgcgacatgcgtgatgtgtgggcgctccacttgttaaccatctcgcgcgcacgccaggctcggctcctcgatcgacgcca

SEQ ID NO: 8937 - DNA, 173 bp, Oryza sativa
cagtggatttgcgaagggggcggcgccgcgtccttcccccctccccctccgtcgctctccccaccaccacaccgccgcgtccttctcggcaacggcgccggggcggaaggtggccgaagcggggaggcggctctccctccctcctcgccgtcgcgcttcctccgtggcgctga

SEQ ID NO: 8938 - DNA, 1501 bp, Oryza sativa
aaatgattatcggccaaaaaaaataaaaataaaaaatgaaaaatcgggagcatccatccgtcgccgccctacccgccgtcgccaactgccgccaccaccaccgtgcactgggaagggggtgagggcgcgcaggtccctcccgtcgccgcagacctcatcggaggaggagcccgcgcggatccgccaccctcgaggccagcgtcgacggatgcaccttcgccagctatcgccatcgccgccgcgcgccgggaaggggctggagggcacacacgcccctcctgttgctgctgaccacatccgaagagggggagctggcggatccgccaccctcgagggcagcgtaggtggatccgccacccgccgtcgtcatcgcaatcgctccctagggtggaggatcaggccctcccggggacggcgtcgtcggatccaccaccctcgccgcccgctgtcgccagttgccgctccctaggacggtagatccagccctcccgtgggtggcgctgcttgatcccccgtcctcgcggccaccgaagccactcccgactgccgcccgccaccgcccactcccgctcggagtacgagaggacatgaagagagagagagaggatagaaagagaggagaggagagagagatatatagggttgggctgggtagggttaaagtgtcttgagggtattttagtcggtttaaatagtaaatatattttttttcttttttctaaatgaaacactaacggtgtaatggaaagagggtcagatggggtattagattttgaaaagcatggtcaaataagcaaactatgaaaagcaaggtcagatcaatagttagacttccaaacatggtcaaatgagcaattattccatatatttataggtgtcggttgttttaaaatttctgcacctatagtagtggtgccgattttttcctattgaaccaacacctatagtttctcaaaggtgtcggttctatatattttcattgctcgaagatggaaaactatctatatgctgattttaaatgagccaacatctaaaaaccgatacatatatacaagggtcttgtagacgtgacagacagtagaattagccacgatggtatggtacgtcacaaacagttctactcgacacgttcagacgttccagatagttatttctatatagtggtgagatacacaggatgttttgaaaccatttcttggtgagcacacggtctaatcttctcgtttaaatttttctagcatgcgttggtctgcctttcgtgttcttatgtctgtccagttctttgcgcaccgaacgtcgtaatcatttctttgaaaaaggacccattccatgtatgatgtatcgacgtgtacgtaggttacccttgtaagcagccaactttggggggcttggatggactaaaactcccataacccggactaattcatgagacgaatctattgagcttaattaatccatgattaccctatatgatgctacagtaaacatgggctaattatgg

SEQ ID NO: 8939 - DNA, 1501 bp, Oryza sativa
ctatcacctcgcatgccggcagccgcctctcaagctcccacgtccacgcccacggccacgaccccttccctgtcctgaggcgccacaccttgaacaccgtgccgtggggtgcgtccgcgaggacgacgaggcagcacccgccgtcctccgcctcgccgacggcgtacttggaccgcgggtgcacgccctcggggaggtggacgtacgagaaccgcatgggtcccgcgtcgaacacctgcagcttcgtcgtgtcgcggtgcttccagtagatccgccccgccgcctgcatccccgggaagtaggagtactcgctggggcgcttcgggttgatgacgcggtcgtagtcccaccggccgcgccgccacgcgccggtgcacgagctgtacaccgcgccccgcgccgcgcgctcgccgttgtgctcgacggacaccacgcggaaggagcccgggcagccgtcaccgccgtagccggcgagaaggcagtgggtgaagtggctggaggggtaccacgatggtcgacggatggaaactccgcggcgcgagagcgggtcgtagacgaggagatcgctctcgttggcgaagaggaggcggccgtggcggcagtcctggacgcgccacccagcgtttgcgtcgacgcgggtgaggaagaaatcgccgcctcgtacggcggcgtcggagcaaccatcaaactgggcacgtgcggggtggaaggtcggtatcactgactcgtcgtcggcgtcggtggcgaagtggccgaggagcgaaggatgaagcgtccggaagcggcgaaggaatgcccacgaggaggcgatcgctcgcaagcgcgcgcaggcacaggcggcgcgggcgagcgaggcgatgcacgggaggcggacgaggatctcctcgaggacgtcgtcgttgagagaatcaattgaagggaacgaggcgtccgccggcgggaggcaggtcggcttgccggcgcgcttgcgtttcctgccgcgtctcatcgcgtaaagcgatcggcgacggcagcgacgacgggtcggaagatggaaggaacgaatcaatttgaaggcatggtatttgcaagttttctcctgtttctttggaaatagcgatatatctgagaagtggaattttgtccctcgagggaacatcccctcgttttgaaaatagcagatatatctcagaagtggaattttgtccctcaaagagacattccctcgttttgtgtatgtcgttcaaagagtcatcaaatttttttaaaaaaaattagtaggaaagatcaatatgtgatatatcttttcgcaaacatacgtgttaaaattcgacttatacaatttgaaacaaaaacaataaatttgaccgctctatttatagttaaatttgttatttttgtttctacttgtataagttgaatttgaatttgtatgtttgtgaagtgacatatcacatattgatctattctactgatttttttttcatagtaaattttttatttttgtttctacttgtataag

SEQ ID NO: 8940 - DNA, 1501 bp, Oryza sativa
gggaggagtataggaaaggggggagggggcgccaacttatcgcccagtgcgattgctggcgatcgatcgcccattagaagggcccgtaacaagcggcctggacgcggcgcatgctgagcagctcgacgacgaagagcttgcgcatgttgcggacgtagttgctatagggggagaaggccacgtccttgtatccgtacgacagcatccgtggccccgccgacggggaccggctacagcactcggggtcatggaccttcagcgcctcccgcgcggccttcggtgacgacagcacgaccaccgacaccgtgcccagccgtgccaccccgccagcgcctccaggctccggtgcggcagacggccgatctggtgcaggttgccgatgatggggagcctcgtcgggccgggcggcagcttgaggcggctgctggggttccttcggcgccggctccagaagatgaggacgacggagacggcgaggagtatgaggctggtgattgagagctgccattgctggggcaggagctccaaaagcagggacgctgccatcttcccgtgtgtgatgtcagatgtggtggtttagttgagacattaagagtgtttaagtagagctagctgctaagtacatccctaggtacagttaatttgaaaatgacctcaaaggagactccccatatacatggacggtggagactcctcttatccactcgttttggctccattcgcaagcagtacgggtggtagaaccctagctctatcaattccaccgaaacagtgcccattccaccgattctgtcaccctcgatactagttgtgcccaggcattgtcgccggtgggatgcaagtttgaccggcggtgatagcttcaccgtcacaggaggcggtagaatctgcgctggcggcagcgccgccgatgccgaaatggattccgaaagggtaagtttggattcctcttatctttgattcgttttttctctctttgattcaattgagatgcatggtttggtggatctgatttgggatcccatttttctcttcatttgccgtcgcattgtaggatggatccgaactctgcatgtagagttgtggttagggttgttgcttatgttgagtatatggataatggtagccaagattatcatgtttcatcttcatataagtgggttgtagataaagacaccgtaagcttgatagatttgatgaaggacttggatgatgaaatcatccgtggtagtgcgcaggagcttacagtgactttctgggacaagagagtgggtagggatgtagaaatttgttctgatgctgtgttattagaggcatttaaccaatacagggatgttaggaagcttccattgcatgtgacaatgagtgagccttgttcccaaattgtgtcttgtgtggatgaagctgaaacagtggttccactgagtatggttttacccacacaagcaagtcaggctgacaatgttcctaccagagatgctaccacaaaaaaggttcccac

SEQ ID NO: 8941 - DNA, 1501 bp, Oryza sativa
aaagccaatcctatcagggatatccacaagatccaatatttcaccaccgatatcgctagaacctcgaatattcgcagctttcacacccaaatcactagaagcattgatgcccttcgtcacataatcacgccttgcacaactaactgctccacccgattcgccagaaattccattagagcatattgcagaatctaatgtttcaccttcgcattgcacaggaccagcagggcctcccgttccgccgccaaaaccgtcgccctccagcacctgaatctccccgggcccgtcgggacggtcatgatttccaccgccggcggcggcggcggcgtcgagcgtcctgaggtggaagctggcgcggtggttgacgtcgccgacgagcgcgacggcgaggttgcggaggccgaggcgggcgacgcgggtggagttgagcgggtggcccgcctccatgaggtgctgcaggacggtgacgccgacggcggtgtcgagcggcgggcggcggaggcagccgcagaggcagaggcggaggggcttggtgcagacgccgcacatggggcggcgctggtcgggctcccgccgatgcgcctcgccctggttcgccgccatggatggaccggccgacccggtgtgcaatctgtatcctgtagtaggggattgggggcggccggcttgggcgagggtgtttgctcgattttagggttttagggcgttttggtatcatgggatgtgctggtaataaaatgggaacattggttcccatccaaggatttgacgggaaccaaggtaataaaatgggattaggatattttgtttcccctggttaatttttttagtttaattaaattttttaaaaattgcaatatttccaatcaacacaaacatattatcaaaatatactcaatgttacatttaattaaactaaaatggtgttttagatattgctaaatttttctataaacttaatcgaagtttaacttaaaaatcaatcaaagcgacttaggtgaattcgaatataccccttttagggttttaaatctcccgctatagctgtttgagaagggttctagttttttttgctctaatgtacaatttagccgctatagctccatttagcccgctatagctgtttgagaagctaaccgctaaatgtcttagtctgctatttaaaacattgaccccttcccaacttccactatattatttttcacgcgtatgtttcccgcactgataaactatgttttttaaatattttctatagaaaagttattttaaatattaatctaatatatttttaagctttttttgactaatatttatttaattatatattaatctattgttctgttagaggattagttctaaccccaataacaaacacaaagttataatacgaacaaacggagtactcatttcttaaattttttttgactggctgtcattatgcatttacgcgttggtgaaaacctttttcatttagacaagccaggttaaagcgaatgtgttt

SEQ ID NO: 8942 - DNA, 1501 bp, Oryza sativa
ccaggacacgagccgacgtcaatccatgcatggacattggacagatggactactacacttacgctcgggcaggaggagggttgtcctgggcgccaggttcatcaagtgtgccgaccacagcctcctcttccaccggttcttgatgcacaagttcaaggacatgcacgccgccgccaggaggaaaccggcgaaggcgacaccgatgagcaacccgctcggcacgttgccgccccatgctcccaccgatggagccggaggtggtggtgcgccggcggtggtggcgtcaggcgggctctgagacgtgccggctgtagttagggagctcggcatgatcatgctgttaccgcccggtggtggtggtggctggatcggcggcgcctgtgtcgtaataagcgtcgtcggcggcgatggtggcgtcccgggcgatggcatttcgcgcggtgcaggtggcgaggttcctgcgccggcaggaggtgtggaagacgacgacgacgactgcgcatttgggggaggtgaaggtgttgtagcccctgatgatggcgaaggtggcggcgaggttccttcttccggaggtgattgatgcgatggcggtgtcgacgacgtagtaggaggcggagacggcggtggaggggacttgcttggtgggggcggagagggcggtgtcgtcggtgccggaggaggtgaggatactgacggggacgccactggcggaggtgaatcttgggacggcgacgcgggactctggtttttgcctggagatgccggaggaggcgggggcggagtggccggcggcggcggcgggggaggccgctgaggcgaggacggtgtcggtggaggaggaggaggggaaggcgacggcgaggccgacgacgactgcggcgggggctccggcggcccaccggcaggggccgtggccgtgtcctccgtagacgccatgaggacgcgcggcatcatgctgccgcgcgttcgtccgggtcgtcgtcaatgccgacgcgttccggtgagcccccctcacagaagcaacaatggcatctcgcgcgcgcgtgacgtcgtcgccgtagggggaggggggtgcggcggccgggccgggctcacatcggcattggcgccggcgaagcagcagcggtggcaaggttgatgctattctcggttgtggcccatggcgtcctgggcatgcacgggaccggaaaggaagactacggctgtgaggcgttccggtggtgcatgcaatggtggccgcatgtttctcctagtaacttctaagtggtgaccacggtgaacggctgacatggtgagcgactgagcgtacgcgtttacgtggtgattcgatcggtctatcgccgtgtttagtttcaaaataattcatcaaacttctaacttttctatccccatcaaaactttcctacacaaattttcaacttttccatcacatcgttccaatttcaaccaaacttccaattttagtgtgaactaaacacagtctatatatagcacaagctag

SEQ ID NO: 8943 - DNA, 1501 bp, Oryza sativa
gcctcttcccgtggagcaagaagaaggactcctcttccgcctccgatccgcagcaggtgaaacctctctcttgagatccttgattcttccgcggcgtcggcttggcttggcttgcctcccgatttgttccgaggtaggttggagtataagtcaagttttgtcgggtctggttatgttctgagaatccaagaagcgatcgattagaaaacacatgaatcggctcggggatcgatcaatcagtttgtggctattgcttggtaaccaacttccctgttttgtacagttttggctcaaattttgaactggttgtagctgatttattttgtgttcaattagtgtagctcatttcccttagctagaaatatgtctaaattcgaaaattaccaatttcagcttatgggcctatttgtgctctagtagtctggttctgcaatttgcttcaggcgagtgaactcgtccgttctgtattagatgtgacatgctaactctataacagtgcatttttgctatttgaattgtatgttataacagatgattatgttgaatccaagaaactctataacgtttgatccttcaactattgccgcaatggctcagttctgtccttgtactattaactgttgtgatatctgagtttttcctcaaatttcacaaaggacaataagtaggcaaatcaatcccataactttgcccgttctctcactttcatgcttctgaggtgatgggtccatgtgcaaaacactgagaccacatgctaatttggtggaattgagccaatgtttggatatttgggacaagtttggccaaagttacattacatattttgcctaaattgagccatcggcataagctgagataccagatgcactattaaccccccttttatcttgcttgttgtggttttgcaagtgtacccaatcataattcaaaattcaaatggttttcatacacttgctcattcgcatgcagcgttgtgtatttatgcaaaggactgaagaggttgttgaccagtgataacatttcaacctcattccatggtttgaattttaactgcatctcattactcattagaatgactgaatgaactatggttacctagagatacttgccacgttgatgtgtgtgatcagttggactcaaatggtaatacttgctctggtttccacagtatcagatgtgacagtactatattagatacttagattattagaactaatacagctgtcttcacttgtttggcgaatagatctttgtgtgtgtgtgtgtgttggggggggggggcatgtcctttactagcacagaattgcactcaaatgcatgtaaaaaatatctgagaaaatttgcagtctctatgcaactaaaccttcatgccatccttgagtatatatggagtcttttttgagaattcaattcttgtatttgttttgaacatttttctaatagataaccagtgactaaaatgcgcaatatgtttacaggtgcacatttcactagctggaga

SEQ ID NO: 8944 - DNA, 1501 bp, Oryza sativa
tacagattaagaataagatggaaatacaatcaaatgttgaatactccctccgtcccataatataatataatggattttgagattttgcttgcaatatttgaccactcgtcttattaaaaaaatttgtgcaaatataaaaaataaaaagttgtgtttaaaatactttggataataaagttagtcaaaaaaaattgaataagacgagtggtcaaacagtacaagcaaaaatttaaaatcccttatattatagaacagaggaagtattaaacaaaatgatagtattactcttgtttgaatactatgggagtatagtgatttgtaggaaaagaaaattttgtcaccatttttaattggtttgatgttcacgacgtcatagatcgtgagtcgtgacactactaattccatattacctcactcaactgccataatacctctgtaaactttaataccgaacacaaatgtacatatattaaaaacacattcgctttaacctggcttgtctaaatgaaaaaggttttcaccaacgcgtaaatgcataatgacagccagtcaaaaaaaatttaagaaatgagtactccgtttgttcgtattataactttgtgtttgttattggggttagaactaatcctctaacagaacaatagattaatatataattaaataaatattagtcaaaaaaagcttaaaaatatattagattaatatttaaaataacttttctatagaaaatatttaaaaaacatagtttatcagtgcgggaaacatacgcgtgaaaaataatatagtggaagttgggaaggggtcaatgttttaaatagcagactaagacatttagcggttagcttctcaaacagctatagcgggctaaatggagctatagcggctaaattgtacattagagcaaaaaaaactagaacccttctcaaacagctatagcgggagatttaaaaccctaaaaggggtatattcgaattcacctaagtcgctttgattgatttttaagttaaacttcgattaagtttatagaaaaatttagcaatatctaaaacaccattttagtttaattaaatgtaacattgagtatattttgataatatgtttgtgttgattggaaatattgcaatttttaaaaaatttaattaaactaaaaaaattaaccaggggaaacaaaatatcctaatcccattttattaccttggttcccgtcaaatccttggatgggaaccaatgttcccattttattaccagcacatcccatgataccaaaacgccctaaaaccctaaaatcgagcaaacaccctcgcccaagccggccgcccccaatcccctactacaggatacagattgcacaccgggtcggccggtccatccatggcggcgaaccagggcgaggcgcatcggcgggagcccgaccagcgccgccccatgtgcggcgtctgcaccaagcccctccgcctctgcctctgcggctgcctccgccgcccgccgctcgacaccgccg

SEQ ID NO: 8945 - DNA, 1501 bp, Oryza sativa
  unsure (1)..(1501): unsure at all n locations
agatctgcttagctcctgtgtaggtccaaatcttgatgagatgcgagcgtgccagtcagtttgattctgcaactgacaagatatgcaaatagtagatcaaaacagccgatcagctgacaagccgacagagtagttccaaccaatagccgataatagccgatgccgataccagccgatagcgatagggtttaagcaatcggctatatgtctaatgtagatgatgatataaaggcaatcgggtgatgatgatgtaataaaataacaatataatccagtataaaccaatcggcaaataatgatatgataaataagcatcgatccgaaggttaaaacacacatcggctggaggtccgatgtcatgaaatccacaagattggattaaacagtgaaacttttgttgtcatcagctaaatccaacatatatgtatatgcaattcttatgagccgatgcaacgtccagataactcaccggctgaaaccccgatgaaacccttattggcaaataaaaagcaggctagagattatggttttaagcacgacttagtagatcaaacttaactgatgcaacactaagtatgaaaagaaacatagtatctagacaatcaagccgttgactgagttttcagggtggtagatgtctaagctaatctaatctagcaacgcgatttagccgatactagcagaaaccctaaaacgagaagcagcagatagagctaaattgatatgctaagactagattaacagagacatatgataaatttgtaggcaaatatatcatccaaaccagagcaatccaagaagtcgaatatactgatgcagccttgaacgacgccgacgtaaacgatacaattgcccgggccggcggaacattggacttaccccttagccggagatcgaacaccgatgcagccccgcgtcaggtgccaagtcccgccggacaataaaataaagtagaaaaggtaaaaggtggcaatacgccgaattgtattgattgtgaagatagattacaatgaccctgggtgtacatatttatacccatgaatagatactagtccttgtaggacaagaaagaaactttcctaaagataaaaggaaaacataaagtccttataggacactaaatacactttcctaaagataaaaaggaaactaacaaattattcctagttaatagatacaactgccttcttcggacttgatccatacgtggcaatcatcatgaagcacgtngatgctacttnnnnnnnnnntcccnanntcacctagccagaatcggnnacatnggnttgccttgtccgattcggtaactgccgatgcacactgtaccgatgcggttttttttccccgggagaaaaaaaaggccccccccggaaaaaatttttttcaaaaatatttaaaaaaaccccccccccccttgtggggggtttttttttttcccccccccgggttttttaaaattccgggaatttttttntctncccttncnccaaatccnngcttc

SEQ ID NO: 8946 - DNA, 1501 bp, Oryza sativa
ttattttctaattgtatttctatatggactctagtctcctcttctaatattccttatttttaattccaaatttcaactatttcctaattgtattctatatggactctagtctcctcttctaatattctttattttttaatttcgaatttcaggtatttctaaattgtatttctatatggactctgatttttctttttctccgattaatgtgagaatttctaggccatgagagcgaacgtagagactcttttttctattcctttaataatataatagatagatagttgtggtgccctagcaaattacctttttttttggcgtagtacaacagtctcacatttttttaagatgtccagcaactttaaaagtcatgtagtaaattttaccataaaaacatactagaattttggtagaaatgaaagtgtaaattaaataattgcaaaatagagaaaaatataaaaatgatcaatttcaatagaccgcaatgagaatagaatgagcgagatagactcattgggccaactttcctccaaacctccataccttgacacaatgagccatattctttacgaatttcatataatttcaaaaaggaagcagtcaggggcatcacagcatgttatattcaggtttaagcattactctgaaatagttcagtgatttactatgatgccaactgattatgtttgtgcctgatatgtatgtatttgtttaccactgtaaaaattcaaaactaaaagtgattgagggaaaggggggggggcggtagcttcagacatgaccagcttttatattggtaatagcattcagaggtcaagacctgttgcatgattctatttgtaaatttttgtccacgttatctgaaatcagcgaagaatatgggtaacacatttgttgttaatttaggaatcattaagtgaagaatatattatttccacacgttatgttcttctgtatataggattgtcatctctcatctttcttcatgcgtttagtaccaagtgttgatttaattgggtaattgatccattcaaatcaaataaatttcaaggctcattatgctaggaatttgtgtatattcattctcttatgggatatcagtgggacgaagagttttgagaattaatccatttgattaatgaattggtaacctatatcaattactcctaattgatggttggttgatggttgtgtactggatgatggttgatggctagttgatgacaatcagtcactctattcctcttcctattctattggttaacatatatcaagtacttgatataggttaccaagtactctcctaattgatggttgtgtagtgaagaatagttgatgacaattagttactctattcatcttcctattccatgactatcttactcttcatctttcatttctcctataaaatgagaatggatttgatctcatgcgtgaaaagagatatacacacttttcatccacttctaatgcggttgctgccacgataatctcatcccga

SEQ ID NO: 8947 - DNA, 494 bp, Oryza sativa
attgttatataatgttgattgttggctggtcatatgcatcataagtctctgcaggtccatagttctctatttcccctcattgaattctcatcttctccttgtttttgggcctgactgccctttatctgtcaggccggaagttccgggcctccctgtccgtaacctccgggtgtcggggagtatatattctcagggggagttagaaaccctagtctctctcctcattcttctccctccccgacaccagccctagccgccgctacagtgccccgagtggtgattttctcttccctccaatcaaattcgattattctctgtggatttatctacattggtggctaggaggttctttctgtgatcgattcgcagtttcctctctcaatttagcacttttgatcttctcttttggttcgtcatgtttttgccccgatctctaaatctgtgaacctagggagaaaaccacttggatagtcttgtttctgctaccttgtaga

SEQ ID NO: 8948 - DNA, 789 bp, Oryza sativa
ttatcctttaatatacttaatgctcccatggatgttgattacaatagagtattaaattcaaaacatgtgacatgcaatgttaatgtaatagcttcccttgcccatgcagtagacccttttgcaaaacgttagctttcaataacttcgacattgcactattggtgttagcattatccaaagtgatgaaaacaatttatcttcacaatacaatcttatatggtctctaggattgtattgaatataacaacatccatgtgcaatgtttttaagtgtgagaaccttaaaaatcttttttttaccttccaatcagcatcaataaagtgccacgttatacatatatatcctctagtctggtttgaggtccacatagccattgttagagaaacattagaagtacagtttctgcacaaaaacattagaagtacagtttctggacatatcttgtagctctagcttctgctcttcaaaatattttaggcaatcatactttaaagttcgtcgggaaatcatcttaaatagtcggttcaacctagacacaaacttccgaaacccatcatactctacagagaaaataagcacttattcatccacgctttgcgttaattctcacggccgtgccacgtcgatgtgcaaaaagaacttacctacatgatgtgaagcaaagggagattctcgatgtttgtcggggtgaatgcttgacggtgtgaggtgataccgcgatgtgcggccattgcttggcttcttgcgagacatgcgtgcagagcagagattggttagggaacccgtcca

SEQ ID NO: 8949 - DNA, 1501 bp, Oryza sativa
ggcaaacaaatctaagcaacgggaaccacctcacatccgcccatgaccgtgggcacggctattcgaacagttagttaacctcttcagaggggtacccccaagatacgaacttattccgaacacccgtcggtgtcggaggttcgcaacaaagcctttcccaagccgacctagggatacctcatgccacatagaaggatcaaatcctcacataaatttaggccattttagttttcacaaatcaaactccaaccacctcgatcggtaattcagcaagcttctcttccttgcttaccaggaacccggtttggctccaaccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaactcccgcatcgcgagttttcacaatttattttattttcaaacacaccgacaccacatgtcgggttttcaaggcttctcaaacccatttcccaaattatcgacaatcaacggtgtatgtggagtagttggtatacgcgctcagagagccggataccgaagtaccacaagggtggagcgacaaggaatcagggtagtacggcctgcaggaatttgtgtgactactgggtaggtccgtcggtttgacatgcaaaccgaggccaagcatgttataggtgtgattctaatagttcaagttgcaaacaaaataataatgatttttcaattataggagatattgatcaaagggtgacttgccttgctaaaggtcttcgcgaagcttcatgaatcttcgagaaaaccacaatcgacgaaaatccggtaaccgcaactatacgcaaacaatcgaaaacctaaacaaaagaccaaaataaagatcctatttagactaaataatagtgccattatatagatctcaattttatggaattactggaagttgaacggagtcaaacggagttacggattgggagatatggatttcggaggtttaattggaatatttggaataggagaaatggtttatggaatttatagaaataatattctcaagaatattattgacagtcactgacgtgcgggaccaaagaaaatgattcatggaattttgggaataaggaattgatttgtgaaaaagggaaaaggatttattaatccctttggataagaaaaggaaggagggataggaaccagactttcccgagtagcttggcgcggcccgagaggatttgcgcggctcagccgagcttattgggccggtgcgggctacggggaggcagcccaagagaggggcgcggggagagagagggggaaggggagccgggtggaccgggctcacctcgcggggtcccgagtgggcccgcttgtcagtgaggcggtgcacggtggaagcggcgcacgcgggagcgggcgctagg

SEQ ID NO: 8950 - DNA, 1501 bp, Oryza sativa
tcggagaggttgctcccgcgccgtcggccgctcgtcacagcgcccgtcccggctcggcagtgcctcctcccgttccccttcctcgctctccctcgccccctctagtctgcgtgatagctcggtggcactcccgaacgcgcgtggacatcgccccgagccccgccgccgcctggcatggcctcgcggccattgccgtccactcccggaggccaccgctcgtcgccggccctccttggtactcctttgtcccatccgtcgccggaactggattccttgaaccaaggatatgcttccaccccttttaatcgaacccccgttgctccgatgaagtttcccccttttctcgccaccggtgtgcgccttcctccagcgaatccgatccggtggttcacttcctctcgtccgtcccatcgttccggtgtactccctctctctcgaatcgtcgcgacgagctccggtgaacttggccgccgtccgccgtccatctcggcctccccttcttcctcctcccgccggcccgcgtggctgccacgtaggcgccacgtcggcgccacctcggctttgaccgggccaagccagtcagttgccccctccctccgtcttccctcccgtgcgcgctgtccatggcaagccatgcggctgcacgtaggcccaccgccattcgtccacccggcgcgccgcgcccgaaccacggaaaaaccgaggccagttgagatcagtctccctccgaaaacctagcgcccgctcccgcgtgcgccgcttccaccgtgcaccgcctcactgacaagcgggcccactcgggaccccgcgaggtgagcccggtccacccggctccccttccccctctctctccccgcgcccctctcttgggctgcctccccgtagcccgcaccggcccaataagctcggctgagccgcgcaaatcctctcgggccgcgccaagctactcgggaaagtctggttcctatccctccttccttttcttatccaaagggattaataaatccttttccctttttcacaaatcaattccttattcccaaaattccatgaatcattttctttggtcccgcacgtcagtgactgtcaataatattcttgagaatattatttctataaattccataaaccatttctcctattccaaatattccaattaaacctccgaaatccatatctcccaatccgtaactccgtttgactccgttcaacttccagtaattccataaaattgagatctatataatggcactattatttagtctaaataggatctttattttggtcttttgtttaggttttcgattgtttgcgtatagttgcggttaccggattttcgtcgattgtggttttctcgaagattcatgaagcttcgcgaagacctttagcaaggcaagtcaccctttgatcaatatctcctataattgaaaaatcattattattttgtttgcaacttgaactattagaatcacacctataacatgcttggcctcggtttgca

SEQ ID NO: 8951 - DNA, 1501 bp, Oryza sativa
tgatttgttggacttcttagctgtatcagccggagtacctgctagcaaagacagcggaggagtcaaaagcacatcctgaaagtgaaaaaataacaaaccgaaaagagaaaaaaaaacataaagactgctcaaatttttatttaattagtcttttgaacagggtttgacctgatcacataaatagaagctttctatttagtcaaaataaatagatagatcgttgatacgtttcaaacagaaaaaacaaaacagatagataattgacgccttctcaaacatttgcaattgctgctgtaaggaatacatttttttccagcatcccctagcactcactcaaaaagatgaaaactagcgacatattcattccattacatattcaccaaaggtgtgatgacgacatcaagctaatagagaatgtatgttggagactttaagtctacggtcatgtagctctctgccaatttcaggtggaaattcacaaaaaggattcaataaattatgtttttttatcttgtgttggtgtttattagtttgtgtgcttgcatttcattaaattttgatgtgtttatgtgaactctttggtgtgtggtcgctttcgagcgaatttatgtaataattggttgtagcacgttgagcaaaggccggattttattccatcatctaaaaaaggttggcagttttttgttagtaaaaaacaaatataggtgtaacttgtctattttttgtcttcatcaatgctcggtcagatgactagtaccacaagattacatctcacaggacacaggttgttagttcgattcccactcccatatggtcacaggacacagtttgttggattggatagctgactacgggtgttccaatatatccaatccaaggaaatccataaagaaaccacattgcaattacaaaaatatgtactacatgaaggcaatatccattgggtaacacaatataatacgtgaatacgtacgtacaaagaaccatagatcgagcgggactaacgaatgtagctcacagtcatataacatctgaagagggggggcctaacaggcgatcgcctagcgatcggatccgcccccccctataggcactcctcccacttcttcccttcctcctccctttcttctcttcctattacagtacaccataaaaaaattttaaaaaaccaaaaagttagaaaaatttatgtataaaaaatttgaattcaaattcaaatttgaatcgggtatgtaaatttttgacttataaattttggatcgataaactttaggtgtataaactttagatgtatagaaatgctatatttataaaatatttgaattcaaattcaaaattaaatcggatataattcaaattcaaatttgaatcgggtctataaactttagatgcatagaaatactatatatgaaaaatatttgaattcaaattcaaatttgaatcggatatataaactttaggtgtataaactttagatatatagaaataatatatatatata

SEQ ID NO: 8952 - DNA, 566 bp, Oryza sativa
gccctccacgagggcgattttgcactgtgcggggggccgcctgcaaatgggcggcgagggggcatggaattttgcaggcggcccccttgccgccctaggggagggcgatttttgcctccccctataaagcccagcccctcccctatgaaatttcattatattcactaaaaatccaaaaaaaacgaaagagagagagaggggagggcagcagaaggggagcggcgaagccctgctggttcgctcactttatcacaggtatgctcccatacatcttttgcatttgtactaatatattacgtttgagtacatatgttgcgttttagttttagttccatatattttagcagatctatagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 8953 - DNA, 1501 bp, Oryza sativa
tctactttgataattgtttcatttaaggctatagtataaaatgtctgcttaaagtgaaccattttcaataattttgtgggggtaaactgaggaaaaaaatagtttatgtggttaaatgatccaatgaaatagcttgaggacgtgaaatggaccttttccagttgttaatacaggatagccctttcttaattcttctcgaggcttaaactttttgagaaagatcgtgtatcccctccccaacacatacaccgtctctgtttcatagatcgctttaaattgttaggggagtcgtcttttgaaaaattagtgagcttatttataagttgaacaagaacagattgcaaactcttagtacaaaaaataaaatattcaaatgcgttctatggaaacagaactaaataaatgctcttgaaaagcaagtgcaaacccctgtacaatgctaagcgaatcctatgaataagatgaccgcccatcaagggaatttggtgccgtacgctgtgaggaaattgtgtagcggattagctcggtcggtctgtcattctggagtctggacctggtatatttaattatttgccacgctattaagtatggcatttaacaatttgttactactcctctatagacatacagggcctcattgtttggcatattcatatgtttatcagctaaaatttaaattttcaacattaaatttggagctgattttggggttttttaattgaagtttatttttcagcctttgcttttagatcgctaagaactcatatataaaagttttattcacaaattgattttcgtttgcaaatatgccatttggcatattcagaaaatatgccaaatgatgaggctgatagagaatagagtggcaaaagcgaagtaagcatagcttaactagttagattcttgtgatggaataaatccacccggattcaaatcctttatttaacacgtgcttgtttttatggttaattattttttcggtggtcagcaacgtacccattaacagcgaggcacccgtggtgccgaccccgttttttaaaagtgttcataggcacatgcatttgtgttcataggcacccgtggtgacttccttaaacttatggtatgccgaccctgtctttcaaaggtgtttatagacccctgtatatttgtgttcatagggttatggagaaggtttgtgcttatagaagtagggtgtgcatgtatgtgtttatatgagtgattgtgcgcgcgttatgggcgtgagcccattgtgtgcgcctgcatttgtgctcataggggtagagtgcatgtgcgtgcgttcatatgggtgagtctgcgcgggttgtgagcacctgcatttgtgttcatatggtcatagtggtgagtatgcacccattatatacccctgcgtttgtgttcataggagtaggatgtgcgcttgtacgttgatatgggtaagtttgcgctcactgtgaatacatgcgtttgcactgtatttctcaagaaaaatatagtggca

SEQ ID NO: 8954 - DNA, 1033 bp, Oryza sativa
atggacacagtgtgtgaagacctaatggaccgtgggtgcatgcggggcccgtatacctgatggaccgtgggccggtggggcccgtataggacaccaatgtgtgaagtgtgtgaagaccgtgttttggggtgggaaaggccatttacgatcgtacaattggtatcagagcctagctaggttaacatctctggcccgatggacacagtgtgtgaagacctaatggaccgtgggtgcatgcggggcccgtataactgatggactgtgggccggtggggcccgtataggacactaatgtatgaagggggagatggtgaagggctgagagataccaatgtgcgaagggggagatggtgaagggctaagggacatcaatgtgaaggataaaggacctaagatataagtgggggagcccctcacctcaatagctagcttttggtgtaggaaaggccgtttacagtcctagaagtaattttcttctaaacactaggctatgaaggttaggccaggacaaccaaaaaaactacttctacgactgagaagaaaactataacacagttgaggactcctgagggtcctcacaacagttgacatagcctatgaaaaaatataaaggtaaatgagtactcagttaacagttgacggagagagtacacagttgagaacacagttaacttttgtttagaagtagttttcttctaaacactaggctatgaaggttagctacttctcacgtagttatagtaaagggagtactcatttgagtttattccacagttgagaagtagttttttttttttaggactcctaatcaactgtttatattttcaggtagatttgagacaataatggaactaaaattaaggactagctaaatcttcagttggttaggttcagctgtgtagtttcctaaatataaataacaacattaaatttagcatgtagaattcaaatctatccacactcaccagaagttggcggacatagctacaaacaattctctcattttcactacgctaatctttcatcaacaagt

SEQ ID NO: 8955 - DNA, 1501 bp, Oryza sativa
ctcaaaatcaaaaggtgaatattggttgattttttagtccactgtcgatacaattatggaggagataattccactagtttacttcccaaaaaaaaagagagataaaatattactgtgatcggtagtaagaaattaacttagtcttatctgggttacccttaagtcccaccagtgtaaataaaaagaggaggatgcgttagggagagaggacgattttttcctatgttaattcccaaaactctaaagagagcccaattgatctcaaatgcacttgaaggggtttcgtcggcccttgtcattaattataccactatgcttatcttttccaccttgactctcgaatcttttgcttctcgggtggtgtgcaattcactcctgtgcaggtaaatcaaggaggaggccggtgctagtgcaactacatcaacatcaagaaaaaggaaaacagaaggtgttcacggctttaattcgtgagactgaggtagtatattatagattccttaattttcctttcttctttctcacccacttataaaagagaaattaacaagaaaggtgaaatattgttaaaataggaaagtagtggaataaattagacaatgtttgtagttaaaattatattgtatgagataaattttgaataagttgttctatgttaatgtgaggaaattcgcagccggaaaggctaataggcgatcgctcgcctggcggtgggttagcgataaacccctccccccctccctccacctggtttccttttttggcaccgcattactttcctattttagtaagtttatgcacctaaagtttaaacacctcaagtttacacatttaaagtttagagacccaaagtttataagtcaaaagtttatatatccgattcaaatttgaatttgaattcaaatatattttataaagtatttctatacatctaaagtttatacacctaaaatttataagtcaaaagtttatacatccgattcaaatttgaatttgaattcaaatattttttatctatagtatttctatacatctaaagtttatacacctaaagtttatagacctaaattttataagtcaaaagtttatatatccgattcaaatttgaatttgaattcaattatttttttatatatagtatttctatacatctaaagtttatagacctaaagtttatatatccgtttcaaatttgaatttgagttcaaataatagtttataatagtttatagacccaaagtttataaataaaaagtttacatacccgttccaaatttgaatttaaattcaaataatagtttatagacccaaagtttataggtcaaaagtttacatacccatttcaaatttgaatttgaattcaaatttaaatattagtttatagacccaaagttcataagtaaaaaatttacatacccatttttaaatttaaatttgaattcaaatatttatggtgtagtagaaagagaagaagggaggagaaagggggaaaggagataatgta

SEQ ID NO: 8956 - DNA, 172 bp, Oryza sativa
ccatccgtgttgtttgagaagcactcacctagtcgttttagaaaaagagttcaaataaacccaattgcaaaaacaacagccttcccttgaagcctgcattaaacacttatttcccctggcttgctgagtactcccgtactcacccttgctctatataaatatcccccccagt

SEQ ID NO: 8957 - DNA, 1501 bp, Oryza sativa
ttttgacggacgaaggaaactcttatttttcttaagtagtagagatagagatatataagtaccgtgtcaaatataatatgattcgactttttttttaccttgtcacatatatttttttttttgggaatccgacagatttgtttttcttttttttttttgctctttttttaccacgtccacgcggattcttttttttctggccggtcttttttttcaccttgtttttttttcgctcgttttttaggaatcggacagattccttttttatttctttcgctcttctttttaccgtggaatcagattcgtttttcttttcctttttttcgcccttttttgatcggacgttcttttctttttttttttgttcggattttttcccgttttgttttggatcggacagatttttttcgtccggttttttttatggacgacggaagcacctattattttttaagtagtagagatagagattatattgtgttttaatatatttaaaaacctatcatattgtttcattttttaaattaacattttggacatgatttctgttggaattaatagatgggctaaggcccattcgaaaattaattctttggaaaatcacaaaagctcacttcatgggatggcatgcatgtggagtttagtaccaccttacttattctaggaaatggggacctccttaaaagggaggatgccctcctagccatttgaagcatgtgtggtggagagaagaggggaaacacacacgctcgctcgcctggcctggcaaggcaggcggtacgcgtcgaatggtccgcaaaattggctcctcacccttgagcagatacagcctccttttgcagttttattccgaaaaaatacggatttgttttgttttggaaacattccgaaaaatccagtgcgtgaaaacggcgtggtgtccggataacttacggccagttcggttacgcgggcgccctgatcaagcgacctatctctatataaaccgagccgtcgccttcacgcaacacacgcgaaatcaatctagggtttgcctcctactctgtactgcgccgtcgctcgtagactactccatcccgctcgccggcgtacaccggcgatcgggagagcaggtctccggaacctctgtcttcgacgtcctgaaccgggagaaggcggcaataaggtttttgggaagcttttcgcgcgactactccttgttcgtccgcgacggctcgccttcctctccgctcgcatgctgcgcgccttcgtcgacgcccgcaaccgcgagtagttcctgacgagcaaccggtctttccgccacctcggtacgtgttcgacatgttgcgcatatttgatctgttcatgttttactgcttagtttacatgtgtagatataatgatgcgttcaatctagtttacatctgcaatgtcatgatttatttatggaataaattaaatcattatgtgcttataatttcaacaatccaaaaaccttattttaggcgctgtgattttacta

SEQ ID NO: 8958 - DNA, 1501 bp, Oryza sativa
gattggttcagctagcttaattagctctcgatatcacgatcagcttctctagctacctcgatagatctagctatatatgttagtgtgttggcatggcagtggcacttaatttatgaacaaatatcggacatttataatttgtttcatatatcgatgacttgttgcatgcaatagctaaatattataggatctatcgatcgggtggcccggcccgatcgatcaatcgatcgataaactgacaaattaacaccagtgttagtacagtaattcacatcacatctcagttagttggacgacgggcctgggcacccccagactatatactcctttaaattgatgcgtttgcgtcgtcgatccactgctcagctagttcatgatcatagtggaagcgggccttaattattaattaattaagttaattaatataaacaagcttctactactttctccgtttcaaaatgttgctagctaggtacatggctacatacaaatcacacactgtgtatgttgcgtgcagtccctccgcagattctataaacgcgcgcatttatgttttaaatagagtaaagtccatcaccggtccctaaacttgtaccgttgtgtcatcccggtctctaaactcgcaaatcgaccgttcaggtcctcaaactttgtcacgccccgaactagtcccgaccgggactagcccgtgacgctccaatttaacctgttaatcgataccagtcccaggaaacagtgctggtatcacagggagacagaatatcacagcaacagaggtctctttattatagagtaggagtacagtcatgttgggctgcggacagatcccgagctcacaactgcattacaaaaggaaaacggaagccaggacttggaccattcatcacaggcgcgacttgggaactaggccgaaaccctaaaactcatcgtagccggcttgctcctggaagaactcctcatcagcaggatccgcttcatcttcttcagcaactgggggggatatttatatagagcaagggtgagtacgggagtactcagcaagccaggggaaataagtgtttaatgcaggcttcaagggaaggctgttgtttttgcaattggttttatttgaactctttttctaaaacgactaggtgagtgcttctcaaacaacacggatgggacagtgcgtctcgtccggtcggagtatgtgcaatgtatcagtctttaggattgcaacaaggttggcacccggccaacagcttttcaaacggccacccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagaggggggggtacactttacccaca

SEQ ID NO: 8959 - DNA, 1501 bp, Oryza sativa
caaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatggtttatatatatatatatatatatatatatatatatatatatatatatatatatatatatatatctactacttaaaaaataagaggtgcttccatcgtccgtcaaaaaaaccgtgtaaaaaaaccgggcagaaaaaaccaggtttatccgataaaaaaaccggaacggaaaaagaagtccgatccagaaaaaaaaaagggggcgaaaaaaaccaaaaagcaaaacggacggagtccgatccaggaaaaaaaaaggcaaaaaaaaaccaaaaaaaaccggacagagtccgatccaaaaaaaagccgaaaaaaccgacaaaacaagggacggaaaaagccatgtttgtctgataaaaaaacaaaaaaaataagtctgactcctatatccttaacagtaaaaaaaaaaagttcgactcctatatcaaccaaaaaaaaatctgactcagattggtgaaataaattgatgtgccggattgaagatctgtttgcaaaaacggaatctacatgtcgagagcattccatttttatatgattttaatttttggatttgtaattttatatttgagtccctgtaatttttatatttgcatttgagtccctataattttgcaacaagctacttgaggttgtttttgttaaaaaaaataaaagagaaagagaacaaaggcagaaaggtgcataaaaagaaaaagaaaagccaaaaaaaagtctgactcagattggtgaaaaaaattgatgtgccggattgaagatcggtttgcaaaaacggaatctacatgtctgagagcatttcatttttatatgattttaatttttagatttgtacttttatatttgagtccctgtattttttatatttgtcgtatattctcctgtattagaaaaaaagcaaaaaagaaccttcgaaaaaaacaagcaaaaaaacgtgtgagaaaacaagaaaaaacacacgagaaaagaaaagcaaaaaaaggagaaaaatatggttttcttcgtaagtgaaaaaagcgaaaaaaaaaacatggtaggagaaaactgttagaaagaaatgcgccttttcaaaaaatggtttgagaaaatcgcgcaagaaaaaaaacat

SEQ ID NO: 8960 - DNA, 597 bp, Oryza sativa
ccgcctgttgggttccgccgcgtctcgccatctgagctacaggaatgtccaccggcatctaggcgtcgttgtggccgctccccggcggaaggcctctgctggtcggcggtctctgcatcacaaccattgggcgaagcgtctccgccggcctccaagcccgtcaccaccgctaagtctcgatctgatttgagttttgttactgtatgtgttttcccttctcaatttcttagtgcaagactgcaagtgctatctcttttcttagatcccgtgaaatttggaattggaagctcaactacttctctcctacatacaacacattatccatgggatctacctgatgggcaagatttcctgtgatagcgctaaaagatttttggtgcattagacctgctagatgatatagcactgtcaatgatgctaacaccaattaaacttattcagccattgagtcgaatttgataccctgactagttcatgccatgtaatgctatatcttttttctctatttatagtgttgtaattatttatgtttttcttctatgttttttattttttttaaatatatatagacatatccccgtatcggtgtttttcaga

SEQ ID NO: 8961 - DNA, 313 bp, Oryza sativa
aatcaaaacaattcaattgtgagaaatacataaatattcaaatcaaacatttgaattctcaaagcccaaaatgtatagattatatttcaattcaattccaatcccattcacttttgcagtttagcccctccctcttcctctttttccttttcttccttctctctctttttctgtctgtcactgttcatgggccatcatctattcgatccggtcccatgaccgcgcccgcgtcctacccgcatgccgcacgccgcgcctccctttcctcacgtcgcatccatccgcttccaggccgtgcgccgcttgtgggcca

SEQ ID NO: 8962 - DNA, 1501 bp, Oryza sativa
gcaaagaaaataagtaagaaaaaactaaagtttgataagaaactaaatggatgcatatatttggcaactctaccaagaaatggtatggtttgaaatgacatcaatcttaacacgcccttatttttaacgggtgataagttacgacttataagagatgacttatacacccgtcacaaatgactcatcgacaggtgttcatccatcacagatgagattttgtcatcacaaaccacttaacatctctgacgaggacagtttaagcccgtcagtgatgacttggtccgtcgtattatttacttggtgcaaattgaggacatcttaaatgggcgcacaaaacatttaggctatagcaatacaaaaagcacgagttttgaatttgcgtaatatctacatgcatggttgataccctaattctgacactggtgatatttgatcatactgcatgctgagatttagtccttccctaagtccactatagtaatttaatttttacattgactctctttcttattaaattccgaccatcccatgtttagatggtgcttcacttattttgctaacgctaaggagagaacacattaagggctgatttggtttgaagccaaaacatgccataccaaaatattagcattttaaatagtaattttggcaatgtcttgtttgctactaatacttgccaatactatacaaatgttacaaaaacttgcctatgatttggcattgcaaaccaaacaatcgctaagtagtttgctattgttatgcgcaggcaactacaagtcgggcacatgattttcatcctaaaaatcagacgatgtttcagtatttatagaagaatgtttcaccactagcttaacacatgtttcaaactattaaaatgatgaaacactgttgaatcatggattgaaacacttcgttttggaacacgaaacatcaagcagccggcagcagcaggctagcgaaacgatgtcggtgccaatgaagcgggggtgatgggactaggggtttcccaccggtagcagcagtaggccagagaaacggtgttggtggtgatgaagcaagggtgacgagactcaggggttcccaatggcgcacagggaagagaaacagcttcgccctcccatgtgagcgtgggagagagaaaagggggtgtgagagagagagggagtcacgggtggctagaaaagaaaaccatgatatttcgttatcccatcagatgcacgatagctagcattctcgcggttataccccctaattgatcgcacacatatatctatctatctatctatctatctatctatatatatatatctatctatctatctatctatctatctatctatctatctatctatctatatctatctatacttctatatctatctatctatctatctatctatctatacttatactaatcgggcactttttaaaagctctcacgttaattagaaaaatctgaccgttgatttgattaattataatatcttgaccatagattatc

SEQ ID NO: 8963 - DNA, 1351 bp, Oryza sativa
tggagtcctctaccatcgctgacggtatctgcctcccccctcaccgagaaccttgcaccagcgctcaagccaccgccgatcctagggccacagtccccgccgccgaggaagtcttctccccgaactaccaggctaccgccgccagtggccgctgcgtacgggacccacctccgtcggatctgccatctcgtagctgaggattggttgttgacgcttaggctgtcgttgtccaccgctagtcgcgccgccatttgaagggacgccgtcgtcgacacttcgccactacccgccgccctcccgatcaactttactgccgtcaccgacctgcacaactagactcgggcacgttccgcatctgtcctccaccgcccaccttcccgatatctacaccgccagatctatgggcagtaaccccaaccccaacgcctccccctcccccctaccccctcgcataagggagcaaggtcctcaccaaggaagccccgcctaggggtggcaacaaggcggggtgggtccaggttgagctggattgccccgcccccaccctcctacgggtatccccgccctcggccccacaatgaaagttggatgaaaagcatcacccgtcccgcccccacgggagacccggtgggtgaccggggccccgtatcacttggatggagttaatactctataaaaatattgcaatacattaaataatagtatgataaaatttcaatagccccagttgtggggcttgattgaagaaaggaaagggattacggttgagaggaactagggtgttgagcttttacatgtcaattctgaatgggcctgttgggtctatagtattgcaatgggctacttttagagaattaactcacatccgggtccccccggtcacccgcaggttaattccgatctctgccctcatccacactcacccactggtgagaattctccccctgccccggccccgtaggggcgggtcccaagccccgcagccgccttcctcacagctggttggcacgcaggcggtcttcttggcggcagcaaggcagcggagaaaggagactatttcttcaacatgactaatggtcaagcaattacacaccacacgcccgatgcgtacatatagcattgtccagggagctagtaatatattactatttgcgccataatttgattagtagttagtttcatatgagtataccaaattatctacaataattgtcgtatttgctgagtattctctttataaggctagttaaatttatatttgcagtgtgatgcatcggtcatgtgtgctagctatagcatttaggttactaaagttgtaccgatgtcgctgagatcactgtgcttggactga

SEQ ID NO: 8964 - DNA, 1501 bp, Oryza sativa
ttccctagtggagttgagccggagcaaagtttggattgcgaatcattaattgtccttgagtctcagtgtaccggacggtccagtgccacatcaaacagtccgtctaacggatcatgtgttgatgaaagcatattgtgtgtacgtgtcaggtaggccgttgttgactagatagtccagcatgttttcttccaactggaccatgtgtcgatccaggccataccgtgtgtacggtccagagaatccaactgcgtgtcagactgtctggtggatggatcgttcgaccagaccatgtgttggtcctgaccgtgtttgtgcacatggatcggacagtccgacagatgacggatcgtgtggccaaacaatgtgtttgtctgagttaagacattacatttactggacagtatggtgaaaatcaggcaatccactcaaatcacatggaggaggcctaaggattatatggattggacaatctggtatgcaaccggatagtctgccttatacatgggtcggatatatagttttgatatgagtaaattgtccggctttttatggtctaacggctagttacatgtgatgattgaaaagtttatataaagggacaaacagtcctacaatacatcggactatctaaatctatgctttttttttttttgcaacacacttgcaacgactagtttgagtggttagggttataaatacccaattgtttagacttcccctctagctttctagatatagtgttaatacaaggaagcatcatcttgttattgttggcatctcgatgcgcctaaacggttgtggaggtggttcctgtgatctctcaagaatattgtggaagactcgggtgacgtgtggggcttggagctcgctatccaaagttgagaagagctagctatctctcgatagtgctcgacttcatgaccatgagacttttgtgtacagtactcaacgaggactagtagagattgccgaatttccgatatctcaggaaaaactcgttgtgccttggtgtttgcaatatctctttttctgttcttcacttgatattcttattagtttcaatatttagcttgttctagaattgttaggatttcaactaggttgtagaacttgggctaactagcttttgaacctaggcacataagctagattttggagttgctcatattgatgtcatttcaaactatactatttttttaaaagttatcaaatatgtgcatccatttagtttttttttaccactctgttaaaaacataagaaatcataccaagacttagcaatattgccaaaattttgacaatgctaaatttggtaaggtttatttgactataatctgaacagaccctttattttctgaatttaagtttaaattcggccacatctttgatccacgtcttagagcatatatcgttattccccccctgacctacccttttctttgtacgcgttaagcccaatgtgttgggctggtccaaagttattgtaaatactccctccatt

SEQ ID NO: 8965 - DNA, 1501 bp, Oryza sativa
atgaatagtgtcatagcttcataggtcagatagttcgcatgcctatgaatttatgtgctatctcacaaattaattgagaaatattgtgggttatctcacaaacgagttgagaaatattgctcaggtcaagcaagaaaaatcttttgagtgttcagacttcgggctgaaaagggaatcgttacaaatagtttttgctagcttcatttcatgaaggtttgtcaacatgctcaaatgacagacgtacatcctaatgggtaaaatactgaatgatggagtaaatagcatgggaaaatacacacctctggtgcaaagccctcaatgtggtctttctccttctgtaggacattctcagtgacaaacaatgggaaataataaggtttcagcttcagcttttttatttctgcatcaaagaattcctgcaccaaaccgcataggacttagggaaaaagaacatgattatagtaatgccattttacttaataaactgcaaacaaagaaacaaaggcaagatccttgatgctaagaacgacacttttacacaactcaatcagaagttactgatgatataaaatagacatgttgagataaacttattagtccaaaagggcatcagaattagcatttgaaaagctgatttgttaatgtgatgtttgcagtaactgtcaatcagggaaaaggagtgcataaggttgacaagataaatacttcaggcaacactctagaccaacttgtggacagagattactttttgttatcatcactgatgcttaggttacaagagtacaacaggcaacaatgactacttacatttcattgcaaagggaaataaataaaaattagcatcttgattaattgaatttaagcaggcattgagaaaaaacttactttaagcaattcccagatctccatcgcccatggcctcaagatataacaaccggatatgtcatagtactcgatcatttcactgttaacgacaacctgaaggaacaaaaagtaaaaaaaaaaaaaaacttctataagccccctagcaagaatgagatatattttgaatttgaaaaaaaaatgtttgagcttgttgttttgttttggatggcgattaataaatggataaatcaaccaataacagtttagaaacagaatctgtgtgttccattctccagtaacagctacgaaataacttatatagttaacataacagtatcatatccttggagattactaattctctcttcagcaacagcatttgaatagagtaaattgacccagaacagtttcagaaaaccagcaatagcaatagcaactaacagaaccaccaacatttgcactgatgcagaagtaaatctctgttaataaaagttcaaacgattagctaccaacactccctgccagaacttgtcacacgcatctcgaatacatcaccacctttaaattcaattccacacatgaacacctcatcgcacccacattacattaaaattcacccaaatctaccaacaaaacc

SEQ ID NO: 8966 - DNA, 1501 bp, Oryza sativa
gtcaaacattttaaaacgaagggagtaacagattttgccataaaaagaagtggaactagcctgtacgtatcttcttaaacaccgtaaagtccatgttgtatatatagcaacaatgaaaaataacgagtagattgcaaccacggtttaacaacttgcttggtggggtatgatataatttaatttgagaattacgtctgagtggaacaacttggtaagtgagtacattctagtaagaacttgataatgtagtatttttggtacagcaacttagctaagtatgtgatgttttgcttaacgagtgctaggtgagttttctcaaatgtcaatatggcattacatagcaatcttacggatattagaattacattgcaaatccattttgcaccactggtttggattttttttttcaccttctcaaatctaaatcggattataatattttctatatagtaaagtttaaataagtacttaaaattgaatttgtataaaaaatactcataataattaagttatcgcatcaccaaaattgcaccaactttacaacttatcgctcacttataaagttcttacactaattacacccatatactaagttattgcataaggatactcatttctcaaatttttgcaccaaattgcaccctcgttaccaagttgatgcatcgtgaatgcaatttattcacaaaaataatatagtataaaatatattcaactttacgtttaatgaaactaaggtggtgtttgaatctcctgaacataaagataaagataaagattaagtgtttcacgtaaaacgagatggtaataacgtgtgattaattgagttttaattattacaaacttaaaaatgaattaatctgatatattagaacaactttcatatagaaagctttcgcacgaaacgcaccgtttagcagcttgaaaagcgtgctacgagtatctaaaagtttatccaatttttattgaagaaaagaaccgggcttaattggtgttggagatgttgctatatttttatataaacatgatcaaactttaaaaattttgatttaaaaaaatacatcttgtaatatgaaatggatgaatgagatttatttttcgggcaaaacaacactttccgttaccttgcaaattttaatatattaataagtatttaaaagtgcacagaattaggaatgcatatattggtcccaaaaccaacaaaactaccacttacagtaagatcaaaggtatcgttattttttttaaaaaaaagtatttttttccttttgaaagttctattgagtatttgtaaattgtaaaataagtgttcttttgttggatataagtataactgtaaatttgtaatgggccggcccatatagaaagcccaataacccatgactaccacttagaaagcccagctctaaaacccccttccttcctcagacgagcgggaaggaaaccagcagagacgcgcggcgaaaggaaaaaaaaagaaaacaaaaaagaaaaacacgcgaaa

SEQ ID NO: 8967 - DNA, 1501 bp, Oryza sativa
atgtttttttttttttcggtcttccttttccttcggaatgggatgatggcactactgcgctataagtagaggtctgaaacgcagcacaactcttctttaattttttttaaaaaatttacgcagtacaacgcaatcactcacaacacacgtagactcaaccctatgaaggcacacagcaaaccctacccctatgagcaccacttttaaatactaattatggcgagtctagaactctggattgtatgtggtatagaatatatttatagattggtatatatttattattggaatagaatccatagtatattttctctgggccgataatacttgtcgttctatacaagagtgaggttaaattttagaatctttaattatgaatcatttctaaaatatttttcattcaaatatagtgactacgtgtatagattagtcttaaaaaatattttaataaaatcatatacttcctccatttcacaacgtaagacgttagttctatatatgtgtctagattcattagcatctatagtaatgtggataatgctagaaagtcttataatatgaaacgaatggagtatttgttaacagttttatacatattataatagaaaataattatcaaaattggtttttaaagaccgtgctctaaatattatcaacccagagaaattacaagaaattgaattctactcttgacgattagctttccgcataactgttcatgaaaacctgctagctatatatcattaccagaatacgtactacgttttaattttttggagtgagaactttctgggataccaaaattctaaaaagaatcatgtcaaaaaaattttcaaaaagaatcagcatctatctattattatataaaaaaaatcattaaacttcctataaacgctcgcaagccgccatgtggtactcctacaaacgcttctaagatgtcatgtggcgctctaataaagaagaaaaaatcttacaaattctgagaaaaaagaaaaacatccaaccctcgattttcattcaattcggtggacccactattttaaaacaattatatagatttatttaaaatacatcccacgtatatatactgtcacgcacagaaatttagcccaaatttccggaatatcttgtgtattaaatctctgtccaggaatcagccaggatacacaaaacaataaattaatatatagatccaaacgtaaataaagcgtaaatacttacagaagagccggttagtcctcacaccgaaaagaaagtgacagaagcgaaaaaaggcgatcctagcggggggcttcagctccactccacaggcaaaactcaactagggtctgagccttggtcctctaacttcgtcttcagctcaaaagcgctacacttctgaaaagggagaataatagcaaggctgagtaccaccaccgtactcagcaagccaaaccaacaatcgatgcagacatgcaaggggatacaaagaggggtttgtggctattgatataaaggtggt

SEQ ID NO: 8968 - DNA, 1501 bp, Oryza sativa
gatttaaattattgcattatcgctttatttaaattcccgcgttatcactgttttatctagccatgcctatttacctttgttatgaccttattattgttattgttattatttccttgttcaccctagaataaacaaaaccccaacaagtggacactctactcttggtaccactggtatgaatttaggtagatgcttcgctggttaattaggcaacattaggtggttttacatctctagactttgggaattttctcatcacctggacactatggaatggtttgattattgtggaattggattcaccccgccccctctattcaaaattcccacaatggttttaggctgggctcggggtgcatggttttgatagtagcacctcggcgatataaggaccggtcttcgggcctctgttgcaaagcactaccgtacttccacatgtctagttggtaaggcttagtttgtggctcagcctggttataaacaaaagtacacggatggagatggacgaagtcgggggtcgatggacatctctagggcaaatgaaggctacatgagctgcggcccggtagtcgagatgtcatggcacagggccggtgtcctgctgctaggggctcagtcctgcctacctgtcccgggggttccagccgtaggtgggattgggtcggtactcttgtctatggctaggatgggttggaaactatgtcacgtcttccgtccgtataccgtggtggtatgtggcacgtggctacacgtgaggaagatgtgtcctgtgggtaaagatgtacacctctgatcagagtataatctattcgaatagtcgcgccctcggttatgggcaagccgagcaatgtacccaagttagtgttttaattcttaaaacctgtttaacaactaaaatgtggaatggttggcctgggttggcttgggacgagctgggacccagggtcgggttgccagttcggtctgaatcttcgtaggccttgggttaaggcaagttcgtgtgggttcacggctttgtttaataatattgtatagctctaggaccgtatttacaaaatagctttgagcaactaagtgtcttttaatgctgtttactgcaaaccctaaccctttatattataactcccttgtactcccttgcatttattctgcacttgtgggtgtgtcttgttgagtacggtggttgtactcagtcttgctcaatttttcccaaacccagaagaggagtccctggaagatgaaggctttggtgtctagctcgtgcctgccgtcaagcgcctgtggtcgtcgccctagtcttccgctgtttctcgtttgtctttgtgtgtgctgggccttcgctgcccatgtaataaattatctatttacgcttccgcttgttaaactctgaactgtatcaacttttggtgtaccttgcctcctgggacaaggaataatgcacgcacgtaaggaacgcccgttgggttatttccggtcgtgacagagaacttgactaataatt

SEQ ID NO: 8969 - DNA, 1249 bp, Oryza sativa
accacctcccacctgggcgccgcctccttgggcttcgccgcgtcctcgccgacctcgtccacctctccgtttcggtcgccgaccgccggagcaccgtggaccccgtccacccgagccgcgccgccgccttcctccgctccggtcgccgtttccgtcgtcgccgtcgaacaggggtgagccgtggaccgccgcttcatttccccctttccctcccctctgtcggccgccgctccgccgtgcctatggccgccgccggcgaccataggggcgcgggcgcgccgcctcccgcctttgcgccggcgtggccgccttcgggcgcaccgagcggctgccgcgtggggcccggccgtcagccgcccgcgccctcgggtgcggctgacgcgtgggacccacggcgccggccggtgcgagcccgggtgcgcccagtccaccgtggaccgtgaggctgccgcatgggaaccacccccgtggacccggtccgcgcgccccctcccctcggctgacgcaataaaccttttttttaattaaaacttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaacaagtggacactctactcttggtaccactggtatgaatttaggtagatgcttcgctggttaattaggcaacattaggtggttttacatctctagactttgggaattttctcatcacctggacactatggaatggtttgattattgtggaattggattcaccccgccccctctattcaaaattcccacaatggttttaggctgggctcggggtgcatggttttgatagtagcacctcggcgatataaggaccggt

SEQ ID NO: 8970 - DNA, 1501 bp, Oryza sativa
tttgttaagatgcccttgctattttcttatatgctagattttctccaccttggatgcatgtgacactatatatatttcaaataaaaggcctcgtggagttcaaattgatttcggattgtaggagactactcactgtttatgcagagtgcgtgagacttcacgtggcctagcaggaatataatttcctagcaaaaaaacaattccataaaaataatttttattgtggtgtggactttttatgattgccatcatgagttaaatatttttactctaaatatgatttatatacttcaaatgatcactctttataattttcctttagctaatgtgcattggccatttagtaagtatacataccctatacacacaaaatttttgtatacacaccgtgcacaccaactacaatcacaaaaaactgtaaaaaaaaactatgcatgtactttcaacagtacaacaaaaactgaaaaaggatgaagaaaataagatgatcttaagagataaaaaacgaatctggacatttgtttagaaatatttatatgatattgaatgaactatttattaggagataatatatgaaaagttggctagatatagtaagttgatgggctttttaggcccataaaaaagtatttaattttaatttttatggggattaaaaaaagagaggaacggtagttggagggatcgttgcgcaccaaggctgatgtccggacggagattttctttccttgtgaagtaaatctaacgtccaaaattaaaggatccaccaatttaaatgagaatcaattgtcttgtcagatttttactattttgttatagtgacacatgacgatttgagagtatttataggatgccacatgatagcctaggaacgtttgtagtaaatttaatggacttttaatataatagatagataatatatacatggttaaaattaaataacactatgatatctactacaattataaatgggagtacctatacatctttcgaaagatttttattatcgtatcacacagatttttaatctttagattaaaatccgatagatataataaaaagaaaaaagcaattaagaaacaccataatggacactaaattaccatatcctcaagaaaaagaccaaatccaatacaaaatttaaaatttacatgcgaagattcaaaaattatagtgtaacaaaagttacagtataagtttcataaattacactgtaacttacaagaaaatgcactgtaaatttgagtgagaaaatcgagtgagagataagaaaaaatctttcgagtgagatatagcaaaatcgattataaattcgaaagttattcaacaaaaaaaaactatcgaattacaatactgcatatgaactctttattcccagcaatttctggttccataacgaaatgcggtgattcttcgagccctctacttatatatatgatgtgtcccctctgtccatgatcatattcaaatccaaagtagaagatagctagaggcagtgtca

SEQ ID NO: 8971 - DNA, 1101 bp, Oryza sativa
tggacagaaagctcgtggctcgttagctggctcggctcgtgacaggctcggcttggttcggctcatttgaattttctaacgagccgagctggcattttagctctttagagataacgagccagctcgagctggctcgcgagccttaacgagttaggactccatcacagcccaaaagcccaatacaacaaaaaggcccaagcccaagacactgcaaaccctatcctcactcctcactcaattccccactctccccagcagccgccgccactctgcctctcccccagccactgccgctccacctctcccccagccgccgccgccgctccgcctctcccccagccgccaccgcctccgccgccgctaggagatcgagtgcccgccgccgctcgtctctgcctctcccccgcaagcgcccgccgccgccggtctcctcctctccctcgccagcgcccgccgccgacgggaaatcgagcgcccaccgccgccggtctttgcctatcccccaacacccgccgccgccaggagatcgagcgcccaccgccgctgatctccgcctctcccccagcaatccagcgcccgctgccaccggcgctcgcccccagcacccgacgctgccggcgaggggtaccgagctcgtctcctccaagtgccggcggagctgcgtcgagttcatcccctccaccgtcgagctcctccctgtggtcgccggcgagctcgagctattttcctccgccgtcaagatcctcccctcctccccgtgcttgccggctacgtctcttgcccctagcttgcgagcgctaaacgcgctgtctaacgcttgtgacaagacccgccccactatgggtttaggttggtaggaaacaagccgagccgaggtagctcggtttctaacgagccagccgagttagctcgttattctaccgagccagaccgagccgagccgagctagctcgacatccacaccctaacgacaacataatatttgctatcatcataacaataattagtcaaaaatacgatcactcgtatcgagtagtaaacatgatccacaataatatagataagctacatgttagcataataaatagtacgtactactgc

SEQ ID NO: 8972 - DNA, 764 bp, Oryza sativa
cagtaaagctttaaataactgcccgctgacttttttatatagtcaggcggctgttttgttttatcaagcaattgataggatacaatattgttgctttttgccatgtaagtgtgcatttttattgaccaatattatggcttaggctgattatatatttggtcattttccaagcagtagatatatcacttggatcatgttattcgtggattcacaccgcatatgctattaatattaagttacttggttgactataattataaaaaccgctcggttggttggattatttactccttgactatatgtttagtttgttcaactaatcacatagtcgtgggctacacctattaggtgcatctagtcgatgcacctaagtctatattcaatttttttcagccctccacagtcttcagatttggtaaaagtactcgggagaccattgcaaagatgattgaagcactcggctttagagtaatctggttcaagagaagattatcttttcgactgtgaaggtctcaggggctactgtggagattataggtaccccatacccacacggcatggttatccgactagttataggggataacttatatctatggaatatgtaacagatcatgacttgggtattacgtttccttgtatattatggaacggcctaaagtcctgatttgataatattgtaaagtagatttaggaaactgataccatattagttaatgtttctatcctatataaggtgggcaggaggccctgtaggtggcaga

SEQ ID NO: 8973 - DNA, 1501 bp, Oryza sativa
gatgtgttttttgtaattgtgttcttgatggggatgagtagttttgatggttcccagtagttgggaagaatattcttgatgttcatgttcattcgttcttggatgttcttcgatgtgttctcggcggggtgaatgggagctgctcgatgcctttttttgattcctaaaacctctctaaggtcccggttttggaacccgcacctttgatttccctcatctttgccgcttcctagatgccgaatgggaaatcgaacacctatgacggattcccaagtggtacctatccatgtttctatggtattgtaagtttatgttgttagattatttacgtaataaattgtttatgtggtagtgtaagtttatgttgtcagattatttatgtaataaatttacagttaaaaacctatgtttattataagtatgtcagtattatggatacatcttatgcgaaatcgcaacaccctttaattatctttaagaaaaattcacctcccaaaattgatcatagataattataaattatttatagcgatgtattaaaatattatatattataaaagctaacaaatagtatctaagtaacgaggatgaagaaaatttatggcgaaataatgctttggaaaaatgacaggtgtcattcggttgatattccatctatataagtttttcaaacgcaatctaaaatacaagcccgcgcaaatgcacgggctacctttatagttagctttaatactagaaagtagtcgtgcatgctttttttatagcccgtgtgttatctaatgagttctttttaatttcaagcttttgaaaggatttgatgtagaagttttgcactaaaaaatatatcaagatgatattaaaaagagtagtgctagatattaaccatcaaatggaaaagaatccctgtaggttgatgttgatattttagagtagaaggttgtcatcgcaatcataccccacccccatagacacatctcggtcgtttatgcatcccattattccctcattgataagtacaatataataacaattgatatatatatgtatttaattatgtagtgttgtgctagtaagatcattttggtttcgcgctagtaagatcatcttatcgattggtaaagctttttaacgcgatcggcatcattgagtgttagagatggcatgcatcacagcaaagctgaaaaacgttgggtttgttatagggtaacgcaaatggcaaacacttaaggtgtggagattagtgtagagattatgggtaccccatatccacacgtcatggttatcgattagttataggggataacttatatctatggaatatgtaacaaatcatgacttgggtattacgtttccttgtatattatggaacggcctaaagtcctggtttgataatattgtaaagtagatttaggaaaccgataccgtattggttaaggtttctatcttataatcctgccccccgtcctatataaggtaggcaggaggccctctagggggtaga

SEQ ID NO: 8974 - DNA, 1501 bp, Oryza sativa
acgaggaggcaaaaaatctaccaaagcgaagatgaagtgagcgacttacgaagttgattccatcgcacttttcgacaggaaactcggcgtcacccctacctggcgcgccaactctcgaaacatgaattcggcaataataaaaggggtagcgcacgagacctaaaagtagatggatgcggagacaaaggatttagacaggtttaggccctctcaatgagaggtaataccctactcctgtttagggatttgaatccaccgggtgtgtattgatctgacgatcaggttgtgtcatctaccccctagagggcctcctgcctaccttatataggacggggggcaggattataagatagaaaccttaaccaatacggtatcggtttcctaaatctactttacaatattatcaaaccaggactttaggccgttccataatatacaaggaaacgtaatacccaagtcatgatttgttacatattccatagatataagttatcccctataactaatcgataaccatgacgtgtggatatggggtacccataatctctacactaatctccacaccttaagtgtttgccatttgcgttaccctataacaaacccaacgtttttcagctttgctgtgatgcatgccatctctaacactcaatgatgccgatcgcgttaaaaagctttaccaatcgataagatgatcttactagcgcgaaaccaaaatgatcttactagcacaacactacataattaaatacatatatatatcaattgttattatattgtacttatcaatgagggaataatgggatgcataaacgaccgagatgtgtctatgggggtggggtatgattgcgatgacaaccttctactctaaaatatcaacatcaacctacagggattcttttccatttgatggttaatatctagcactactctttttaatatcatcttgatatattttttagtgcaaaacttctacatcaaatcctttcaaaagcttgaaattaaaaagaactcattagataacacacgggctataaaaaaagcatgcacgactactttctagtattaaagctaactataaaggtagcccgtgcatttgcgcgggcttgtattttagattgcgtttgaaaaacttatatagatggaatatcaaccgaatgacacctgtcatttttccaaagcattatttcgccataaattttcttcatcctcgttacttagatactatttgttagcttttataatatataatattttaatacatcgctataaataatttataattatctatgatcaattttgggaggtgaatttttcttaaagataattaaagggtgttgcgatttcgcataagatgtatccataatactgacatacttataataaacataggtttttaactgtaaatttattacataaataatctgacaacataaacttacactaccacataaacaatttattacgtaaataatctaacaacataaacttacaataccataga

SEQ ID NO: 8975 - DNA, 204 bp, Oryza sativa
cgaaaaatctggtgcgtgcaaacggcgtggagtccggataagttacgcgcaacttatccgattcggttacgcgcagtggagatcgtgcgggcgccctgatcaagtgacccttctctatataaaccgacccgccgtcttcacgcaacacacgcaaaatcaatctagggtttgcctcctactctgtgctgcgccgtcgctcgtaga

SEQ ID NO: 8976 - DNA, 1501 bp, Oryza sativa
  unsure (1)..(1501): unsure at all n locations
ggtttttgcccaattaattattgtggtaacataacagacttgccaataatttgtacccatgctgccagtcttagaaatctcggtagatgtgcccgttatatataaatctacaacggcaattttgctccatgtgatcaaaacttatttttccatacggttgggctactcatttgccccaacatatatatgcaaggagatgaggggaggccatcaatggcagtggttcaccagagattgaattcgatgattaaaggctgaatcaagaagggtaaatatgggggaattgatgatgaggaggagagagaatgattttttattcaattcggagtgtaatcatccggggagggaggtcggcgtgccggcgacggtagggtttggtcgggagggagaagaacggcggacttgaggtaggggacgcgcctggcacgtgggccccatctgccagcgcgtgaggggaaggggatgggaaggtggccggtcaactagaccaggacaggccgagggggagaggggagagatgggccgacagctggagatggcccaagagggagggagagaaagaggaggaggtgggtggacaaatacagacttcgctcatcggctggggagaggaggactttgggccgaaaatgttatggcccaaagagaaggagagaattattttatgtttttcatgttaatataaactctgatattggttgttgttgtattaaaattatttttgttgctctgaaaattcaaataaaaatttagggaccaatttagagcatggagaattcaagaaaaatactccaagccagatttcaattcttcttgatgtattttaccttttaataatttatattattccttttaattgggataagtccattttacactgtcgaactctttgctttgtctaaagtgcacacccaaactctaaaaccgggtaaatgatgtttaatttaccccttccattcaaacaagggtggtttttcttaaattatgctgacgtggtgatccaatcaggcaaaaaaaattaaaaacaaataattggtaccacatgtcggatgccacctatctcctacccaatatgtcttccttttcactctcttctctccttccactacgagaacggtgctggcgataagatcgagttctacctcctcgtctcccccctagtgccggcgagctccccgtcccccgtcgttctccccccccgccccccccgncgtttggagtgtcagcgagctcgagctcccccttcnccgttaccctctntacgtctccctgtcccccctctctctacccacgtgagacattggcgatgagctcaatgagctaggcatcggcggtggtcgcgaacaccggtcgcgtcgaccccatgctccagtcgcagatctgggggtggcgctaggagaccggagccgaggttgtcgacgtttgatatcacgactacagtattttgcatagtatgtggatcgttggtatcagggtatatgcgagattaagataaaagaga

SEQ ID NO: 8977 - DNA, 1501 bp, Oryza sativa
  unsure (1)..(1501): unsure at all n locations
catctcttttatcttaatctcgcatataccctgataccaacgatccacatactatgcaaaatactgtagtcgtgatatcaaacgtcgacaacctcggctccggtctcctagcgccacccccagatctgcgactggagcatggggtcgacgcgaccggtgttcgcgaccaccgccgatgcctagctcattgagctcatcgccaatgtctcacgtgggtagagagaggggggacagggagacgtanagagggtaacggngaagggggagctcgagctcgctgacactccaaacgncggggggggcggggggggagaacgacgggggacggggagctcgccggcactaggggggagacgaggaggtagaactcgatcttatcgccagcaccgttctcgtagtggaaggagagaagagagtgaaaaggaagacatattgggtaggagataggtggcatccgacatgtggtaccaattatttgtttttaattttttttgcctgattggatcaccacgtcagcataatttaagaaaaaccacccttgtttgaatggaaggggtaaattaaacatcatttacccggttttagagtttgggtgtgcactttagacaaagcaaagagttcgacagtgtaaaatggacttatcccaattaaaaggaataatataaattattaaaaggtaaaatacatcaagaagaattgaaatctggcttggagtatttttcttgaattctccatgctctaaattggtccctaaatttttatttgaattttcagagcaacaaaaataattttaatacaacaacaaccaatatcagagtttatattaacatgaaaaacataaaataattctctccttctctttgggccataacattttcggcccaaagtcctcctctccccagccgatgagcgaagtctgtatttgtccacccacctcctcctctttctctccctccctcttgggccatctccagctgtcggcccatctctcccctctccccctcggcctgtcctggtctagttgaccggccaccttcccatccccttcccctcacgcgctggcagatggggcccacgtgccaggcgcgtcccctacctcaagtccgccgttcttctccctcccgaccaaaccctaccgtcgccggcacgccgacctccctccccggatgattacactccgaattgaataaaaaatcattctctctcctcctcatcatcaattcccccatatttacccttcttgattcagcctttaatcatcgaattcaatctctggtgaaccactgccattgatggcctcccctcatctccttgcatatatatgttggggcaaatgagtagcccaaccgtatggaaaaataagttttgatcacatggagcaaaattgccgttgtagatttatatataacgggcacatctaccgagatttctaagactggcagcatgggtacaaattattggcaagtctgttatgttaccacaataattaattgggcaaaaa

SEQ ID NO: 8978 - DNA, 960 bp, Oryza sativa
aaagattcccctcacacggccacatttttggggggtctataaataccccccacctaacccttttctagggttacccaactcatttcattctcattcactttgggttgagcttggtactaaggtgctttggatctttgagctctctctccctctctcaaatccctccttgttctttgtgtggtggatcttggtggttgtggatttggtgtttgagggcctagtgtgtgtttcactcgatcttgagcgctaaggtttgaccaagagttgtgtggtgtttgttactcttggaggttgagaactcctagatggctaggtgtcactcccgagccaccgatctacgtgtggttggctgggagaagtttgtgaaggccggatctcgcctccgcaaggaaagagataccccttattggaaggaagagtgcttagtgcaacctcttgaggaaagggttagcaaagactcggctcttagtgagctcctcaacggagagtagaatcccctcaaggatttgaactccggggacaacttcgtgaacttcatcattggtgatctcccttcatcctccttttagctttgcttaattgtgccgctatagatctagtcgttgtttgtgctttactcttgtttgtgtgatatatctacttgttgtgcttcattggtggatcagacagtctaatccaacatcagactatctgatattttcggatagtctgactgtggatcagactttccgaccttatttcagttttagcttccgcataaagttttaaattagcctattcacccccctttaggcctaattgaccctttcaattggtatcagagcctaatctcctaattaggcttaaccgcttggagagatcatgtcgggtcaaacggggaatggcaaggatggtgataagggagctacgtttccttatgactatccctccacatctgcatcttatgtgagcacctatagc

SEQ ID NO: 8979 - DNA, 1501 bp, Oryza sativa
ccatctatatcttgtgttccatgctaggtggttcaagtctgagacaatgttctgatcaggagtataatttgacacgtcagtttatttaatttaattaagtaagtaaagaatgtttccaactttccaagtctgacgaaactgtcaccaatgtccctatgaggcggacctcctggtctatttcttctacatagttcatccattccataaaaaattaatatgaaatgtaatatgacacatctagtaatataaatatgaaaaaatatatccaatttcatagtattaagatgtgtcacatcatatactagatttatctttttatggaatgaaagaagtacgtgtgttgtcgttgattatttctttcttctaacattcaaatccaaatggcacccgatcaggtacatagaaccgatcaaaaccgcttggtatttgtgattttctattgactctttatggctcacaccaagaaaccgcccggtaaatatgaggaaattggacgtgtccattgaggtggagcatgaaaaaaaattgggtacgtgttttaccagacccctttttgacggaaccaacctagttttattttcaaaagaaaaattaaaattcaattttgtagtaaaacttcttgtcgttttaaggttttacctattttcagcagcttttaagaactaatcgagaaaaagaaaggacgaacgggttgggaacggtattctgttgtcaaacaattctgaaaaccacgagagataaaaacggcctctcgtatcgcccctcccccacgggcgtcgcctccccggggctcgtctccccttcctcctctacatcgccgctgcccgagcgcggccacaagaatggtggtggcggggcttcgtcctcgcgctggggaatggaaggggggcctgctcgggcggcggaaccgcctagatccatgtcgcccgggcggatctggtgatggggcagctggcggcggggctgagcggtgcggcagcggtgtctagtggcagtggcaacggcattcgaggcgttggcggcggcggaggaaaccgccagatccacgtctggatttggcaggatagcggccggcagcggcgtttagtggcggggatggcgacggcggtgaggacggcgaggggatgtagccagcggcggtgtctggcggcgggggtggcgagggatggcatcgatgaggcgaacctggccgcgccggcggtggatccagtgcctcgaggagttttggacccccggcggtcgcggcagtggtggcgaggagttcacgcgacggcggcgcgggctaccacggtaggccgtctgtgtcgtcggagctcgtcgaggataagcaggtgtgggagggtggcgagatggcaatggggattgaagggcagcggcggctgcggtggtggcaaccgtcaccgtggtccggggaggcatggcggtcttggacggctagccgggggcgtggcagacgaccgcacctagccggcatagcagcgtttggaggaggggtcggagg

SEQ ID NO: 8980 - DNA, 1501 bp, Oryza sativa
gtttcagtagttggtaatcattctccgatattgggctttccaaacttccaaaatatactaagttgcatccacctgattgattgatgcccaaccgaatcactgaaactacattggaacaaattatttatgcaaggctcaccaaatctgatatccttatatcaacttgagagtctacaaacatttggtatcaaaatagcagagactgccctatccctgaactatctacaaatcccatataaatagcacgcactaccgtaacactttgcttcatcgtcgccaaatcaaacatcggaacaagaacatccaagcccttacttcccagctcccacgagactaatccaagaaacgccgcaccaagtcagtcaagatttgcaaccaatcaataccaccaaatttccggatttccggtcccgtgtatccccaaaacacaataaatatactaccgcgaggcgaaaaaaaaatgtactaacactagagagattcagaggagccctgacctgcatggtgaagttgacgtggtcctggacgccggcgaggtgcttctgcgcggcggcgttcacctcctccagcttccgccggatccgctcggtgatgacccgctcctccatcgaccccgcctggtccatcgagctctctcgccgggggttcctgggttgggggcaggaggcggcggagacggtggccgccggcggcgaggcgaggcgaggcgtgcgcctgttttctttcttggtgaagagggcgagagagcaagagaggtggagaagatgggagaagggtttaagggccgtgggaacgggctagggttttggaggcggaataagtccattttgcctccctcatctcttgcccttgtgtgaataacatcccccaaccgtaaaaccgggtataacgcctccttcatctcttaaaaccagagcaaatgacctccttgagcggtttggcaggcggtttcgtccgacgtggcgtcattgacccggttgacgagctgactcagcatgtgggacccacatgtcagtgtgttgtatgtacggactaggccgagctgagtcagcctggaaggtaaaattattggcgtgcggctcgcatctctctctctatccccatttcccccctttgaccaaaacccttgaccgacaggcgatggccaaggcgacgtgaggtgcggcggcggcggcagcggctggtgtggagcgcggcggagcacagcgacggctggtgcggagcgcggctggcgatagcgagggcggagacgactagggcacaatccgtggcgacggcaagggcgcaatccgccgagacggtgaaggtaggagtggattcgcgaatagaggtggtgcggtgatggctagttcccagagcgacgggtcatcgtcctattctcagcattcatcgaggagtcccatcccatatagggttggtccttttgattaccagtcggccgtgatgtgcgactgtcgcgtgaaggctgcatggtggatctcgtggagtccggacaacccca

SEQ ID NO: 8981 - DNA, 1501 bp, Oryza sativa
atttgaaaaatgattgtaattctggtcaattatgctcaggcgctacagaaatgactgctcagaacgaaccatttcagatttcacaacggaatgctaaatccccgaattccacacccctaacaccataatcgatccgatacggcgacacgagacggggagaaataaaagataggatcagttctatctatacactatcaggtcaacccggatacgacgagagttccatcaaaatggaggggagctcccatttccgtagtccttaacgcccagaaacccaaatcaaaccggaccaacaaaaataattttcgagcaggtacggatcttacgagcccctggggcttggcggaaccggcgcgacgccgccggtggccggagagggagcggcggcgccggcggcggcaacgacggccgcggggcgcgacctcggcctcgcgcccccgcagactgccaccgtcgtcgggcggtggcgccgggcgcgagcgggttcagcgccggccaccgcgaggcgggaggcggcggtggcggtagccatgattgggagcggagggagggagggagagatcgaggaaggaggaggaggagaggcggtgggccgtgggggggtttaggggggatgagtcagatggtgggccccacattgctcgccacgtcggcatgtccggctttggcgctggcggagattgtctgcgtctgcgggtggagttcacgcgaaacgaccacgctaataattccatgtaagagcaagtttaatacttcctgcgtcctaaaatatatagccatttttaagtttgatatgggtattaaaaaagtagataagaatgattggaaaacgtatgtgattggtcgaaaagaaaaggtaagtgaagaacaatagttgtgattggttgagagattgagataggtgaaaaactagcttcattttgggacaagacactatgctagaaatagctatattttaggacggaggtagtagtataactaaatgttaactccaaatcatctatagataatctaacagcccatttatataatagttacctataaaaatatagtacactattaatacctggtctcacttctcatacacacacaacgtcttataatccgtgttatagctggctataaatctgtagcccgctttctctcttcccttttcttctcgatatgtattatagctagcttataccttgctattgtacttgctctaagagcaagtagccgactactagcttcaaatcaactataatcacaattcatataatagttatctataaatatatactacactattaatacatggtcccacctatcatacacaaattgtgtcttagagtctgtggtacggttggctatagatttataacccactgttcttatttctcttcttttatcttctcgatatgcgcttatagctggtttatagtctgctgttatacctgttgtaagccgcagggttaactagacaaaccatacggtcgtactgttcttttatttactttta

SEQ ID NO: 8982 - DNA, 1501 bp, Oryza sativa
tcggtttcggcaggcccggcggaaggcacttcgtggtatacctctaacaatttctaattgtatttctatgtggactctaaactcatctttcaatattctttaatttttaatttcgaatttcagttacttctaaattgtattccaatattgactttatactcttcttcccatgttttgtttaaattcctaattttaaatatttgtaaattatatttttatacggactctaaactctacttttaattttattatgcttttttctaaattttagttagttttaaattcctatatggactctatactctacttctaatattccttatttttaattctgaatttctattatttcttaattgtatttttatacgaactctatactctatctctaatattccttatttttaattctgaatttctattatttcttaattgtatttttaatatggactctatactctagttctaatattccttatttttaattctgaatttctattatttcttaattgtatttctatatggactctatactcttcttctaatattctttattttttaattccgaatgtcagttatttataaattgtatttctatatggatactagtctcctcttccaatattccttatttttaattctgaatttcaactatttctaaattgtatttctatatggactctgcttttctttttctccgattaatgtgggaattttttggccatgagagcgaacgtggaggctcctttttctattcctttaataagttaatagatttcaatttacattgggtatatgaaaacaactagtttcatgttgcacgattggaaggaaaatcttgggaagaatttagaccatttttcttgaagtaccttcattcaggttttgtggaatttatggaaatttctactagtttgatgatgcatcttgatgcggcaatgtcatgtaaaacttagtttgatacaccatggtgtaaaatggaagtatgtataaagattaatttctactgagagtttgagacatcacctagaaaacattagtcattggatctcttttgagtttaatctcaaccatccttcatgtctttagttacatttctttcatttattaatggaattgctcctatcgatttctttataggtaacacttattttccttcaaaatattagtaccatggtgtaaaggtttgcatcattattttcgaaaaagtagttaatgttacattgggacacttttgtagagtcaccaaaaattgatactatggatagagatggtgtcgtcctggatatagggggctaatgctataactcccaggtcgaatagaacctcctagataattcaagacagacagctctcaccataagtttgtgagtgcttcgatttcacctccgtaggggaaggaattaagattgaacccacagagcaataaggcgttgctatagcgaggaaaatggatggaacagacctatccttttggggctactcaaacagagaagtaggatta

SEQ ID NO: 8983 - DNA, 1501 bp, Oryza sativa
gcggaaattactggggcttggtaggtggtgatgtttacgaggtataagcttttcgtaggtggaacatattaaggtcttgcctatgaaaattgattttcacaggcatggccttaagaggtctacctgtgaaaattaaggatatttttgtaggtggagctcttttgaccatgcgatttaaacaggcaggactagatttggtatctttaactatttttacaaatggtgattttatagtttgtctggaaaaataaatcgtaaccttgggaaaaaatgtttttctactggtgagtgatacagaaaacattcgcatagacagtcagtaactctgacgaacgttttgtaaaccgcctgcagctcaaggcaggtaaaagtcggttatttatacagatggattctgtaattggccacgaaaatgcaaaaattagctatttttatactaatggataatatatatttttacttcaatgtgcgacaaaaaatatttcacagcttgtattggaacacaattgtccaaagttgtccccgggcaaatctcgtctgataactcatcctccgtgattcgacaatgttggctcggtgttacctttctcaacgattgtcacgatcttgtaagtcttccactgctgcagaaaccatctttggtcgattggccaaattctacaatagtcccggttctattaaaaaccgggactaaaaacgatttttagtcccgggttataagagcaacgggactatttgatctttagtcccggttagtaacagtcccagttcacattgtgtcagggattgtcaggctccccggatctttattccagttggtgttactaatcgggactaaagatctcgtggatcttttcgcccggtttgtaacaccaaccgggactaaagttagcttcctttatatatgtctttttcctcctccagcccgagccaagcttcaaaattttttcttgaggagggaaggtgctgccaaaatttattgtgaatttattttgatgattatatacaaattggatatgtctaaaaggttagcaacttcatcctccaaagttttttttatcatattacatttagatatttgttttgtatatattactgcctgtaaaactttgatggaagttgatgagggagaaaatttgtgtagggagggaagaatatagaaattttgtttatttacaattttataaaaagtttttataaaagagttgagaaggaaaaaatattaaaaattatttaaagaatagaaaactaactaaattgaaaattaaaataagtacaacacattaaaataagaacaaacaacctcccgttaccttgcccccatcaggccggacatcacgttccccattaattgcgatcgaggaggaagcaagacggtgatggcagcggctccgatcgaggggaggattgtttcacgacgtttatctctccactctttttttttgacaattatacccttgtacttttttttactattatatccttgcacttttttttaaga

SEQ ID NO: 8984 - DNA, 1501 bp, Oryza sativa
aggccctttacaaaaaacggctagcgggagcaccacactcataaaggcattgccgtacatgtttatcccatctttccaaactgaaaaaatgtgagtaaaacagacacgacaaatcaattatttaccagcaagtgaccatatatatgtcacattctgaaaccgatcaactagatcatcaattaatttagaccctcgtgaaaagttctggcatttcacatcggatatgcggacacacatttaaagtagagttaattacactttggtccaccttttattaccaaaattttactttgggctatcctctagctcatattttcactttggaccaggtaagattacctttggtgcactttggaccaccttctttagctgtatttactctataatgttgtaaaaaattacctacgtaagttggaaaagattaccgggttacgggttgttgatatgtttaaagttggaaaagtcttttatgtattcctaaaaagtttatgggatggtccaaagtgaaagaaaggtaaagtaacctagcccaaagtgaataaatatgttaaagggaggtccaaagtgaaactttggtaataaaaaatggtcctaaacgcaatttactctttaaagtattaaacgtggactaattaacaataaaacaaattatagattatgcctgtaaacggtaagacgattttattaagtctaattaatctatcgttagcaaatgtttactgtagcacaatattgtcaaatcatgtagcaattaggcttaaaagatccgtctcataatttacacgcaatctgcgtaattagtttttttttctatatttaatactccatgcatatgtccaaatatttgaggttacaggatgaaaagtttttgcgttggaacgaaacatggccttaaccgcaacaagtactccgatctaatcaatccgccatgcatgatctgatcaatcccccagcaagaaaaccaaccaatcatgtaacatgcacaaggtagcctccgctttaattccttccctttttttcttctccccaaaacttatccggccatgcatatgatcatgatcgccaaccgccaaaaagtttgtttctaacttcccgccatctcccacctctcccgccatctatctctgacctctcctctccacatgctcatcgatcagcttccctttcactgctcaaatggcgttttgccgccccacgctacaactcttatcatatcttcgcctatatatatcgctcaagttccagtttcgtttcagctcattgaactgaataaagtcggtgtgctatagctaccattcccccggacctgtgtgttggcgctgtcggtatctgggtggtgatatattttttctttttttttttacgatctttctagagttgtaatcttgtaattttttttctgctctatcaatagaacttcgcatttccaaaaaagttcatttcagctcactcaactgaataaagtcagctagcttgtattttaggtgaaaaccgtgcgaaa

SEQ ID NO: 8985 - DNA, 1501 bp, Oryza sativa
ttgagcacacatttcattccatttcattagcacacacacacgcatgtcattagcagctaacgaccataggcacgtggcgctatatcgtaggctcatcatgcgccatacagcccaatcaagagttggcataagcgtgcttacgataatcctaaactatcctaacctcctcgagctaattaagctcaccagccgagcacaccccaagcagaccaagctaaaaaaaaaaaactctgctttattcgtcctctcctctgcatgaactctccccactactcccctgttacagcttgtgacaaccaagaaataccctgcctgcttcgctgtaacacttgtactcctgaattacgcagagatctcctgagttatctgcaagagagagtgcagtaacaggaaagaaggttttcaatggagacggagatgcaaaagtggcagtaaaatggagactttgcgagggcaattcgatcgggcaactcacctcctcggggcaagcaactgccggtgtcatgatcggaaaggcaccggagccggagacggaagggggggggggggggggccttcacctcgcctttgccgtccgtaatgtcgccattattctgaccggcatgctcgccactttgtgtcagataaaggaggaggcccgcttgtgagtgacatgacatccgtgctatctaatccttgcccccgcgcggccacatggctgtgtttagtttagctgcgagacgaacgcgtgctgctgctcaaagcgccaggattagtgttgagtccccatgctttgttcagccattggtgagccggcaggcataattagcttagtgacaagtaccgtactactaagagcagtacaatagcagactatgagcccgctaataaacatacttaaaaaagataaaagagaaaagagaaaagtaacgagctttaaatttatagccagctatagcacaagctccaaaatatatacgtgtataatatgtgggaccaaacaattatatagtatatgtttataggtaatcgtatgaattggctatttaatcgattatagataatttgaagccaataattgattataatattaaacttgctctaagtagctgcgctggttaagggagacaaatggtggcgtcgattttgtcattagtgtgtgcttgcagcgtcattagtaggagtatgatcatctgtcggcagagctctgtaaaaattctgctgcttcagtgcttctggtattagcgtcagggagtgcagtgatctgcactgcagtgcacatttcttttcggtgtttacgcattttcgaagggaatttacgcgcgaagaggagggggggggggggggggggcatcgtggaaagcgagggggaggaatcgcactcttttcttggcataaagcgcgcccgacccgtttacctcatcgccgtcatcgtggggcctcaccacgccacgccacgccacgccacggcacgacgtagtacgcttctccccttgccggccacttcttccgcagtcgacag

SEQ ID NO: 8986 - DNA, 1501 bp, Oryza sativa
ccatcattcacttttcccatctacctccactactcaaccaatcacaaccctccaccattcacttttaactactttcttaataaccgtgtccagcggtaaaaatgcttatattttgggacggatggagtaattatttgatagcaaatgaatcaattataactgttataagattttaaaattgatttcaaataattcctaaaaatataaaaattcatatataaaaagcttttgcaaaaatatatgggcttgatcggtagtgttgtagccgatccacgctaatcaggtgatttgccgcggttagggtcatatgctttgattttttacagagaagggtattttttacccggcttctatatccaaccggatatatgtatttttttttaaaaaaaaaatagaaacttacctatcaaacatggaattagcactcaaataacccaatctaaaattcactcctataaagatttgaactcagaactttcggatgctactcaggtcactgtaaccattaggctatgtgtcctttcactagtcatatgttctgatggttgttgtagcaaagacctaattccttagtcctaaaatattgcaagtttagaaatataatcattcatcagttcattcctgtcacaccccgaactagtaccgaccggaactagcccgtgacgctccaaattaacctgttaatcgataccagtcccaggaaacagtgctggtatcacagggagacagaatatcacagcaacagaagtctctttattatagagtagaagtacagtcatgttgggctgcggacagaccccgagctcacaactgcattacaaaaggaaagcggaagccaggacttggaccaatcatcacaggcgcgacttgggatctaggccgaaaccctaaaactcatcgtagccagcttgctcctggaagaactcctcatcagcaggatccgcttcatcttcttcagcaactgggggggaagttatttatatagagcaagggtgagtacgggagtactcagcaagccaggggaaataaggtgtttattgcaggcttcaagggaaggctgttgttttagcaattgattttatttgaacccttttctgaaaacaactaagtgagtgcttctcaaacgacacggatgaaacagtgcgtctcgtccggtcggagtatgtgcaatgtatcagtctttagaattgaaacaaggttggcacccggccaacagctttttcaaccggccacccgggccaacaactttccaaacggccacccgggccaacaacttttcaaacggccacccgggccaacaacttttcaaatggccacccgggcctagctgatcccatcagctgcatatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccaca

SEQ ID NO: 8987 - DNA, 1501 bp, Oryza sativa
catgttattcacgcacttttcacatgtatggcacgtacaatgtgtcaaatttcaggtacagataacttactgagaaatttgtatatacctgttatatgaactcatctatatcacatttgttaggaaaccctcataatcttagtcaccttttttttttacaaaacctactatacaccttcccaacgtgagcgccgcaaacatcaacaccatcgctgccaccgcctccttacccctagtgtgtcgccacacggtctcacctgctggttggaagacaccaatggcattggcaaggcccctcggctggtttcctccctatctccactctctgactctgccctcccctgccctatgttccttctcaagccggcggcaataaggtgcccctgctccaccatcttccatgtctctagtggctatctgtcgttggatccgtcaccccccgattgccgcctcctaaccagtgggtttgttttgcccctgtcagtcatcctccgtcacacacggttatctctctaagctttgggaaaacccttcctcttcctcctcctcctaccccctcccatcccaaaaataacctagaaccctaactgatggggggacgttgctgccttgctagagctagaggagaagaaagccgacacaaatcttggcatggaccctatggtctgaaattcgacgaaaatctttccaaatttctgccatatgaaggttagcgattccgtaaaaattatgaatgagcctgtacaatttacctaaatggatggtccggatttggaacttatctacccttaaggatggtcaaaattctcatggttacacgaagaatgtcaaatacactcacacatctcgctaaggaaaaacagaacagccaatcagagcataaatttcaaacttttcttgaaaactcaagcaatttttcactgatattggacaattttttttatcaaccataatcactagtgtcacaaacaccttgaaattcaaatacattcaaaacttttgtccaaaagcacatccgaccgggggacctcaagatagaaccgaaatttcaaattttcaaccgaaatttatgaactagatgagagtgatgcgtaagggggaccatcagggagcaaacaaccgtgaccgaattgcataggagttatggctgatcacttgagaaattaaccatccattcccggtttccctccaatattgcacccatccatcatccaccagggatgataccgttgccgttgctctaaaaaacgttaaaacagcggcaggcaacacgacagcacatcgcatcgtacgtacgtcgttcgtcccgctctcctccgtcgtcctccctgcccaccgtcccccacacccactccccgccgtcacgtccttccagaaccacctccacgactcttccaatcccccgctataagacgcttctccactcaccactgcaaccctcacccagccagctcgagcgagcgaagccagcagcagaagcagtagagagaaagtagagaga

SEQ ID NO: 8988 - DNA, 1501 bp, Oryza sativa
tagtccaccctgtgaaaggcgagatcccgagctcatccaccaacgagaaaatgttacggtatgggtaccaaaaccctatgtgcaatgccacgattcaaggattactgaatcagaactggcacaccaagttttaacagttgtaaactgaaagctgaagaaaattttacctctgagaccaatctcctcggttgggccgctctcggcccccagaagcgtgacctcgtatccctgatcaatggaaagtacagtgatgaagaacaaaacccaccaaaacttctctgctccacgtactggcagatgcgtatttgtcactgctgtttcaaaagagacggcgaaggaaacaaattttgggagaaaattccgccgccgcgagtgcgcccacacgagcggataatgcgaacgagcgcggtgcccgctacgaatcgagaacgcgaatgcagcaggagcaatccggcgccacggagcagcgagagcagacctgtttgacgaggtgatgcgcggcggcgaggcctgcccagccggccccggcgacggcgaccttcttccgctgcgtgtcgacgggctccggggaggcgtccgcgcggaccgatctccctcgacgacggcggcagcggagagagggcggagggaaccggccgccggcgacgggcgcggtggcgataggcgcacaccagcacattccttcggcgggaagattcgggaatcgaggagtggaggagctcctgggagcgagcgaacgagtggcctggttaatcccccgcgatgtgttcgtctgtgtgccccacggaaagtgaacatatatttccgtttatgcatatatttgtaacagataattggactttccaagaacaatttggtatgcaaggcgattagtaatcggtaatactaaattgtggcatatagataatcaacataattatttcagatagatttgtataattaatattctagttttatatataatgtgtaaatcgcatgggattcatatgtcaacgacgacatcatttgaaatttctctccataatttttttaagataatagaatataatttttgtccataattgttatcctagaataagttaaatcatttatcaccctgtagcaacatttttactcgaagaaaatattaagttatgcagtgaacaacccgattaacaaatactctgtagcaacgttctctaatatatttgttctttttcccacaatataaaaatatagcattattctctaatctatttgtactccatgttctttcataagttgacttgaacaatggttcaatgggttatggtttatataatcgttccacatcatatcaatataatgtacatgtagctgatataacgatttatccgtaataatagtaaataattaatgatttagtgttatggatggtattatatgcagtgatatactgtatgtgatctattagatcatctgttaattaacccattgcattattttcttctttttctttttctttttctttcttaacttcaca

SEQ ID NO: 8989 - DNA, 1501 bp, Oryza sativa
caggctcctcagcgcgcgaaacgcccgcctcgcctgaaatgaacggacacgcctttctgaatcatcgtggcagcctttgcagaaatgcagcggtaaatgcggccgggttaacgtgcgcgcgtaccaggtgaccgcggaagccggcctggatggtggccgccgcggcctcctctcttgagatctcctcacggttgttgacacctccgtcgcgcgctcctttccccacacgacgcgcagccgtctgacgccttggttcgacgacgacgatgccggagtcgggtgccacggccgtctggccgcacggaggagaccgaccgaagacacgcttcatcccgctcatcaaccggcgtaggcgaggccgaggcgtgggccgcgtctggcgttgccgagcattatcttcacgccgcgtgccgaggcagcagaggaggttgctcctggccatgttcatgtggttgagatggcggcgatgctttggtggagacggaggtgtgcagtgtggttttgggccatttttggaggtgctccagagacacccgagtcttggtggaaagttctcaaacaacgtggcgggatgaatcccaaccgacgaatcgcgtgcatcttgatttcttgaaccggatcttttctcatgccgtattattttagcgcaaaaataagttcccgagaatctgacaaaactcggaccatttcatcttatcattcgcgcacttcccgccaacactccgatttgtacagactttccagttcccaggtacaccaaaacagagcagctataatggtcatcgaaaccagagcaactaccggtggccgcgactgacgaccggtgcccactaggaggcgcagcgcagcgaatgcagtgacgcggtggtgtccatggacgcggcgtcgaacacgccgcaccgttcgctcgcctcgatgccgtagtccatgagcggccgttgctcgagctcgtcgtcgtgccggcgcaccgcctccgggacgtccagctcccccttgcgcacgtgcgcccacaggtactccaaccggctcacgtacctcagcttcccatacaatcttcaggaaaaaaaaacaataacacaaaaatcgcttagtaagcaaatcgatactccctccggttttattttaattgacgatttagacaatgatactctctacaagatatacctttcccttatttttctattataatatatacaataaataaatgcatgtttatttttatatagtattttgaaagacaaatctatatatgtttttctagtttttttaaactaaatattttgacagttattgatgatcaatattataaaagtttaacctcaatcttgtccaaaacgtcaattaatatagaaccagagtgagtaatctctagtacggcctaacatcgcgcgtaacgtatgtaccctgagctgaagaggaaccggccaagggtggagaagaagaggcgggactggagccccgggtgaaggaagtacacggcgtgtagcctctccctgacagc

SEQ ID NO: 8990 - DNA, 1501 bp, Oryza sativa
atcggggggcagcctccttcctctaaacctgataccccgggcccatatcaccgacacacgcaatttctctctccccttcaaccggaaattattattttagtgtggtatcggggtatccgctggcaaataaccttgttttgagagtgtttttctccaaagtgacttcgggtggtgtcctcaagttaaaaccacgaagtcgcgattctctgtagtaaaatttatctatatgtagtggagtgcagtacagtacaacaacttcaatggcaaaatttgcctacacgaagtcgcattgaatcaatgcgcccgtgcgtacatgtgggctgtggcttcaatgcgccaactcggatattcgcagccatgtctgcatctgtcgatcccttgtcaagagccacgaatcacaacgaagtttcgtgttcctgatgctatcaaagacaatgaatcgtggtattaatggattgaccgtttcttagactgaaatgattgcttgagacacgccataacgtggctctgattgtgaatggcctaatctctagactctgtacttatttatggtattgggcctcgaggttcatcaaccacttgcctgatgaacgtgtgttttactagtagttctaattgtaacccgtagatcctcttcctctaaacgaaaagctccttaagaaactccctaacacttgggtgcatgtaccgcaagtccagaactaaacaaaaatgacgggggatagtgcacgatttgtcaccttcctctaagcctgacaaaaagttctgcataccagataaatcagctaaacaattagataccccaaatctcaaacgcagttgatgatgaggtgaaaacgagagagattctcactgtacatcagtacatcctgccgagaatcttgacagtaaaatgtatggctgcgaagcccgaaggaggtaataacaaaactagtaatcccaacaaggccctgacgcctgacttttcattgagccgtggtctccgcggtgaaagcgacgactccttttggtatggcaacattcttacacccctatggcgacatcctttgtagcaagtctgcaggagtgtgtggtctcgcactctggcctcggcctgtacaacgtatcatttatctcccttttttttagagcaaatcgaatcctttttttcctgcccacagattcgcacagctaaaagcgaaagatgatgtataaattacttagtacgaaactctgtctgtcatttggaaatactacttttttctttctttctctcgctctatctgcaattcctgcatttatcaaactgcctaacctctttacgtgcagagaaaaagaaaatgccccccacgtgatcacatcctgcactctatattgacggcattatatcaaacatcctgtacttcgttgtcatcgtgcgacttcttcgcgttgtgagttgtgacccgtgaagaccgctatatatacacacgctactagcccctgttgcattgtatacacatattcattgcctcattggtac

SEQ ID NO: 8991 - DNA, 1501 bp, Oryza sativa
cccgtagatcctcttcctctaaacgaaaagctccttaagaaactccctaacacttgggtgcatgtaccgcaagtccagaactaaacaaaaatgacgggggatagtgcacgatttgtcaccttcctctaagcctgacaaaaagttctgcataccagataaatcagctaaacaattagataccccaaatctcaaacgcagttgatgatgaggtgaaaacgagagagattctcactgtacatcagtacatcctgccgagaatcttgacagtaaaatgtatggctgcgaagcccgaaggaggtaataacaaaactagtaatcccaacaaggccctgacgcctgacttttcattgagccgtggtctccgcggtgaaagcgacgactccttttggtatggcaacattcttacacccctatggcgacatcctttgtagcaagtctgcaggagtgtgtggtctcgcactctggcctcggcctgtacaacgtatcatttatctcccttttttttagagcaaatcgaatcctttttttcctgcccacagattcgcacagctaaaagcgaaagatgatgtataaattacttagtacgaaactctgtctgtcatttggaaatactacttttttctttctttctctcgctctatctgcaattcctgcatttatcaaactgcctaacctctttacgtgcagagaaaaagaaaatgccccccacgtgatcacatcctgcactctatattgacggcattatatcaaacatcctgtacttcgttgtcatcgtgcgacttcttcgcgttgtgagttgtgacccgtgaagaccgctatatatacacacgctactagcccctgttgcattgtatacacatattcattgcctcattggtactttggtagctatgggctccctacccgccgccgacaagccgttgccggcgctccggtaccctccggctcgccgcgacgacgacattgtcgacgactaccatggagttaccgtgccggacccctacagatggtgagtgtcttgtcgacggctgtttccgttcctctgtaatcgattctgtcctgttttgagaggcactctgtttgttacgttatgttatgcacatctgctttttctgaattttaccctttttacccggcttgaaccatttctctgttcgtgcaacatgaaaaaacatagttcctaaattcatggaaagaagtactgcttcaggataagagtgttagaattcctgaggttcagtttttttttaatctcatttcttaataaacttcggccggcttagggcctggcgaaacagttttttttatataaaaatattcattagattattgacatgtattatctactttattgtaggataaattaaatattttttataaacaagttgtctaaataatacttcctccgtttcactatgtaaatcttttttttttgcggggcactatatatgtctaaatttattaacgttaatacgaatgtgaaaaatgttagaatgattta

SEQ ID NO: 8992 - DNA, 1501 bp, Oryza sativa
cgttatgatgagggagggagtataacatatctaatcgatcagatgaacggtggatgggagggggagtacgtactccctaggagtatagatccattttcatatatatatatatatatatatatatatatatatatatatatatatatatatatatatatatatataactactatacagcaccctaaggtgctacgtattaaacagcacctgatacagcctccagccccacccacccacgctcccaccaggtctatagtacgtagttaaaatttaactcaccgacgaccaatcttgatcccacccctgcgccccctcccctcactcctatagtccgagtaaattttttacttcatgctatccaacttcttagtagttctatatatatagttaaaatttaactcatcgacgatcaatctcaatcctacccctgcacccctacccccactccaataatccgagtaaatttttaactcgcgcaccaccaagagccacacccaccccaccctgtcaacgctcctacccaaacgatagtaatttttttactcacaccaatagttctatttataccatccataaccatctcaccgtatccaaacccccattcatactcccgtcctcttccatttttttcggatctgagaaattggggatagagcggcgacggtcgatgggtgactggtctgctcgtcggggcgatggcatggaggctgagctccgagtggtggcgaggagatccatcggtgaggggtggtgtcgtcatgcatccaggtaggagagggcgattggcgtcgggctgccctcctcttgaaggtgcccaatctgaaggccggcgccggtggtcattcttctttggagcccgtgagggtggcggcggccggctacgtcgtccatggcgtgcctcatggtcggttcagggagcacgcgagtaggtggccagcggcagtggtggccctgaaacaacgttcaagccggaaaggaggggaaggttgctttccaccttgtgcggcggcaacggtcttcaggcccggcgactagcttccaggccagcgtcgatgcgtatagggcaggagaccgatgtagacgttggttgctgcgccggatctggagggagcctagcgcatgcaccaccaccacgtacagcgtgcttctcgggtcatccgcatctctgttgtttctatcctcccgtggacgggggtttcgtttcatttttttctctttgttggttctgtagtttgttatgcacgggggattttttgtacgattgatatgcatatgattgattgtaatactccataatctaatattgactgtatgtgtcaaaatatgcgccataaaaggatagcgatactagtattttgatggcttaaaaattttcactcactttttttacggacagattgagtaagtatattactatgaacacactgagagtgatgtttaaaatatatggaagtaaaaacattactaaccctgataagtattatagggaaaaatatgtagt

SEQ ID NO: 8993 - DNA, 1501 bp, Oryza sativa
acatggcatccatcaccacgaactggctctctccggtatcctctttgtgtgtatagcacaccacatatccattgtcctcattaccatccccattatcattgcttggcacgaaaaatggctccccaacaaagcacccggggccaaagtcacggcgtgcaaccgtgcagtcgtcagcaccaaccatggcaaagtcgagctttctgattccagagaacctgggtaacggtgcgcttacaccaaagtatccatagcggttgtatcgaccgacgtagccctgatgaattacaccaaactcaaggctctccagtgagagtgcagtgcgcaaaacggtaccagtgcggagattgatatgtatcatgtcaacctgaacttgcatgagttccatgttgccaagcatgtgtgacagataagttgttggttgacaccaatataatctcctctccattagcttcctcccaggcattagctgtatgtagcatattgaatcctgggaccttgaaccacctcatctctgactcgtcctcggcataccttggtagcacaccaatccgttgtaccattgcactatccaatcctatcagcgagccaccacgtagagccatgttcatcggacacatgacaagttgcgactcagggaagatggcataatgctccgtgattgcaaagtcatgtagcattgatggttgctgcaaggagaagatgggcacatcatcagccttgttgccagccttgtcaaaccaaatatacgtgagaaatggctagaacaagctataacggaacgcgaataactctccagtgactgggtccttcttgggatgcgctgtcattcctatcatgcggcgaccatcaaagtcacaacggtgctgcggtagggataatagtggctgggtagggacaagccatggcgacaatggctctgtccagcctgcaaacttttgtaacggatgggagcatggtattggtgcactcagctatatatatatggatcgccagtgaggtgtcgtacagtaagtttgttacgctatctctatagaatggtgtagattgaagccaatcatagcaaactatcagcaaggtttgcacttcagtaaacaccgaaatttcgagagtttcaattggttttttttccacgaaattatttaaatgtttaacaaattttgactgaatttgaataaattttcaccaacttcattaaaaaaatgagagtattcgaaaatttcggatgagatgtttgcttgtcaggggattcgaaatttccaaaatttcgaaccaagattttaaaacctgactatcaatatgttgacgaagagaaatttcattttaataatacaaatgagatataatatggtcttcatcattcactattgtagtgtcgcctttgcatttttggcaactagcaagagtcctatttggacaagctagttttctggctcacaatcaaagaccacgttacggcgtggctcaagcattcattcgagcccaagaactgctcaagccattc

SEQ ID NO: 8994 - DNA, 1501 bp, Oryza sativa
gggggtggggagaaatccaactcacgtagcggccgttctcgcggcggagccagaggtcgtggttcccggggacgtagaagacggccccgaaccgctccctgagcgcggccatggtgcgcgcgaagttgtcccgcgtctccgccacgtcgcccgccacgacgagcgcgtcgatccccaccccgtcgcccccgcctcccccgccgccgacggggagccgcagcacccagtccatgttctcccggtagtccgtgtgcaggtcggacaccacgaacaccctagtcgtcgccgccgctccgcgcagttccgcccccgtcgccaccctcggctgcggcgccgggggcgcgcaacacctcacaggatggggccctccccccctccccctccccccgccgcacatcctcctcctccgccgccgccggtgctgcgcgtgcgccggcgacgccggcgtcggcgccgcgtcgagcaggtggtgggaggacgacggcgacacgggcagatgcggcgtcatgtcgggctcggtagcttcgcaaaaatctcctccaccctttttctttttccctttttttttcctcccaatttttctcctctcctcgcctcgccggtgggtggtggtggtggagtcgaagggcaatttcgtaattttcacacgactcgactcctcggctcgggttgggttgggtcgctgactgtgattgtgtgtgggtggtggggtcgccttttatactgccgcgagataagcattaaaagttttttttttgggggagttttttttctggttggtggggggtgtgaaaggtgggcccacatggcaggagtggcgtgtgggggccgcctgtgggattagctaagcgagagctggtcattagcggcgtgtgatgatgattatgttttttgggttaatcactaatcattggcggcctctggcacgggattagtggactattggtactattatttttgggcgtttcctgcacggaattagttaggctaatggaaaatgtaagagagtgtaacgactaggtcagatcttatttttttataagatgttcaaatagactttgtagaatgattatatgattcaacaaggttttataagatgtgttaatggactttctaaataattatatgcagttcaatgaaggtgtcgcgagtagattagtgtattgtggaacccggtgtcgtgtcggcggcagcatcgtgtcccaacacccaacacctcagaaggaatcaacgaaaagagaggttggtgttcagagccaataatcactcatgagcacattttttcttccgaaacttccgaccacaaatttaaaaattaaataccaggaacaaatacaattcctctccttctaaatgccctcgtcgtctacttttgatcctgttcggtgcagcttgctgcagcagcagctacaacatagaagcaatatagtcactgtagcagctacaactgcgcagctgcacaaaagttgcaacgaacagaccttttatgtttacaagtcaa

SEQ ID NO: 8995 - DNA, 1501 bp, Oryza sativa
acgtggcgtggtcgcggccgtccgattgtcctgcaactgccatcctacggttggtgcagagctgcaggatcagttggggagttgcacccaagttgaatatcctgattagtagtagtctagattcagcttcaagtgttaactcaaccaaggatcaccaaccgaatagttgtgaattgtacctaaaaatcaccatctggtcagaaatatttaatgttgtaggataaaattcgatcaaacctttaatgttttcttaaatccttagtttaaaacatcatgattactccaaaattcagctttaggtggtgtttgaatcttctgaagataaatattaagtgttttacataaaacgagatagtaataacatgtgattaattgagtgttagttattacaaacttgaaaatggatcaatatgatattttagaacaacttttatatagaaagtttttgcacgaaacacactgtttagcagtttgaaaaacgtgccacaagtatgcaaaattttatcctctagccttagaagaaacgaacaggttctcaattgttaactcaattaagaataaaaaaccaaatagtcacgaaaagttctttaaaaaattgcaaaatacattttgtaaatataattgaaaattaatgttttatatccacatcctctgccatacggcacacaacctacgttttgaatctagaaattaatagtgcaaaaccatatatttttggatcataaattaaaaataatagtaaaaggaaacgagaattgaacaaactgatgaatcatcagcaagcaccaaacctctcatgtgctatatatctcaaaacaatttgcatgaccacacatctcatgtggaaatataggtgaaagagttggaagcttcacccaactgagcacttcagtttctttgcaactcttccgagtctcacccttcttctccaaggctatcggttgagccgtcgtcaatgcaaccgcgaccaaaccgccgatcgatccatcgagatgttcacgtcgaatccaccacctaatccgtagcctcataccaccaaatctcactcctcctccctccatgtattcttatcatggtttcttcctcctcccgcctctcccctcgccgtcgcattcttcttcttctcctcccggcaagcatcgtcccgccattgttgggatccatttgtttattatggtgtttcttgacgtggtttagggcttcaagaacgccgccatgatcgggacaaggtgtgagacgacatgggtttgggtggtgatggtggtggtggtgattcttgcggcggcgatggcggcggtggtggagggtgtggggtggccagagccggagctggaggcgttgcgcgacgagcggggcgggctggtggcgctgcgggacgcgctgcggtcggggagggacctgcactcgaactggacggggccgccgtgccacggcgggcggagccggtggtacggcgtggcgtgcgacggcgacgggcgggtggtcggcgtgcagctcgacg

SEQ ID NO: 8996 - DNA, 1501 bp, Oryza sativa
tatttaataattaaacatgttacaaattaaagaagaaataaaaaaacatcaaaaattataaaatgtcaaaaaaatcaatgcacacgactagtgtgcttagcaatttttttatccacaattacttttacaatattataattaattttgttagaattattattataatatagaaaaaatagttgccaaagtttctcaacgaatatcgaataaagtaaaaaatatcatatatttaaatatgatggtaatatttgtttgcaaaactttgatcttcaatccttcaacagcatagatatacaacgtcgtaatcaccaacgagcccgagtgaccatacgggatagccgagcggcggatctgcactgtccttgggtgaaataaatctagaacattgtatatcttatcttaatctctactattagaaattaaagatgtttttgctcaagatttccgtacgttctctacttcgttacaatatcggttttgtacgcccgcacacgcgttgtgtgttctctggtagagatgcaagtggatagtcctgctacccgtataaaaacccgcttcctagttcattttccacatgatagtataaaatttagaagaaaaaataaactataaataaaataagcaggctgaaaaaccccgcttgtccactccgtttgcatccctattctccggttccaatacatgaagtgagtgtcttgcttctccctggtctggcaggccctttttccaccatccccacccgggccggcgggttacattgaccgatcatggcccacattatgtgatgaacactagctgagttgaaatttatcctttgatgattttcagtatgtttttttttctccacatcttctctttcaattttggaaaaatattttattcttgatttttgtgctcgtacatcactaataaatcagctgttacccttccacacattgtcaatttatcatgtctatttcagctcttaccttagtatagtcttgagtcatcgctactgactggctgtgttcgctaggagaagttcccatccagaacagtgattgtgaaaaacggaacggtttattagcgcgtgattaattaagtatttgctatttctttttcaaaaatagattaatttgattttttaaagcaacttttgtatagaaacttttttaaaaaaacacaccatttaaaaaagcgtacgcgcgcgaaaaacgagaaagaggggttgggaaaagctacgtgcctcctacaaatcaatagcctgccataacaatattttctacgacatgatccatattaatccatgcaatgcaagcacacacgctactgcacgaaaaaactacggtccataacttcaaaactaacatgttagaatgacgttaatttttcattgcaattatattcatcgaccgttaatttactaggcagcctgtttaaaaaaaatattcaccggccatacccacatgttccgtagttcattaggtgatggatcggtagttacagcagactatggtaagca

SEQ ID NO: 8997 - DNA, 1501 bp, Oryza sativa
tctcctctgttctctgcagcaaaatcgaggatccgatattcctttatttttatatgtctcttaaaaagtcacagaaaattttaaaaaatttagtaagatagatctatacgtgatttatcactccacaacacatgcaaattcaaattcaacttatataaatagaaacaaaaataacaaatttaattatgaatctaacgcgtaattcacgttcaaatttattattattttttaaattgtacaagttaaattttgactcatatatttacgaaaagatatatcataatttttttaaaaaaaattgataattttttaagctgcatacacaaaacgagaggatatcgtcttgaggtaaaaaatcacacacttccaaaaatcgaaactcttcgtcagatcagtcgccatggcagccactactccgatcaagaatggccatggactgaccgtggaggaggtggaagaggctgcggccggggacgtggtcgtagacgacgagcttctcgtccttggagaagtagcaggcgacgacctcgacgacgttctcatggcggagcttgccgaggagctgcatggtgtgggcgaagtccttgcgtggcacgtgccccatgttgcgcagccgcttcacgacgacgacgaccgggccgccgccgccgccgccgccgccgccggcgtggagggcgacgcggtaggtgatccctagccggcccttgccgagcatctccgccgtcgaacggaacagctcgtcgaggctgaaggtcgccttctccggccggaagaactgtagctgatccgccgctcccttgccggactccgtcgtgctccggcttccgttgccgctgccactgctcaccttcttgccggcttgctccgccgccttgtccttgatgtcacctgccactggtcacgtcgccgtcaatgactcgtcgagaagaaagcggcggcgagcgaagtggagtgggttttgtggcgtgcttacctgcggtggcggcggcggcggcgcgaccgccgccgagacgaaccacccggctcttcttgctgtggtggaggaagatgagcaccgcggcgaacggcaccagcgcggcgatgagcgcgatcaccacgacgctccacctcgctatcctgaaccggatgggcttgcgccaccgcgccggcggcgcggcggcgtcgcgcgccccgaagacccgatcaccaccatcgctgccgctgccgccgccgccggccggcgcggcgtcgaatggcgagccctcgcggcggcactccgtcctcacaacctcgccgcagagcctgaggttgtgggcgaacgcggtggcggggaaccggcggagcgcgcgggtgtcgggcacctcgccctggaggaagttgtacgacacgttgaacacggcgagcccgtcctgctcgaacgccggcagcgtgccattgatcaggttgtcctggagctcgagccgcgtgagctcacccagcgccgccgcgtacccgcgcgggatgggccccgagaaccggttgc

SEQ ID NO: 8998 - DNA, 1052 bp, Oryza sativa
gtataataacacaaccttacctcacggccactccctcggaagaaaattacataggatggaagaccttcaaacatcagaaggaccgtgcttctccggttgacacgtgtataagcacaaatcttgaagcaatcatcccctacctctggcccaactcctctccactctccatccccgcacatctgcccttctgcacaccaagcctggcattggatggctgctcgccggcagcacctacagtcccagctgtggagattggtcgatacggcatacggtatcaagaaattgtgagttttcttaacttaattcagctgtatgtcctttatttacatgcccatgaataattttgacagacaaatcattaattgtttggcatataggttgaatcatagatcaaacttgggtactcgacgctcacaaagtgtgaatgaaatctggaaaccagtgattgagaatttgagataaaagtaatgcgagattcaccaagaaaacccacaacaaacatcactaattgaccatagtgtactcaacgagagaggggaactctggtcagggaaggccggaagactagggagaggagagaagggggagggggggaagttgggctagaggtagatggcgattgcttcaagattcgtgctcatacacgtgtcaactagaaaaagcacggtctttctgatgtttggaggacttcgtctcctacgcaattttcttcacactcacgccggcgcccctcatctccttccccaattccctctccggcgacaaggtcagggcggcgccgatcggcgagcttcgcactagggcgggcatggcgcgccgcgccgcttcccgcgcccttcgctcggagggctcgatccaagggcgagggggccgcgcggggggcggtggcggtggcgccgaggacgcacgccacgtgttcgacgaattgctccggcgtggaaggggcgcctcgatctacggcttgaaccgctccctcgccgacgtcgcgcgtggcagccccgcggccgccgtgtcccgctacaaccgcatggcccgagccggcgccgacgagg

SEQ ID NO: 8999 - DNA, 1501 bp, Oryza sativa
ctatggcagtggcgccatagcatccgttctcaggtactaccctcgccgccggccgtgctggctgccggcgaaggatctcggcgggcgctcgttcttcgtcggggtgaacaacgcggtggcgctgcgcgtggatggtggcggcggcggcgcgtcggggctgagaggcaactgcgtgtactggagtgccaggtgtagtagccgggccaaggtgttcgacgtggagtccggcaagtcggcgacatgctttccggtggtcgacttggagacgggcaagtcggcgccgggctttcccggcggcgcggaagctcatagagccctctgctggttcttcttggctgatatgcgtagcagcagcagcaatacgagagtgggaacgtcggctcatcagcttcagaaaagggctcgtcatgcatgaattatcggaccgagttttataagactactctcgctccgcttcagattacaaacccttgttcattttgaaggattcctaaagtaaatctcaattcctttggaataagcactatttatacattccgtctgtagaaacactatgccaatcctccaaaatatgctaattccatagaaatgaaaacatccacgccatcctcttttctttagctcagtgtaggtctataggaaaaatttatgtgttccaatcttttttttcacgtgcatttctacattatttctacgtttttattattactgtgatttgatcaaagtcaaaccccactctaaatttgatcaagtttgtagataagtatagtaatatttacaataccaaattagtttcactaaatctataattgaatatatattcataatatatttgtgttgtgttgaaaatgttattagttttttctataaacttagtcaaatttgaagcagtttaacattataacttgaaatggatagagtaaatgatatcccgtacgttgctaagaaatgacgatatcccgtactttgctacgaaatgactatgtatatatagatagctcgacaacatatgcaagctagatagatagctcgacagcatatgcaagttatactaaaaataagaaggaatgaacaaaagaaaattaaagaacttagaacttttcgattagtttggttgtgaagatcaattgtgttctcaatagaaggaaacacacatgaataaagaaaaattcaaaaggtttttaacttcagtttgaaatgagctgaggctgagctgagatattcttctagctattcaatggtcaaaacttttatggtgatgtggctcaatgcatgttgaacttgtggttccaactataccgtatttgtagctaattagtagattagttctaatgcaacaaaagttcataattttaactttgatcctctttgacatagcttcaggtctaaaaatttcatatacctctaggtattactaacttcacaaatccatatatttatatatgcgattatgttaataacatttggataaataaattttattctcattttaaataaaatt

SEQ ID NO: 9000 - DNA, 564 bp, Oryza sativa
caatagcatactatatcatttgagagcaagagataccaagggcatatcaacgtgggtgcagaggggctcaagtcccccctacacccgctggacccatggagccccctccccctcccccccctaccccagaaaaaaaaaacactgagaagtaggggctgctgaagctgcctgatggctgaaggttgaagaagacacgcgattgggccagactacccagtgaatgtagtaatgcaatgtcaattgtgccaagtggctaggtgcacacgtccagttgttcactaattgggctttcaacttaggctacgttcacatgtcctcgatgggaactcattccctccggtccattagtgattaattaagtattagcttttttttttccaaaaatggagtaatttgattttttaaagcaactttcgtatagaaactttttgtaaaaagcacaccgtttagcagtttgaaaagcgtgcacgcggaaaacgagagagaggagttgggaacaaggggtgccgaacacagccttagccatcagccgaactaacataaatccaaaatctcccatccagt

SEQ ID NO: 9001 - DNA, 1501 bp, Oryza sativa
ttgcatttttactgagtaatgttgagatcgccgcaatctgaatttgttttcattttaactgaataatgttgacctcgctgtggttatacgaattatactacatgttcagcaactatactgcctttgagtttgatcagatgttttatttattaactttgtgtttgatttttgaaatgttaactgaactgcagctgtaatctcaatactgaatgtgatttgttgaataagtaatctggactctctgactcaacatatctaattttgtagtgactacatggatctaaattgcaagattcagaagaagaaaacgatgaagaagaagaatcagaagatcaaatcagaagaaaacgattactacatggatctgagtttgcttgtgtgactttgctgtttccagaattgatatctgatcacgtgcttttgtcagccatcttcttggcaaacatgttttctgatgggtcacgtgaagaaatcaccaaattgggcttttcactttagaatcatttcggtttgggctttggtttggatttgggccacgataaataggccctgaaaaattgtccatactttattttgctgtttgtatagcccatttctttttttatatttttttgctgaaaaaaatgtgagctgttagattgaaatcgtatggtgacaaaatttgacagattctagatgctattttctgtcgacaggctatacacggtcccaaaaataaaacgaattcccataatagggggtttctaaaatatatgggtttttttttgcaatggaatatttcagtttaatgtaacattaaatctatacatagtgaaacattataagtacactaggtgaaacattttttgtaaaaaaaaaaaaaccaaattcccataataaaggggttccaaaatatgtgtgatttgttgcaatagtagataggagcatagatacggtaggacaaggcctgcatgcagcgtgggggaggggcgtcgcggtgcggtcccccgcgccggtcgtgcgggttagagcattcgcgatatttagggtcctagcactgcggattttctattttgccgacttaaacaaaccacaacggggaagaccagtactctcattgccgtggtccacgcgtcgcacgactgagtaccgtgccgtgacttccttctcctatcgaccagggacggacgcagcaagttataaacagtaaggctcaactatctaattctatgcattttgggcaaatctcatctgaaatttagtgttttttctttgaatttgtttatgccacgtgagctgcctaacacgtgtcacaccgcgccgaccgcagccagagagaaaacaagctcgcggacagccgcaacataaaaaggcaaaaaaaaaaaacaaaatctgttactacgccgaaaccctctaatcaccagttcacaatccccccataaaaggcggcccgcctcatatttcggcacgcccccaaatacacccgtccaatggccgccgccgccgtccacgagccgcttct

SEQ ID NO: 9002 - DNA, 1501 bp, Oryza sativa
taattactgaactgttctttgtatcatttaggaattgagctctgaaaaatccgagaaaatttcagagagtataattaatcatggagaatttaataaaaattaaatccatccatgctttaaatttaggaaattttatttcccacatttaacttcacttgtaaattaatgaacatttaatataaattctattaataatttattagataatttataaatcctaaaacgaaaatctggctgtgacactcaatcatattttcatcaaaattgtaaatgttatacaactatggattgacaacaattttcttttaaaaaaaacagggaacaggggcacttatcagatataggaagttagattgagaagaagaacacaaccaatcagacaggtaaatataaataaatgtataaaattgtttgacaactttcatactgcattaactattttgtgaaacaaatttaatagtttatatgattgaaaacaggtttagcattgcttgaggagaattacaatacacattacaaaaacaggtaagggaaaaattatgaagcaacttgcaggtatgagtaatagtaaaacaaaaaaaatcagatattttcctcatatttattttcaggtaacagtaaaaacttctcagaaacagaagctaaacttgacaagaccaaaaattcagaagcagacattggatgtagtgctttgaatgaatcagagaaaagtaaaaaatttgcagcaatatttatattatttttaagagaatttttttgattaattaaaaattacactaacctataatactggtatcaaatattgcaggtattatagaaaacaatgacaaaggaactataagttgtatgaatatgcaagaaattaattcaggtaaaaagttgaaaaaattcaatcatagttcttcagtaaaaataaacaagaaaaatcatcaatctagttgttcaactacgttaattttagaattgtagaatagcactatttctttcatataatttcttttatgattagaattttcaaaatttctgcagaaaatggagctaacaatgcaaaggttgattatgaaaacaatgttctatctctgttggaccaagactacattgcagtaagtttttggactttgacaaccttaagtttgatataatttcttttattttctttgacaatcaagactacattgatattttgttttttttttatcaaacaggattcatttatatcatacactagtctaatggaacatattatttcatcacaaccaaaacgttgcaatgaattgaaggtaaatttttttttgaaaacaaaagtattgatttgttgttcatttatgtattcatgtgttcaattaagtatagtttttttgaaaatctttcaaaaactgtttaattaaggttgaaggaacacaaaatgataaaataaagactggaattggacaagattatcaaaaggttgatgaaagtttgaattcacacgttgaatatcaatcagaacaaagatgctcga

SEQ ID NO: 9003 - DNA, 1501 bp, Oryza sativa
gccggcgccggcgctcggggttcctggcgttctcagtggcctcgtcgggctcggcgtcggagcccacctcggcagcggcgacgctgccatgttatcaccaccacaaagtaccgttctcttgtgggtgtgctctcagttaatatataggcatatgagcgcagtcgtgtactcgtgtcatagagatcgaccaagtgaaaattaaatacgtcttttcatattattaatcctatattactgaaattaataaatttctctatttttcagcaaacaggctctctcaaaaaacctttctttatacgtacactgtttgttttaaaatattcaagatttatttattagaatatttaatttatttttattttttgcgatgaatttaatttatttttttattacatacataatatgctgtaataatccgtttatagtaatctaaatctgcgttcgtttctcttgttggatgaaattttggatactcgtggaacgcttttcaaactgctaaagggtaagtttcgtgcgaaaactttctatatgaaagttgctctaaattatcaaattaattaattttttaagtttataataattaaaactcaattaatcatacgttattattacctcgttttacatgtaacacttaatcttaccttcagcttaatattcaaacatcaccatagccaactggctagatcaagactggatataaaacgatggtgcgctgaatttattgcatatacgatacaggtgtgcagtgtgtgctcgatgggaactgtatctcgctggtcacccacacggcgctggctgtcacgtactggtaaattcattccgaaataaaaattattccctaaaaggaataatagaattaattaaaattcgaaaaaaaattagcaaacactaaaatacatacaagaaaaattcgaatgtggtccggagaatttttgttaaattctccttggtctaaaaggagccctcaaattttacttgaattttcagagcaccgaaaatatttattaagcaacaacaacctttatcaaagtttattaaaaagaaaactaaaaataaatcctccttcctcctttgggccaagtcgcctccctctctctctcggcccgcggccaaagtccttccctcctccctctctttttccttccccctctctctcttgggccgccctccctccttcccctcggcccagctccctcccctcccctctctctcccgggcctcctctccctcctctcctcctgggccggccgcccggcccaagccgcgccccccaggccgagccgagccagccgcgtgcacgcgcgctgactgcacgcgctgaccgcgtggggcccacgcgccggtcgtcttcctcctcccgcacggcctcctccctctcccgtgaaccctagctcctttcctcccttaaatccgtgcgatttaatcatgggattccaaaattaaatagggggaattagtccccattgattcctctttgatttcccccgttttccccctggaa

SEQ ID NO: 9004 - DNA, 1501 bp, Oryza sativa
ttaaacaacatgatctaatcgcacatgaacaacatcacatcgttgatgaaagccaaataacacaatctccaaagtaaaaaacataagcacacacaaaatactactactcatccaaaaaaacgagatcccaaaaatcccctcctcataaacatgaacaaatcccttcctcatcaaaagcaaaaacaatccactcctcctcaacagcaaacaaccacccacctctccccccaattaacagcaaaaatcccccactcatcaacagaaaaaaatccactcaaaacctcaacagcagcaacaacccttcccaccgccccacccacctctcccccccaatcaacagcaaaaatcccacacacatcaaacagtaacaatgccccactcatcagtagaaaaaaatccactcaaaacctcaacagcaacaacaacccttcccaccccccacccacctctcccccccccaatcaacagagaaaatcccccacacatcaaacagcaacaatatcccactcatcaacagcaaaaaaatccactcaaaactcatcaacagcaaacccaaaccaaaacgaaaaaactcatcaacgcatgcagttgagcagattcaggtgatgctcgaaggggaatggaggaagaatggacgaatctaccaacgaatcgccctcacgtcgagctactcaccaacgaatcgccctcacgtcgctccgccagaatcgccgccgcggtgaaatggccttctgttgacgacgacgaaatcgtcgccgctctctgctctcctctcctaaaagcgttctctctctctctctctatgtcggaagaaatgagaaaattcagtaaatgtgggacccacagaagagacaagaaaaaagcaggcgcggatttcaaaattgaacagttgctgtgggacccacgaggaatcaataaaaaggccagcccaatagataaaaaagatcggtagcccaaacagagaagtccatcccacaacccaattattgcacgaatcttaaacatgatggacggcccaaaaaacgaaagatggagcccagcaaaatctgtcgacagaagagtagccaatccgttaaaaaataggtaagactttcgggactattttttgtccgtcgtcgttcgtaatccgcatcacgcttcatcctggtggccgctatctcatgcttaattagcacgtaccaccgtttatgaatttgaaaatcttattatgtttttcttctagcataacaagtcacgtcgcatacatttttattaggagatgtatcagatggttttgtgttccatgactttgtgtaatcgggggtgagcatgatacgacgcggtagcaagccttatgagcaaagatcataattcacaacatagagaatccattatatgcccctgactttactctagttcaatgatttgccatcttcctctataatatgccaccgactttgataattttttctacaatataccagaatggatacttttcaaaaatacctaaaatgcccttcaa

SEQ ID NO: 9005 - DNA, 1501 bp, Oryza sativa
agagggcggaacggcgacgggaaacacggccggcggccatggaaggcggccgggaatggcgcggccgttccgggcgattgggggcgccattccagggggaaaacgggggaaatcaaagaggaatcaatggggactaattccccctatttaattttggaatcccatgattaaatcgcacggatttaagggaggaaaggagctagggttcacgggagagggaggaggccgtgcgggaggaggaagacgaccggcgcgtgggccccacgcggtcagcgcgtgcagtcagcgcgcgtgcacgcggctggctcggctcggcctggggggcgcggcttgggccgggcggccggcccaggaggagaggagggagaggaggcccgggagagagaggggaggggagggagctgggccgaggggaaggagggagggcggcccaagagagagagggggaaggaaaaagagagggaggagggaaggactttggccgcgggccgagagagagagggaggcgacttggcccaaaggaggaaggaggatttatttttagttttctttttaataaactttgataaaggttgttgttgcttaataaatattttcggtgctctgaaaattcaagtaaaatttgagggctccttttagaccaaggagaatttaacaaaaattctccggaccacattcgaatttttcttgtatgtattttagtgtttgctaattttttttcgaattttaattaattctattattccttttagggaataatttttatttcggaatgaatttaccagtacgtgacagccagcgccgtgtgggtgaccagcgagatacagttcccatcgagcacacactgcacacctgtatcgtatatgcaataaattcagcgcaccatcgttttatatccagtcttgatctagccagttggctatggtgatgtttgaatattaagctgaaggtaagattaagtgttacatgtaaaacgaggtaataataacgtatgattaattgagttttaattattataaacttaaaaaattaattaatttgataatttagagcaactttcatatagaaagttttcgcacgaaacttaccctttagcagtttgaaaagcgttccacgagtatccaaaatttcatccaacaagagaaacgaacgcagatttagattactataaacggattattacagcatattatgtatgtaataaaaaaataaattaaattcatcgcaaaaaataaaaataaattaaatattctaataaataaatcttgaatattttaaaacaaacagtgtacgtataaagaaaggttttttgagagagcctgtttgctgaaaaatagagaaatttattaatttcagtaatataggattaataatatgaaaagacgtatttaattttcacttggtcgatctctatgacacgagtacacgactgcgctcatatgcctatatattaactgagagcacacccacaagagaacggtactttgtggtggtgataaca

SEQ ID NO: 9006 - DNA, 717 bp, Oryza sativa
agacgcccgttcgctttcgggcaccgcccgtcaacgaaatttgcaggcggcccccttgccgccctccgttaggccgattttatactgtgcggggggccgcctgcaatggccggcgaggggggcatggaattttgcaggcggcccccttgccgccctccgctagggcgattttctactgtggggggggccgcctgcaaatgggcggcgagggggcatggaattttgcaggcggcccccttgccgccctgggggagggcgatttttgcctccccctataaagcccagtccctcctctgtgaaatttcattatattcactaaaaatccaaaaaaaacgagagagagagaggggggagggcagcagaagaggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 9007 - DNA, 200 bp, Oryza sativa
ctccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagt

SEQ ID NO: 9008 - DNA, 1501 bp, Oryza sativa
atgttaatgtgatagaaaaggactgaagcttggatccgaactttggatctaaacacagcctaacacgtgtactacgagaaacacactgcgaaccgtcgcatcgctggaggacgtttgaaaatcgaaaccgaagcccggccacggcactggaccacggaaactggaagccactcgagcgcacccaccactccgtccgcacgccaccacttcgtccgcacgccccctcctcctcggctgcgcggcaacgagtccaacgagtcccccattggattccctccgccggcacgcatgacgcctccagcacaaccaacggctacctgctgactgactgactgactcctgaccgcctttaacttttaacggctactccactcaaagcggcccgccaacgggccccgctgggccccgcccgcccggtcaccggggattcgaacgtttcgccctccctgcgaccaccaacggctacatcccacctataaattccccctcaccacgccgcccatttcccgcactgcaattcccacacttgcacgcacacacgaacaccacagagagagtccagcggcgcccggcgagaagcttcagccaagtcacagcggcctcggcttcttgcagctcgctgctcttccctctcttgatcgtgtctcgtgccacacatcctcgtttcgtcatctccatggcggcgtcgaccaaggccttggctctcctcttcgcggtgctcgtcgcgctcgtggcggcgacggcggccgtgagagtgctggaggaggaggccgtcgagctgggcggcctcgcgcctgctcccgcgccggccaacgcggcgggcgccgtcgcgccgggggcgtgggccgtggccgcggtcgtctcgctcctggccttcctcgcgcattgagatgagattcgacccctgagagggcgcagcgggtagtttgcggaatctgttgggacgggaatcctgtggtttggatttccgttgcagcggtagcatttggtgtttatctgaggagattattgctgtacgtttctatagttattttaggcgtgtttgttctagtccgttatggaggtgttgtgtactgccgatctctcttttgcctgtataagagaggaatatggttttgaataatacaattcatttactattcttttataagctctgtcctgtgcactctcagaaaaactgctcataaagggccaaaaatactcggaacacgttggtactacactcggaaaaaggaataagttcatttagtgaccctcaaaagtgattgaaatctaatccgtaaccttaaactacaaaaccggatatctcgactcccaaactcttaaaacccaccaatttgactcccttggtggttttggaggacggttttgctgacgtagcgcctacgtggcggtattgaccgggtctcttttacacgtggcgttgacgtgacgtttaggtggcatttagaattaaaaatatgtgtgggacccatttgtcattgacatgcaaaagaatttg

SEQ ID NO: 9009 - DNA, 1501 bp, Oryza sativa
aggtctcgatggactaaaattcattttctatattgggctatttagctctctaacttaatataaacctatggcccatgaactaaaattatacggtacgtagtatatatactatatgtttatatagagggcccctagattttggggcctcgggcggccgcacggcctgacccccctagggccggccctgcccccacgtgccgcatctacagctcccctaccggtcagatctgggagatgttgagggagaggtggagaagagagttggatccatcccctacatcgtcgccgcctgtgtccttccctacagcgcggctacccagtgctgccgccggagggagggaagggccgggttgccgtcgccactccctgcaacacggctgcccagttgtcatggccacgcgctggactggccgcgccaccgcctcccctgcgtgctgccgcctccctagccatgtcaccgctgccagcacgccgcctccaaagttgtcgagaaagagagagagaagagaggggttggatatggggagccgagaaaaaaaacagagagagctgaaaattttacttccgcgttgtatttaatctctcccgcgattttcgcaggcggtggcttcggtggccgccagcaagaatggatacatcttcgttagagagtttaatagtatagccaactacgggcttcaaattatttatgattcatctaataaactattcatataatagttaactataaaaatatactacaccattaatacccggtcctacctctgatacacacgtaatgtattgaagtccgtgttacagctggctacaaatctatagcccgctttcttttctctcttctcttttcttcttgatatgtggttatagctaatttatagtatgagcaggtacaatagcagactataagccagctataaacatattttaaagagataaaagaggagagaggagcagtgggctacagatctgtagccagctgcagcacggactccaagacgcaatgtgtgtatgacaggtagaaccatgtattaataatatagtaagcaactattgtatgaattgactattaaattggctatacatgatttagagatagtagttggctatactattaaacttgctcttagcggccctcttatcctggccgccagcaaatatccattttcgatggtggtccttagcccctcactcctcgttacattttcactggcggttatcgtgtatggccgtcagagaaaaaataggttgacgccatgaaaaattgattttgtagtagtggataagccttaagcccctaacgtaccccatcaaatgtgatcagagtcatttttgacggattgatttttcggaccatcacatataagtcattcataacgggctgtagtttaatcaagcagaggggtgcacctcatgtcctcatcgatgatgggatttcattaagacccatttaaggtaattgtcataggtgacggcttctcgcccaacatatgatttcatatca

SEQ ID NO: 9010 - DNA, 1501 bp, Oryza sativa
  unsure (1)..(1501): unsure at all n locations
tatttctatatggactttgtttttttctttttctccgattaatgtgagaatttctaggccatgacagcgaacgtggatgctccttttttttttctttaattatataatagataaataaatgcatgtttacttttattatagtgctataaaagacaaatctatatatgttgttctagtttctttaaactaaatatttttaaagttattgatggtcaaagttataaaaatttgatctcaatcttgtccaaaacatcaattaatatggaaccggagggagtagtattcgttggagaattgtaaaaagaaaggattgcagaaaagctacatgtgagataaagttgataggggacattcaacaatcatcagaagcacacacagtaaactactgtagttagtagagctcaaaagttcagtacaaaccacctcgaaagcgagtgtagtggagagggcctgaagcatgtgagcttactaatggtgcatgcaaaggcaaagcanatcagagccctgtgattgccgcctgattgcttcaaaagtggagtacgcctcacttgtcgtagctgttactactactacgtgtattaaccccgtcacgatgaaaatgaaaccccccccccccctcttgtagactgtactacgatttcaattgtttgtccttgacctccagcccccgcttgtccttttggggtacagccccgtttgtccangagntgttggcttgcactgtcccccccncccccccccccccccttggcaagcagccaaacggtcacgcaaagccaaagcatctccctgtcacgtacccgtacaagcgatgcgcttttcgagcagcagcggcagcgatccctgagccgatcaacgccggctggctcgtcatcctgccctctgccgagacggtcagtgcctgcaagttggccacccgccatgacccatgtgggtgtggctcacaaccccggcgacggcgccggctccgcgcacaggctaccgctcgccccgcgtcgtcccacggctcttccaggtccggctctgcgcgtcaccccgcgcattaacgcccgtgcagccggtgcgccaccaaccagaaaaccagagagacccacgtaacgttcggctgggtgtgcggtgcgtggcgtggcgttcccaaggcgttccagctgcgttcaaatttgaaatcaccggtgcggtggcctcgtgggaggcggtgccacgatttattaatacgcaaacaattccgttttcccttgcacgagggctccttttcttttcgccgctacctgcgcagcgccacattcgcctgcattttccatgagccagtcttccccgcgtttgctctcatcgtaggccgcgaccgacggacgcggcgagaggatagagaccaggggcggccgggcggacggacagagcaaccagcgccggctgccggcttagctagctcgcggcggagcatgccgagatccaggtgcgtgacctgcgatagcgaggtggtttccccgtcgaggtgttccca

SEQ ID NO: 9011 - DNA, 1164 bp, Oryza sativa
attgggggcactggttagtggcttgctgctcgcaacgcgtgttggggcggtggggtttggttgaaggaaggaaagggattagggttgatgggaaatagggtgttgagtttttatatgtcaatttgaaatgggcttgctggacttgtattgttgcaatgggctatttttaaagaggtaactcacatctggggtcacttcgggtcacccacgggtttacttccgatcctcgccctggcccggaaatttacgggccccgtccccactcacccgtgggtgagaattctcccccggccctggccccgtaggggcggctccccagccccaacaggaaaaatgccacccctatgtatccgctttgaccaaaccatatgttagagtggccacctcccccttaaactttaactacagcatctggactagtatagtcccaagcgtattatggttattttgtaaattctctcgttgagttggcaaaaacaataaaatattgtaggcggggccttaaaaaagtaacaaaaaatcacatttttaaatgcctatgagcgacgaggccacgttttttcctctccaacaaagaccgtatttttggaatatcttctgataaattttttaatttatgtaaattagtatgcaatgcaactatacaattttctaaaggtggaaaacaactaactacatgcatagcatatgttggacatgttcgactgacctatacaattctcactgccaccttattgctagctgctacaaaaagtgaattggtgcagacaacggggtaacactatactacctccgtcaggttataagactttctagcattgcccaaattcatattcattaacatatatatgaatgtgagcaatgctagaaagtcttataatatgaaacggatgaagtattagatagccgaacaagtccactacccatatataaactagtatagaggaagtagtagactacttgaacataaaagccatgttcagccggaggacccaaagttgccgatggaccacaacattgtactttgatttcatgattaattttaggccggtcattgctcgtgtccttgttctacgcctacgttagctgtctaaaaaacctacactgccaacgatttttaaagaattaatcaactccatgtataatttgtgaattgtgggcagg

SEQ ID NO: 9012 - DNA, 1501 bp, Oryza sativa
  unsure (1)..(1501): unsure at all n locations
cggggttctctctctcatacgttcgccgatctcatcaaaactacttttgccaaattagatcgaccggaaattttggctagaccacagcggtaccatgcatgctttaatcgtgcgtgtgagctactgccgctaataatctatctatctgtatcaatcggatacttcaagagagttctcacgttaacgtaaaagaatgtagttattgactggatggatccagaagcagaatttcattggttttagaacccttttagttttaaaagcatactctcatgaaacttacttgtaacttaaatgagagttgttgtattacttacctccttgcacaaatgtaagacgttggttagtttaatttttagctaaccaacgtcaaacaaaaaaatggagggagtataaaacaaactaactaattttgaatgctgaaattcaccatacgttatacaagttgtttctaaaatttaaattttaaacttgattactattttctccatcgaaatattttttttagcatttgacatttaaatcactaaaggcatgtgtttcatccattctattgctaattactcatgcagcttataattagcattagccaatggcaggggcggatccagcatgggggcggcggggtctcgagcccccactactggcgtgaagactatgagagaccccacaaagaccccactaaaaatttttaccatatatagatgggagggggactgtaactctatctagtttgctcagaccccactgctatttttttctggatccgccaatagccaatggagtcttaatagttttgaagatcaaaattaaaaaaatataaagttgttctcccaagttgctgtattttaaaatatccaaaatatttagcataaccacaatattgacaacaaatatcccgtaccatactcgaccaaagatatttcttttgcgtgttcgcgtacactgtggctagtgggtttttcacgtgaggaagatgtgcgtgcctggatnnnnnnnnnnnnnnnnnnnnatgcacctatgcagccatgggccggccgtttccccggtggatcgtgttcggacacgtcgcggcccctccacgacggccttggctccattgccaccaccagataaagtaggcgtgcatgcgccccacccccaggcgagtcagagcagcgcgcgcgcgcgcgcgagcgagcgacgccgtgagaaaccagagcaccaaaccgaaccgccgtttctcgcgtctcgccctctccgtgactctgcccgcggggacccgcgctgcagggggagaggcccacccaaccggcaggtgccctcccccgctctatatatacgcccgacctctcccacttctcccccacatgcacttgcagtcagtggtacaacaccacagcaacgcaccaccggccatcaacctcctctcccctgcttctcgctcgctctcctgccctgtttcttggagaagtgagcttaagtgagagcctctgtccctcgcacacgctattggccatgg

SEQ ID NO: 9013 - DNA, 236 bp, Oryza sativa
agccatacgactgtaggaaaagacgaaaaggcgccccaccccttttctaatttggccaaggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagt

SEQ ID NO: 9014 - DNA, 220 bp, Oryza sativa
aataaaaccggaagcaaaaaaaaaacagaaaaaaggattcggcaaaaaaaaaagacggaccccctctctctctcgttaacccaaatctacaaacccctcccccccttcctctctctcgtccgttccggcgccgccgtgtactcgccttccggccgcggccggcgtcgcatatcatttcgcctccctctgtatcatcactccgctccaccccccacgtaga

SEQ ID NO: 9015 - DNA, 1070 bp, Oryza sativa
actgtatttgaccggtctttattggaattatgaaccctggtgctgtgctgtgtcgtctgagaagctgtttttacagcattgtttggtgtaaattgatatccccttcgtgactctgtctggatatgttgcctatatctttaaggctgagttcgtttgttgcagtcagaaagtactcattagcatataattaattaagtattagctttttttaaaaaaatgtattaatatggttttctaaagaaattttcgtatagaaatttttttaaaaaatacactgtttaatagtttaaaaagcgtgcatgtgaaaattggggatgtgagctgaaaaaggtaacaaacgaacaaagtcgatgaatctgtccacgtcccgtattaagtttgtttattttaggtaaggatgtaaatgttttgttcaagcaatgggcatttgatcggaagaaatgtcttcacagatttgttcagccaataaaaaaatattattaaactctccttactgtgtatgcttgctgaaatctctcgttgaagattccacgtgagtatactcaaagctgaaagggacccaatcacaaactcacaatgcatgaagtaccacatgtaaataaaaattagcatggccaattgccattatttttgtgttcaaatgttcaaagcctgagcttccccgtcatgttagaagtcaggcttctttggaaatgggggatgaatatgtgcatgtgcagccgtttaggatggacctatggactggtgaagtacactgaactcattaccatattgcaaatcttattttactgtccagatttacggatcctgacaaggacacgtcatgccacagtgccacttgtgcaacaggttggaaatgtatacacgaatcatttgccaacatggtacttgcattgcatagtttggtccaaggaaactgcccattgacgcaaaataactggcagactgaatttagtcttatcaccttcgtagtagtatatagaatgttagaatctcacttttttctgcaagtttgggcagctagttccgataacagcttgcattgcttgtcatttgaaagatcagcttga

SEQ ID NO: 9016 - DNA, 1501 bp, Oryza sativa
tcgtgcaataaagctatttcgttctttggtgttatacaacgaatatatacactattttcatgctcgacaaaaagatggaagatttttcttgagaatgttccacacttgactgtcaaatcagtgtgtaatacacgatgggagagtcgaataaaaagtgtccaagctattagataccaaactccccaaataaggtcagctttgttggaactagagaaagcttctaccgatgacccaaaagctgtgagtgatgctcaatctttggtcactgcactagagaattttgaatatttagttggaatggttatttggcatgatatattattttctataaatatggtcagcaagaagttgcagtctgagattgtgtgcatggatgctactctcaagcaaatcgaaggtgtcatatcatttttccagaggtacagaaatgaaggcttcacttctagtatagatattgcaaaagtcattgcatctgacatggatatagaaccaaaatttcctacaaaacgtcaagctaaaagaaagaaacattttgatgaacaaaatgaccaaaatgaagaacaacaatcagttgtggagtcctttagagttaattacttcctagtcatgattgatgttgcaattgcctcattgactagtcgatttgagcagttgaaggcatttgaaaatgtgtttggtttcttgttcacctcaaagaatttgaaatccttggatgatactgatctatggcagtgctgcactaattttgtagagacattttcacataataactcatccgatgttgagctaaatgacttcttttctgaattaaaagtgttgcaagcgactttgccagatgctttgaagtcagcacctgagattcttgaattcattacagctgcagattgctatccaaatgttttagttgcctatcgaatcctcttaactgtgcctgtgacagtagcctcaactgaaagaagcttctcaaaattaaagttattgaaaaactatttgagatcaaccatgtcacaagaaagattaaatggcttggctatgtgctgcattgagaagaatgtcttggaaaatattgatctcgataccgtcattaatgattttgcatcaagaaatgcccgaaggagtatttttttatgagaagcaaatggatatctgtcattttatcttttgtcaagtattattaatgaagtccctagagcttgatcctaagtcaagaattcaaggtaaccatagtaattccattttaatgctcttttggtatttttagcaacatatatagaggatattatcaatatttattttcagcatgattagcggatgaatgcttcaaaagtatactttaaaaatccaaagtgcatatgtgtatatagagagagagtgtatgcctaagggcccatgtcatggagttggcctagggccctaaaatatgtagagctggccctgtacacagtataacgtagacactcaacgcacggcaaatcctcgagattgacgaagtcaccacaga

SEQ ID NO: 9017 - DNA, 1501 bp, Oryza sativa
tacgagcatctctagaagttttagcagtaattaagatatatggttgtgattgattgagataaaaaaagtagatgaaaataattgaataagagatttgtatggttgtgatcgaatgagatgagaaaataagcaaataaataattatattatagcactatgacaaaatgtatttttgtaaacggtcaaaatgggtttgcacagatggttcggtcgaccatctctaatcaaatgcccacaatagtattgcatttccacatgcataaccgcagccgtatgtgcaaacacattgtcacaatcggtccacgtaaagatctgcttgcgtgttaataatcgtttaataaacactaaaaaaccaaagccgccgccatcatcgttgtgcctcgcaagcccccccccccccccaacttatttttacacgcgggtaataattctttcgggctttcgatgaagtaaaatatggcatgttaaaaataggtttttagtgtagtataatttttaaataaaaaacacttactccatattttaaaacctaggacagtatgacaggaggagtacatgcattcctggagatgatcagtgtgatctttctatcgctagctaaggtagctatagtgctgaagtaggcaggcaggttggtagctaggtaggtaggtgggtgtgtgcttggcctactccaaatgttcacttttggatacttccctgcctgactgcatgatgctgccgatggatgggggatacaagagagaaaaagagctggctgaccaaggtactcgtcggggaccgtagtaaacccccgcatccatcggcgcatgattggcacacaatacgattcttctcctccttcttcttcttccttcgctctacggccgggacggcgccggtagaggttgagctgcgctatcatcctctcccatatcccccatgtgagctgttgttattaggagcaagagatcaatctagcttaattctagtactgctaaatcatcgcatcatcaggcgcatctgtcccgctttattaggctagctttgctgctttaatttaccacctttccggtgattagcactgctagtttctcgatcgatcgccggcttttcttttttcggatatatgcatatcggtttaagcttaactatgattgataaagcttttacgatggtctctgctgatataggcatataggcatgtttaatgtgtacgtctaatatgaagttgactcttatcacaccaaatgtgatagataaccaacttgcacatgcatgcgtgtgtggtgtccgtagaggctgccaagcactccctttcatgttaattttgagggtgtgtgttcaccttaattttttttttagaattacatagtcaggaccggctctgggccacggcaagaagtgcgatggcctagggcccagaaaaagtaggggcccagacctaggtatgtattaggtataccatatgcacgtatacaagtttctgatcgaatcattgggcatacacgaccgtccaagt

SEQ ID NO: 9018 - DNA, 1501 bp, Oryza sativa
gattattcatggcctgttttcaggagtactttctcaaaaaactttttatgtcagtattgcttagtttttttgggggggtaagctgtcggcagctttatatatttattctacatatatgccatttaacagaacaaatactttggaatcttacaaattttagatcggccgatagctttaagattcgtgccaacaccaaacccattcttcctctctccctagtctggtgcccccagtagaccagccgcgagtcacaattgatccttgcctccttcgtcgccactgcgtcattgcctggcctcaacagttggccaaacagcgccaacgagccccctgctggcttcctcccccttcccccccacacccttcccccttcactttcccaagctggtgctagcaagtgccccgctcgccaacttctccgtctttggtagccccccgctattggatctaccaccaccgaccggtacatcctaaccacaagccttgactttgccctcgttgccagcacccgcccaccaccttcctccatctccatagctctggcaccaccaccgcctcaccgcccgcccatgttcaccacctatcatggggccacctatatctctaagcctgacgatctcccctctattccagctctcctcacccccaccacaacttagcactctaaactgtaaatcgtcggaccgcccttagttgctagagctggaggaggagaaaaagctaggattatcgaatcacgaaacaaagcttaaggtcagaaatttacaagattttggacttaatattttgttgaatgtgatttatcaattccaatatttattaattcattcatcgttttctttgtctgtaattgtcggagatatgggcccgggggtatgtgaggtagaggagaattactcttcctccggccacgtggcttggccagatagccccactcacacgccacacgtatcatagaagcagcgggagggggggggctcggggtacgacgtcaccccctcggggtatcacatcgccccctcggggtatggcatcgcccccttgagccctaccgcaccttcgccccgaggccctcgccacccccttaaaactataaaaggaggaccctgcccacagtgcaagggtgtggaaccagagaaaacccaaacttcggaagagaggaggcaagagtgctctccaaagaaaaggaacccttgtaacttcatccataatcccaaacacaggagtagggtgttacgctctattgcggcccgaacctgtataatctgtttgtgtactagctcactgagagtcttagggacgacaaacgaattctgagggacgagcctccgcccccggccgaactcacgaaaggggggtctcacgactccctgttattgagggttctccctcgacaggtggagcgccaggtagggggcggttgtgcgtcccgggagaaagttgttttcttccgtcctaaggttttccaggacttggccgactatggtcgaggtcctggaaa

SEQ ID NO: 9019 - DNA, 1232 bp, Oryza sativa
aaattcggaataaaaataagcactattgaaagaagagatcatataagaatttaatatgagattaattaatattcaaaataaaaaataaaataaaatatgaaattagccaaaaaaaaaagaagagttcaagtagaaatacaattaaaaatactgaaattcagaattaaaattaagaaatattgaaataaaagtctatataaaaacccaatacgagattaattaaaaattaaaattagaaaaagaaaataaaaaaagttcaagtaggaatacaattttgaaacaagtgaaactgaaaataaaaaataaaaaataaaaatattaaaagaacacaatgcaatattaattaaaattcaaaataaaaaataaaataaattctgaaattagaaaagaaaaataagatttcaactaggaatacaatttataaataactaaaattggtgataagataataaagaccattgaaagaaaggaccatctaaaacacatgacgagaataattactccctccatttcataatgaaagtcattctaacattttccacattcatatggatattaatgggtctaaatagatatatatatatatatatatatatatatatatatatatatatatatatatatatatatatatatatatatgtctagattcattaacatcaatatggatgtaggaaatgctagaatgacttacattgtaaacgggaggaagtaagtaataggcctataaaggagtaaagtagtggtgggacatctaaaaactattgataaaacactaaatagaatcctaattacaattaaaaggaggaacgacaggcaagacgtgaagcaaccagtcaaggcggttggcgggacttctaaaaagtaaaaaaaacactcatgataatcatattcgtttttaaaatttcaatgacaataaaaagcgggcgtgttgtacaggggtatagtggcagagccgccgacggttggcgggacatatagaaagtaaaaaatgaattccaacgatagttatgttcgacttttagaatcccaatgataataaagagtagacgacggataagccgtagaggagtatagtggcagcgtttgaagtgacttcgaaattttatagaaaaatgaaaccccacgacacaataaactctaaaaattacaaggtccaatttttaaaggttcgagacatctaaaaataaaaaaaatcccaatgataatcatgtttgattttaaattctcaa

SEQ ID NO: 9020 - DNA, 1501 bp, Oryza sativa
aataaggggtagcaactagcatggcttttaaaaactataaaattagaaacacgtggatgataaggtttaacctttcaaagtcttgatacaacaagatagctatttaacaattttttagtaaattcatattaaataatagataattttatatgagtgctagccgtgcaattgcgcgggccacgcagctagttccaatataaagtatacatctatgttactccgcatgcctctaatcattgagcatttcagttaaaattcacatcaaaattttagtagaaatttcactactaaagtacagcctatcaatgccacctctatcaagtgttggttggattaaacctgacactggtaaggattctgccccctcctcctggaacccatgcatgatctgaaggacaaataaccggtactgattacgacagtatcgatcggaagaaaaaccagtaggcactaatgtgatcagtgtcagtttatttaaaaacccaacactgatgaactaatttattagcactagtttgcaagtagtgcaggtttatttaaaaacctaccggcactgatgggccaaacattaatgccggttaaggagaaaaatggcaccaatgacaggagcccttcagcccgtaggccaacttaaaaaatattattaaagtagacgtctcacactctaggacactactttccaagtaaacccctccctcgcgctctccctctcagcctctttctttgacggcgacgacagcgtgatcctcctccctaccgtctcgcagctacctagaaattgggtgccatagcggttgcctggagcgtgatccttctccctccctattgacaaggccctcgcactagtacagatccttccatctgtgacggcccataacaaaactggaatttgcgggccgtcacaaggaagtaatctcaatcgggccgaagtttcgcccgattgagatatggtcgcataaccatggtatatcggcataaaactaaagcccgtcacggatgacacttatctgtgacgggctatagttgaggcccgattgacatgagggttccatatctcaatcgggccctaaaagaagtccgtcacagatgagggtcatctgtgacgggctccaactagaggcccgattgagataagtttaatgcccgtcacagatgacactcttttttgacgggcttttattaaggcccgatagagattacttgtatgcccgtcacggttgattgttttagggccgttacagatatttgttgcacagtataaatacccaccaccacctagtgtaaatgtatcccactgttcactattttggtgggaggctgtagagggcgatttttttgtcctttttccaaggaaaatagaaattaaattcccaaaagtgatcaaaatggatcaatcaagtgagtaatattattcattaattgagcaatttcatcacgtcttacttttgcaatactgatcttataatatgtgcctctaatttgtttttttttattttgtagc

SEQ ID NO: 9021 - DNA, 1501 bp, Oryza sativa
cgacttgcatccatcatacaacggcatctggcaatcttccaccaacttactaaacttctcataatctctgtcattgtcctctgcgtcttcaatgtcatgcaacattgtagatagacattgagtgtccaaatctatggtctctccacctaaagcagaaggtacgaacatgccttctcgagctgcggcggtgttctctacatcctgatccaacacttcttcagctgcgacatcaggcgcctcttgctctccatgcttggtccaacaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtatatccatctacgatccatctgaaatcaacaacatacaaagaaaaataaatgatgatcgatatgttgagaatgaatggagaataatgtgttttttaccttgaattttagcaaaaaatcgcccccttgccctcccaaccgatttgtgaacagtaaaatggtcgggatggaaagcagttggcagtttggggggtattatagacccaacacacctcaaacgggttagataaaaaaagcccgtcaaaggtattggtcatacctttgacgggcttctattcagtggcccgtcactggtatacctttaactgttactgctttcagcccatcacaggtgaggggatacctgtgtcagctctgagacggatggctgaccggcgacgttatacgtgatgacctcctcagaggtaatggtcactcgtgaccaattcgtgtgccagtcacaagtgtcccttcttacgtgtcaggatctggaggggatgtcttagctagctcgctaactcatgctgtcgtttcttagcacaccccacttgctagctagctagttatgctcgatcagtgctctgtcgcgttcgatcgacttggatcatgtcatgaaggaggcgtgggacatgatcgagagtttcgtgcagtctagccgaagatgctcctccatccgatctgaccacgagcagcgtcggaatgtgggtggagctgatcgagcctgttgcctctgatccaaataaactcgagcaggaaacgcctcaggtccggccgttgcacaagatcgagacaggacactgccgcatgcacaagcttgcattggtgaacacaaaaaagaaacgcgcgaaagagagcgacggaggtgcatgcacagtagccgtggaccaccgtaccccaacgcgttgatgcaaaaaggacgcgctcttccatattgagcgatatagatgcaattaatgcagtgatcgacctgcacatacagatgagtatatatatcccgggaaagtttcaggtgcaacaaacccacccaatcagttagctagctagctggcttattgcaacccac

SEQ ID NO: 9022 - DNA, 435 bp, Oryza sativa
ttgggaggaagaggagaggaaggagtagaagcctcctctctctcctctttatttcatttcaaggcagcatttttattttaaaaaatgtaatatagtacttattagtagtgaaattaataatttgtgcccaattagttgttttgatacttactacatctgtcctaaaataattataattctagattgtttagtaatatatattaaggtttgagaggatgtgtatttgtgtgtaaaataagaagaaattcgaataaaaaatgatcaatgaaatcatcagtattctaaaattctataaatataattattatgggacatagacagtattttgacacatttttaataagaagaatagtagtagtagtaggtgaaattaaatactgttttggctagacagtctgacccaattaagttctttgttatcaaaggacttaatta

SEQ ID NO: 9023 - DNA, 1501 bp, Oryza sativa
acatccttagaataaatctcggtattagaggggtattttatttttttcaaggatcaactccctccatttgcatcggccaattagccgcattctagttaatttgcaaccttagaacttagaagaacaacacacacatgtatagacatccacgtcaaagctagcgccgccgacgacgcacgtatagtatttggccggttacattccgctgttttctccagcagacaaaacaattattgcattgcattggtacgtctcttcaattccattcaaaaaattattgcattgcaatattggcctcttccagagagagaggctcaagtcccatcaaaacagaagcaagctaacgatcgagcgagatcaacttggcaaagcgagaatcttgcgagttgggtgccggctttggaggcatcgctacgcacaacccctgtggattccattgcccccactaatgatctctcacaacggttttaaaattgttcagggtacatgcctgcaaattaattaagcgatcagagctaagctagctagctacatctggcttatgcatgcacttggagtacacacgtatattaattaagcatgcctggattatggagtattcgcggctagctcacatgcatacatgcatggggtttaattaggagcaacatttggcaggaatcaagtacgcctagtgcagagtgttaagttttctctaacttcttttggcgtcaggcgtacaaccctaattaaagtataccatccctctattttcataatataaattttgtttggaattatcttaagtcaaatttgtttacatttgactaagtttatttgactaagtttatagaaaagtacaacaatgtttattttcattgcaaaacaaacaaacttttaaaaagtatattaaaatgagtcaacatatgtagcaaccatctaaccatgtgctttcagctaggaacgtacgtccttgttctccaaaagttaatccaaatcggcaatgggcccttaatcgcacggacccttgcatgcatgggccgttctgttgcagccgcgcgccttgccaaccgcgcaggttcaccgcccctgccagcaccctgcaacattccattgagagtgattttatactgttttcaattcaaatgatggtacatcatcctcaatgacaataaatttttcttcaatttaaggtagaaaaggtggaggaagaaagcattcgtttagaccaaaccggcacatcaatgtatgtatgttttgcattatcaccagctacacgcatttacgactaattaattttttaagtgataaatgatatatccgtcgacagcaaggtttctagatgtttatggtgacttcggccctgtttacatcccgtaccaaaactttacaccctatcacatcgaacatttaaacacctacatgaagtattaaatatagactaaaaaataactaattgcttagattatgattaatttgcgagacgaatattttaagcctaattgctccattgtttgacagt

SEQ ID NO: 9024 - DNA, 1501 bp, Oryza sativa
atttccagcagacattccaatcattaattgttgtccacactgaacatcccaactagtaccatgccaagcactaaaagcactcgaacaaatagagttgatttaaatggttataaatactgacggtctggtggatttgcatgtcggtgtagtccccatggtggattcccgtgtcggtggcgtgcacattggtcccaatggagtaccacccgagaacggacaagtcagggaaggccttcttgtctgcacaaaaacaaccgcaagaaacaaattaaaatccatcgatggatagatggataatcaaaccttacctaaaaatgacggggagaggacttggggtacgttacagatctcctgatccttctccagtaaggcgcggtcgaaggttccggggtcggggtcgtgcaagatgtcgaaggtatcggagatatccaccgtcccaccacgccgaaccccaataacgcacccagacatcctcgcttgctggtattggtcatcgtggagatggacgaactcgcggatgcggtgggataatttcaagacagcgagggggtggagcctgaaggtgagcacgtcaacggcgccggcatcgagggcgtcctcatgcggcggcatcaccgcaccggaggccacgcgccgagggatccctaaaatggcggcggagcggatgggggagagaggagaagaggaatcgcgtgacctagacccaaggggatgtggggttgagcttcttttttaccacgaatctagcgatagttccccaacgggaccagtcaagagtactactccagtgtactactactgctactacaagggaaggccggtccagctgcgctcaaggatgcaggatgcacgtacacgttctgtcatccaagttgtagaaaaccacacacactttaacactgggcgcttaagaacatatattttcgtaatgtagtttcacaaaaccacattatcaatgaatggattcacccgtgatatgacgtggttgttccacttaggataaggatgtgacattattatcagccatcgcacgaaattaataggatgccacgttcttattctaggtgaaacaaccacgtcatctcacagttgaatccattcattgataccatggttttctgaaactacactaccaaaaaatatgtacttaagcgccagtgtcaaaagtttgtgtggttttctgcaacttggatcacaaaacgtgtagttttgtgaaatttactctttattttatttgtctcagaatataagaaaattttgtccttactaattatgaaggattttgatacactactcctcccatcccaaaataaatacagttttgtattgttcatatctaatgtttaaccgtttatcttatttaaaaaaaatatgattagcattgtcgaggagtggtcctctctagcaggtgatcgagagatccccttttgtgagttcggccgggggaaagggtacattgatcgagatcgtgtatccgcctcgagttcttcgagatcgtgca

SEQ ID NO: 9025 - DNA, 1501 bp, Oryza sativa
atgcggtaagggcggacgtgcggcgctgcccgattgacccacgtcaatcgggcgtgaccagactgtgaccggcctgtcgccggtcacgtccgatcggacgggcggcagtgcccccacgctccaccctgtacccggcggagtgggggcaggtatgccccgtcccatcgaagcatcatctagagccccctccacgcgagatggaccgccacaagtctccattcatttaagagggaatgacaagggtgtcccccgtgtcaggcggggggcggcgctgggccccactcgaggacggacggctgcttagctttcgggcgaaggcacgaattgtggtccggtctaagcggagtgggtccccttcccgtgaaggagtaggtagaggtggtgcatgtggtatccccttgaactataaaagaagaaccttgcccaccgaggaaaaggacggctctcagttagcctaaacctcaggggaagaagagcgagagtgctccctagtgtttaggaacctttgtgacactcaaccataaatcccatgcacaggagtagggtattacgctacatagcggcccgaacctgtataatcttggcacctgtgcacgatctcgaagaactcgaggcggatacacgatctcgatcaatgtaccctttcccccggccgaactcacaaaaggggatctctcgatcacctgctagagaggaccactcctcgacaatgctaatcatattttttttaaataagataaacggttaaacattagatatgaacaatacaaaactgtatttattttgggatgggaggagtagtgtatcaaaatccttcataattagtaaggacaaaattttcttatattctgagacaaataaaataaagagtaaatttcacaaaactacacgttttgtgatccaagttgcagaaaaccacacaaacttttgacactggcgcttaagtacatattttttggtagtgtagtttcagaaaaccatggtatcaatgaatggattcaactgtgagatgacgtggttgtttcacctagaataagaacgtggcatcctattaatttcgtgcgatggctgataataatgtcacatccttatcctaagtggaacaaccacgtcatatcacgggtgaatccattcattgataatgtggttttgtgaaactacattacgaaaatatatgttcttaagcgcccagtgttaaagtgtgtgtggttttctacaacttggatgacagaacgtgtacgtgcatcctgcatccttgagcgcagctggaccggccttcccttgtagtagcagtagtagtacactggagtagtactcttgactggtcccgttggggaactatcgctagattcgtggtaaaaaagaagctcaaccccacatccccttgggtctaggtcacgcgattcctcttctcctctctcccccatccgctccgccgccattttagggatccctcggcgcgtggcctccggtgcggtgatgccgccgcatgaggacgccc

SEQ ID NO: 9026 - DNA, 1501 bp, Oryza sativa
tttgtacactgctcattgccaaaacctaacatttgattcagataacttgattacgcccatgaccttgcaatccgaaaaagaaaaaaaaatcatgtctagctgtatatacatggaaatcaaggagtaatcctgtactgatccagaagagaatttcagtttgcactatatgtagacaacattcattcaatcggttgtgcataatacattcaatctgttatgcattatacattctgaagtacattctcagatggaaaaggaatagagtctcgtacctgcacagcctccgccggcggcgtctccggcccctcagcctagacagcagaacagctccatgcccgtcgccggaaagaggaggagtaggcggggcggcagaaggcgggggaggaggcgcgacggcggaaggaggaggaggaggcgcggcggcagaaggcggagaaggcagaggcggaaggaggagaaggcgcgggcggtctggcgacggtttttttttttcgatttggcgacggtttcctttgagaagcgctaattggatggttaggcgctaattgcaattgcggtgttaattgcacttaacaactcgtactttttatattagtctagaataagcgttaattgcaattgcggtgttaattgcacttaacaactcgtattttttatattagtctagattatttcgacttgactaggacaaaaccaagccttttcactttggtctctgtatcttttcactttggacctggtatctttacatgttatttcaatttggactccattcttcttcctccagttccctttctcctctctcccctacgtatagctcgagaggcaccctatactcgagcagcgcatgtggaggaaaagcactgtatcagggctgtgtttagatctaaagtttggatccaaacttcagtcattttccatcacatcaacatgtcatacacacacaacttttcagtcacatcatctccaatttcaaccaaaatctaaactttgcgctgaactaaacatagcctaggtttaaccctgaaacctcctttacactgcatgtctacacccttttctgaattctgatggagacggcgttgctgcaacggaacagtttgattgatgaagacaaatggcaggataattcagagtcattccctcttcctgcatggagtgccggactcatctccttccacttttctcctcattactgatcaagcaactcaatttgaacatgtaaagtcttccagagactagttcatgggtggatgtttccggagtgttcagttcgaggcctcctaaagaatcatgaattttcttaaccatgtttgaaccgctgctcaaagatcagtaggctagttttgtatgtcagtttgatccaacggctgtaatattttgagtgatgtggctcattgtggtgatgagaaagattagttatttcactactttagatgtgacactggttttgagtaatttggaggtatggacataatactattcttataatttttttgag

SEQ ID NO: 9027 - DNA, 1501 bp, Oryza sativa
cgacttcaggacgcaaacgcagccgctccgtccgctaggacctgctcgccgagaccccgccgcagccggacgcccaccgggacgctgccgtagccgctccgcccgccaagacccgccgcgctccgctcagctagctggacccactgcgctccgccctccaggacacagctgcagctccctgctcaccggaacccgccgccgacacccatcgggatgccgccgacgcccatggagggatcgatctagggtttaccgaaatgaggggaaatttaacggtcaatagaagttttatagagcagttaacggtcattgacggaacgaaacgacagtggcatctcaaatgaatttttgttcattctagtggcattggagcaattagctccttttcagtgtcatactgccaaatagggcgcccaggagtggcaaaacagcaattgttcctttatttccggcccaattaatatgggatacaccgaggccgcaattcctttccgggccagcatacatgggccgcactgaggctgcattcccgtccaagcccacgtaaaattgctgcggtttcttcggctcgttttcctttttcgtttttgatagtttcagcaagtattcttgagatcagaagagaggcaacaatgattattatacctttggctaaaaaagtgcccgctagaaaattacacaaacagagtttaaaagctagctaaaaaccacagttcgcttcaaaaatagtttttaaggtaaaaaggtggagagactctaccttataaccattaccatattttttttgtttgacgttggttagctcaaaccaacgtcatacatttgtgtaaggaggtagtatatattaatggtgggacagttttacaaagcttcagacaaacataagaagtacagacttcaaaaacaaagtgcaaagtacagaaaggtcttagactcttagttcagctcgatcatccatcatctgatgtgagcgcggtggctgctgtgtttgatgtttgcttcaaaatagctccagaagatgatcgaaagatgaacccatgcattcttttctttttctagttgatgaaaaagcatgcagtgcacttaacaaataattgtttttttatctgacaatgaattatttagtttgtacacaaaagaatattagcaatgcaagtattcagcacactgaaaatgcagagtatatacacaatacactcggaatgcacttgaggattggtcatcccacataatcatcatgtgacaatctccgaaagaacatcaagtgaataatctatgaatgaactgacaatcaagtgataatttttgtggcgcaagataaacaagaagactaaattgttttaaactttttttatataaagtaaaaattccatggtttaaagagtcaacaagcatgaatcaaatatacaagtatgaagatatatcagatttcaactataaattgctatccacatatataacgatgcggcgatcaaaaatttcaattggcaatgatcaaact

SEQ ID NO: 9028 - DNA, 270 bp, Oryza sativa
tgagggattattgcttgggaaaggtgtgatctctatgcatgaattattgtggcgtttgttttttgttttttttggtgcaggattctcggtagagtctgtttggattttcgttaattggttgtcatgtttgctgagtattacaagttatataaagttgtattgttttgatttggtttgtaaagtttgtgagtctttgattggccgggtgtcacatatattagtccttattaaacggctcaacttgtggattatgaactttttagatagagt

SEQ ID NO: 9029 - DNA, 1496 bp, Oryza sativa
ctgcacccctgttcgcatgagggataacctgaccacacacaaggaatttatcgcggcggttcaagaacaactcatgggattcatcaacgaagaaatccttgatcccaagggtaaattctactacgacggaaacacaattcaccggtccttagcttctgagctagcagcgagtactctacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgtatatacatataatataatataatataatatatatacatatatatatgtatgcatatatatgtattgaaacatatatatgcatggtttatatatatatatatatatatatatatatatatatataaaccatgcagcaacaggggcatgcaaaaaaaaaaaaggtcagctcgatctttagtcccggttggtgtcaccaaccgggactaaagatcgatctttactcccggttatttcacccgggactaaagatagcgatctttagtcccggattggtactcccggtttggaaaccgggactaaaggggggttacgagccgggactacaaagagtttctccaccagtgggcggcgctccgccgcgccgtgaacgtgcacggtagtgctagtgttgagcaccagtagcactacacggcgagcctgctcatcgtcgttgataccggtctcgctactaagcctgcggggccatggtgttgtctcgtcctggagtagcgcccgtgacataagccaccagttacgcaagtaatctacttgccgctcgttgaggctgatttggccatcgttcacggcgtcgtagtgcagagccatcctcgcgccctcgcagaagacgacggtcaggtgcaccagatccagtttggtgtcatcgtctgcagcgccatatggatcaggtggttgttcgtagcccgacagcttatggacggcatccagcaggacgacctgtcgcaggtcaatatcattaaccaacatattcttaacgtcgtcttcatcgcgaccaccaagtaagcttgggtagctgccgtcgcatcccagaaatgtggatggctcagggagaatcggcttgctcatccccgagaagcccatgtggaaccattgtcctttcaggttcctgaagccgatgaggttgacattgtcatcccggacggctaaggttgctctgtcgtcgccgttgcccaccaggttgatgtacatccacctcgccggctgttttgggcatcgttgcatcgcgagtacgggacagccggcgtagacgtcgtcgaggtcaggatgctccgcgagcctgtcgcgaaggttgttcatgaattcagggtagttgcctgtcctcacgttgaactctacgttctcaactctcaccgccatcct

SEQ ID NO: 9030 - DNA, 1241 bp, Oryza sativa
agcttgatgattcataggggccatggtgtcaaaaccgggttacctaactagggaaaaactgttcctaagctcttccaaagcgtggcaagctggacagcttttatcgaagcggaccccccgcccatagcaaatgtttgttgtcatatttcaatctagggggctgcggcataacctgggtgtggagacatgaatgagtcgaaccctattcatcatgacgtaatgtcaaagaagtggctcagcgaggggctttatgctgattcaaggccgaaggacaaagctcttcctcttcgtgcttgtcctaaataatgatattcactgaggtgtgctggctctgcttcaatctgttttcttgctccatgccaatcgaagatgaaccattcaccgagccgagtatgtgcaagacaagacacgactagataagtcaaatagaagatattgcttttacacgagcaactcttaccttcatgtaggtacagcccacttttcctttgatgaaatgcgaacacaaacttcaggcatcgaagaaagaagtcaagatcgaaatcaaagcattgtcattgggttgaagatcaattcatatcgacaagactttccattcatctttttgttgatatttggattccgttttcaaataaagtcatcttctagttttaaatcacctttagaatcatcagcctctgtccctacactgactcacttatccgggatcgatcctcactacggtcctttatttcgaaacgaggatagggcttgtgaagattatggataccccatatctacacggcgattatatttagactggatataggataccgaatatagatagaatatctttatttgtatctcgggtttgtttcttaacttgtacgtcaaggaaataccctgagacttagtcggttacgattgtattttatctgtactctcatattctgataaggatatgagttataccttgtaatacggactccttcccctatataaggaggggtccgagtccttcctgggacatcaactttcttggagattatacatccaataatacactcggcggattcatccccagacaggagtagggtattacttcttgaataagaaggcctgaacctgtataaatcctttgtctccaaacccatacacttttccagcttgatagccacccccttttagtattgccgaaatcttgtttcgacagttggcgcgccaggtaggggttgcgtcaagcttttcaccgatcagtgcaa

SEQ ID NO: 9031 - DNA, 548 bp, Oryza sativa
ttaactatgaaagatacttaactcttgttttacaaagaagctagattgctggaaaattcgtagattgctttctagctaaacattccactcgtcagtaaggatcctaggatccttgttcttgcggcatttggtgagagggagcataattaagagattcccaccattccgctatgcttgaggccgtgtgttcttgggggatttggttatattaacccagccaatttcaaacttgattctatatatacaatgtgttttgaaagtgcattccttttcgatatgcgtgtcgtcttcaaaagcacttgtatacataagctgcaaatccagtcacaagtccaatgccttctgagatgattgcttgctttctttgaaagtttgtttagtagaactactagttattaatacggtggacataagattaagaattaaatgaagaatgggtgtttactttgctacacttgaaattttgtcagagatcatgatcgactaacagaatgtaaaaggaagcgacgaataatatcgtgtaaagagtggttctttcctctgacaga

SEQ ID NO: 9032 - DNA, 1501 bp, Oryza sativa
gcggcagagggccacggcgggggctggcatgggcgacggcatcggccctcccctgctcagatctgcccgctgccgccctcccccgccccaatctgccggggtcagcactcccctgccctaatctgatggcggcggccctccccgctcggatcctccggctgttgcgtgccctcccccctcccccgatccaccggcggcagccctcccccgcccggatccgccggctgcagccctccccctccccgatctgctagtggaggcactcacccgccccgatctgccgaggcaagagagagttcgagagaagcgcatccgagagagagataaaggccatctggaatggataaggccagcgtgagagctccgctcggctcagtttgctataggcgccgacaccaatagtttattataggtatcggttttaattaatcgataccggtaataaattataggtgtcggtccttttaaaaaaaggcacctaaggtgtaggtgtctgttttcctatagaaccggtacctatagttatttaaaggtatttgttttatttgtttttagcccatagaggagggaaaagacagtatgtgccgattttaaatgaaccagcacctatagtgccgatccttatgatggttttttagaagtgtagcattgcgctaatcataagcacaatacaaccgtgtaatggctgtgatctgttatagcattcgtgaactgttcagggtgttctgcaataacctgcattgtattagactttttttttaagaaaaactatatcatttcggcaacaccagaatgaccagcgtaaaacacttgccagttttttaattgattttgacactccgtttagccaattaccaaaaatatttttagcattacaaggaaggggatgttgaaagtaaaaaagactcattgcaaagcaaaacatgcaacgtggcaataaaaaaatagatgttgaatagtctcttacatattaaaaaacaacattgcttgtctcccctccaatttcttttagccaagttatctttagcagcgattacttttctgtgaaggaactacataaaaacttaaaagattgatatttaatggtagttttaactcccataaaatcctctcacggattcccacatttactgtgagctcttcataaaacatcatttaacacatgatgtaccactacatgaatatatggatcccctagtgtagttcctttattgaaaattttagcataactcaaatacttcttggttgaaattttagggaatggtcaaagtagataagtaaaataacaaaatgcgcagcagatcttcaattgaaattctaccgaatcgcggttgatgcatcttcttattgacattacatttctccaaatctgcaatttcctcgaagcaacccagtgtgcgagaaatgcagatgtgaacaccccagcaaggtctctctctaaaacattctgctcattaattcataagcaagttaccagatttcccatgtctcctaacctatt

SEQ ID NO: 9033 - DNA, 1501 bp, Oryza sativa
accgaggcagatcagtctccatgaaaatgatcacaaattatgatgcacatgtattttgtaattagtaaaaaaaaagagagggagaatccagagttgatggcatcgagctaatagaagcataagttcgtacgtacgtacttgtgggtccggagagaaagggtgagaagatatttagttttgatccaacgattaatattattgggtccaccactttaaataaaaacttacagttagatgtttttctttttattataattttatttgaattattagagagccatgtggcgacttaaaagcgtttataggagtctcacgtggcggcttgagagcgtttgtaggaagtttgatggacttttagtataaaatagatagataccatgctgtaaaagtgttaactgtaagatattctttgttcttcatttattttctatatgacgccgattctttgtcccattaattgacttttgtacgaaatttttttaaaaggtgtgtttagttcatgtcaaaattggaagtttggttaaaattggaacgatgtgatggaaaaattggaagtttatgtgtgtagaaaagtttcgatataatggaaaagttaaaagtttgaagaaaaactttggaactaacactggtggagaaaccatctttactcccggtttataaccccctgtagtcccagttttccaaccgggactacgaatctggaactaaagatcgctatctttagtcctgggtgaaataaccgggaggaaagatcgatctttagtcctggttaatgctaccaaccgggattaaagagaggataggggcagttctggttggtccattttctttttattttgtctcaaatcaagtgggatgtataaacccagaacaaacaacaaatccccaaatcgagtgtcatgcatatacctaaatcaaactccaaatccccaaattcaaagtaacatcacaaatcattcacatcacaaatacaaatactaagttacttacacacaaatcaaatacatcacaaatcttagaaaaattacacacaaatcaaatgcatcacaaatcgattatacatctcagatccatgcaatgaatcacaaattctaaaaaagaaattacacatctctcaatcacaaattataaaaaaaaaagaaagaagagccgacgcgctgccgctccgtgcgcggcctcgccgcccacgctgcgtgctgccccactgcccgccgcgcgctattcctcgccgctcagccaccgcgtgagggcgcccgaggccaactccgtcgccgcccggccgccgcgcgagggcgcgcgaggccacctccgtcgccgcccggccgctgcgtgagggcgcctccgcgcttcccggccacgcgaggccgccttcgcggctgcctggccaccgccgccgcctgagaagtggggaggagacgggagggggcggagtggggaggagagggaaggaggcggatcctgaggaggaagaggaagacatgggaggaggaagaggaagaca

SEQ ID NO: 9034 - DNA, 1501 bp, Oryza sativa
agcagaatgttttagagagagaccttgctggggtgttcacatctgcatttctcgcacactgggttgcttcgaggaaattgcagatttggagaaatgtaatgtcaataagaagatgcatcaaccgcgattcggtagaatttcaattgaagatctgctgcgcattttgttattttacttatctactttgaccattccctaaaatttcaaccaagaagtatttgagttatgctaaaattttcaataaaggaactacactaggggatccatatattcatgtagtggtacatcatgtgttaaatgatgttttatgaagagctcacagtaaatgtgggaatccgtgagaggattttatgggagttaaaactaccattaaatatcaatcttttaagtttttatgtagttccttcacagaaaagtaatcgctgctaaagataacttggctaaaagaaattggaggggagacaagcaatgttgttttttaatatgtaagagactattcaacatctatttttttattgccacgttgcatgttttgctttgcaatgagtcttttttactttcaacatccccttccttgtaatgctaaaaatatttttggtaattggctaaacggagtgtcaaaatcaattaaaaaactggcaagtgttttacgctggtcattctggtgttgccgaaatgatatagtttttcttaaaaaaaaagtctaatacaatgcaggttattgcagaacaccctgaacagttcacgaatgctataacagatcacagccattacacggttgtattgtgcttatgattagcgcaatgctacacttctaaaaaaccatcataaggatcggcactataggtgctggttcatttaaaatcggcacatactgtcttttccctcctctatgggctaaaaacaaataaaacaaatacctttaaataactataggtaccggttctataggaaaacagacacctacaccttaggtgcctttttttaaaaggaccgacacctataatttattaccggtatcgattaattaaaaccgatacctataataaactattggtgtcggcgcctatagcaaactgagccgagcggagctctcacgctggccttatccattccagatggcctttatctctctctcggatgcgcttctctcgaactctctcttgcctcggcagatcggggcgggtgagtgcctccactagcagatcggggagggggagggctgcagccggcggatccgggcgggggagggctgccgccggtggatcgggggaggggggagggcacgcaacagccggaggatccgagcggggagggccgccgccatcagattagggcaggggagtgctgaccccggcagattggggcgggggagggcggcagcgggcagatctgagcaggggagggccgatgccgtcgcccatgccagcccccgccgtggccctctgccgccggagtccgcgttgcgggcggcagcgcccactcctaacgccttttcgtc

SEQ ID NO: 9035 - DNA, 1501 bp, Oryza sativa
caccatcttctgggatcaatatttccgttgatcggccatcgcgtccgaagaataattaactgtaaatgcaagcacccatatcaagtctaaaacttgaacccaggtgggttggttccaccacaaggaaccaaccaattgtccaattagttctatactataaataaaaggaccaccagattcaattccagaaatcataaaattaactagaggatatatatgcaagagggtgcagccaaccagctctacaagactgtaacatatctgtaacgtatggcaaaatgcacatacacatgctagcctatagagcagcacacggtaatataagttgcagcctggcttagaccatgtgcatgagtggcgtcaggaaaacgtacactagccgcaccacctccacacccagatgcatcgggatctcattcttgatgttgaattcgaagagcatgtatgatcgatcaagaccaaacaaatctatcagagagggggtgaatggcagaaaaaaccaaaaacccaaaattttttgcggaataaaagatttacctcgaacgagacagatgacgaagtcctgttgccgccggtcgaaccgtccacctgccactggtcagaccgccatagctccgccggtcagaccatgaaatcattgtcatgattaatatttgtgatgaacaattggctttgcaaaatgatttatttagtgaattggtttggaattatgtgtggatgttggtgtgagtgcgtgtgactaatgtgggtcaggttgtgatatctgtacccagaaatagttgttttgtctgattgtgtgcaggtaacttgaggtcagccttggtcaatggtgaggaccgggactatgttcaaggaggagcagaggtctactgcgatcgggataccatgtgagaaggtgactagagtcaggatttttgggagtcatctttggtcaacggttgggatcggggcaagacttagggaggagttgatgtccagacgatcaaggataccgggtgacgaagttggatacgagatggcatatggtggatggacagcgtgtggtagagatctttgcaatgggcttcacgaagtgtgtgtacaagggtcagtgttcgcgaaggatattggaagaaattggattggagtagatagcgttacagtacggtgaggtaatgtagcatgcatatatgtgtgtatactgtatcgtggtgtgtatgcttgtgtagcatgcagtacatggatgtgtatgcgtactgcgtgcaggtgcaggcgtgcagctagttgtttgggctgcaggcttcggctgggtggcaagccgagtcgaggcccaggcagcagagagcggggcccctaatgggcgactgctcgcgtggggcgtattagtttattagtttattttggaattgaataggaagctcttttaactcgtggtagcccttttaaacccctcctacttgtattttattacaattttgattaagtgagggatcaaatataatacgtagttaactttatttga

SEQ ID NO: 9036 - DNA, 1501 bp, Oryza sativa
taatctttctgggcagagcagtattgatcgatgtgcatgcatagctgtatttaggccgacggcttcctctgattggtcggctggtttcccatgcacacagaaagtaccggattggcttatgtgcttgttacatgcaattgctaatgacgctggcccatgatgattgctccaatcgattggctgcgaggacaagttgactcggatttggattaataattggatctcgtcgggagatacgataccaacaagatgccggcgccacagatgccggcggctgagaattgatacgcatccctgaatagattaaaacagatgatgactgcggtgcggccaccttcttcaatgaaactgataaacatagcggcggccggacgagatcaaggtagtcttgaaccttcccgacttgattaggtccaagtgagaaatcgagagctttccgaagtcgtcgacgaagaaaccgaagcaggagattggttgtaaagcgacgacgaatccggcaatgctgaaggttagtttccatcgcacttgtcaatgggaaactcgacgcacccctacctggcgcgccaactgtcgaaacatgaattcggcaataataaaatggggtagcgcacgagacctaaaagtggatggatgtggagacaaaggatttagacaggttcaggccctctcaatgagaggtaataccctactcctgtttggggatttgaatccgccgggtgtgtattgatctgacgatctagttgtctcatgcccctagaggggctccctgccctccttatataggacggggggcaggattacaagatagaaaccttaaccaatacggtatcggtttcctaaatctactttacaatcttatcaaaccaggactttaggccgtttcataatatacagggaaacgtaatacccaagtcatgatctgttacatattttatatatataagttatcccctataactagtcggataccatgccgtgtgggtatggggtacccataatctccacatcctcctcctcccacctctactccggccaccggccgcctcctcccacgctccccccgccgccgccgccgccgccgccgccgccatcgccacccgcctcctccttctagcagtagtaataaaggaaggaagaaaatccaccgccctacccctatctatccgttgcctcacgtccgtttcccacattttccgcttccttcgtccatcgccatctattaacccgcccccccacgattcctgccgagaaatttctcccccccacagagagggaggcgatccctagcctcgtcctgaatctcgcggcgccgccaattcgatctgcccgcgccgtctcagggcggcgaatcttgggctggagtcggggggagagatccgggatcttccttttcttgggtgttcccgggacgcaaatcttgcggccgccgggcaatgtgactggggttcttgtggggggtgaggcgattcgcgcgcgcattcggtgctgaatcttgcgggga

SEQ ID NO: 9037 - DNA, 1501 bp, Oryza sativa
  unsure (1)..(1501): unsure at all n locations
tatacttaaggcgtccttatgttttttatattccgatgaaaactttagttcttagaaaggatttactcctttttctctcaatagcatattgaggaagaatatgcattttcgcgatttgtacccaaagactaattgaaattgcatgcaaaaaacaaattggatttggattacgagtacagagtcacgaagcatggattccaatttttaaaatatgagtaaaggatctatggatgaagatacaaaaaaatttatttccaatcataactaaatcttcttttgttaaaaaaaggaaatggaagccaaatagctaaaaaacggtagttttggtttacaagaaccatcagcaaaanggctcagnnnggnggnnncccnnnnnnnnnnnnnnngnnnnanaaattttattatttaaatttatatttttatttttttaatccgcccccccccccccccccctcccnnnggccnnnngncnnnnngngnnccncggnccccntcaggcaaaaagagctganttagatgttaagtggtgagaatacccataaaggagcngaatgaaattaaaatttcatgttnggttttgaattagagaggttaataataatcaaccaangnngannataacttctagctttccaagctatcgactcgagttcattctcaccacccgctccattctgtataaaataactattctatttgtctagacatgatagaggcctgtattcaacctttttcgtccaccggtttccagcgctccagagcagagtagagcagtttggtatagctcacaaggctcataaccttgaggtcacgggttcgattccagtctccacacttagcagtctgtataaaaggactattctatttgtctagatatggtagagggctgggtggttgggcggtatccaaccctttttattcattagttccggaccctataaggccaaatttagcaggttgcgaagtaacttgctaccacaagaggaactctcaaggccccctaccttgcagaaaagaaaaaaatagatgaaagaaaggcacagtctatctcccttccctttaaaagttgtttgctggttgtttgtttcgatgaatccccagtttagggagccctgttgccgagttcgattctcgccgcagtagtgctctttttttgagtggggtgcaaagggggctaagatagtaaaggggtacggtactagactaacacctattacattaataaaagtagactaaattttttatcatggtacgtaccttactaaattaagctggcgagcggcgggaatcgaacccatatcttcttcttggcaaggagatgttttaccattgaactacgctcgttacgtcctatattttatagggtatatccacttgggtcgactgtctatgtatgggtagacagtttcattttctatttgagttttaattttattaatttaattgtctgtcaatcaattcggggcgcaaattacatttaagaaatgagagaatttagaat

SEQ ID NO: 9038 - DNA, 982 bp, Oryza sativa
  unsure (1)..(982): unsure at all n locations
agggagagaaaggaaaagaaaagaaaagagaggagaggaaaaagggaaagaaaaagagaaagaaaaaaaaattaagagggaaatttaaaatatttacaaatattgaatttaattgtaggattaatgaaaatatagttagataaactcttactaattaaatacctaaaatactagcatttaaatataggattaatgaaaatataattggataaattcctatagattatagataacttttagtactctccataagaaatcaattcgcggtattaatttagatgtagttaataattaaacaaatgtatgaattctcggaaattattgtggattatttgtgggaatctctataaataatcgatcaacggtagcattcggatttaattactagggtgttagccgtgtattatatttaatcatagactaaattgagtcgtataatattataagataattttaggattccgtccgacatttagctcgcgataagaaatttctaacctaatatatggatataatgctagggcnnncaaattaaaaacatacgaacaacaaatattggaaccggcaaaaaaatttaaaccaaaatgggggtttgccatagttcgcggttagtaaaataaataaaaaggaattgactttcgcattgaacttccattgggatttactgggatttttatttgaattctaaccgaattcaaatcaattttcgcacgtaactatagagaccgagggagccgcggatccaggtgaaagccaagaccgcaagacctcgagcaaggcaagtcatcactattccttgaacatgttgatcccaattgcgaaattattttgtttataaataaaattgcatgcaatgatgaatatcctacttgggattatgccatgccttgattattgtttacccttaaatctttgtaaccatgtctacgtatgagtccctagtcaattatgacaattgcttagaaatgctattctagaatca

SEQ ID NO: 9039 - DNA, 1167 bp, Oryza sativa
ttccagattgcaatatattgatcttgatctgatcatcattgggaatgaatcttgctttcatatatacccctattcacattctacctagtcaaataatcgagcatgattttcgttgtaaataacatgtttaaccaataaacattttgactttctagtgaaaataattttattctccatgtttagttgtgtggggcagatagatcccgacaagagtcgtatatatagttaaccaagagtccaagagctaaaaattagggcctctttgaatagcaggattaagaaaacagaggaatagaaaaaatgtaagaattgaatgccacaggatttcgaaacacaggaaagtcttcaaactgtcgtttgattagcacacaggaaaaacgcagaaacgttagacatatgaagaggaaaatatgaggtgagacctcatgcttatttttctccaaaattgctctagtaaggttcattccataggaatttcaaaggaattgataggaaacaatcctttgttttatatgactttataggattatttcccataggataaaatcctctagaattcctatggtttttcctttgattcaaagggggccttagtaacccatcacacaattaactacttgttgttacatagcgaatttaggccccctttgaattggagggaaaatggaggaaaaacaaaggaattgaaatcctacactattcatgcctttgattcgtaggaatgagaaaatgaaaaatgtaggaaacttccctattcctacaattctagagcaaaaacttaggaaagttaacatctactctaacttcttggaaaactttccttgggtctatctctctcatcttattcctgtatttttcctgcggtctaatcaaacggtcgtccctatatttttcttgtgttttgcaatcatctgttttacacatgcattcctaccaaaatcccgtgtttttcctattcctctgttttttcaatcctgcgattcaaagaggcccttagtggctatcaattgttgttcttcatgcaaaacaatgatagagccaaaaatattttcaggcctagacaaactcaactataccactcctaggcatctgtccagggttagctgggctgtggctccacacttatacaaaacctatcatttatcaattagacattgcgcttattta

SEQ ID NO: 9040 - DNA, 1343 bp, Oryza sativa
  unsure (1)..(1343): unsure at all n locations
ccgtgttctatatggttttattcatcgggagataccattcttctataaattaaggtaagatgtacaccgctcttctacactatgctggtcctcgaatcatcgctaaacggtgatgcttaccttcttggcatggtacatgtatatacatgtgatgtgatgcttattttacaagtatatgcattgatacttggagcgaagaataacatacttttcttcaatgttcacttcattagaagagaaaaaagatgcctctccatccaaatgcccaataaaccatagctgcacaatgattgactttccttacaccccttatggttgcatacttaatcaacaattgccatccaaaaaagtgtgattccacaaagaaaaattgtgagcatctatcataaatgtatatctacttcatcctagtatcatatatgtacggcaagtataataaccttagtttacatgcaaacgttatcactcaagccatatcaacctacatcctacatgaatgagaaagaagtaatcatatgttcgttgagtgtgagcgcatagccaccaagtactagctgttgtgcatgagctagtccaaagtaaaagagaaagatttgagactcggtaaaagataaaataatttttaaagaaagcattgagaaatattgttgtatatgtatatggctttcaaatttaggtgattattctttagagccaacaaaaggtcatcttattggctgttgccaatttgaaagtgagtttagcttttgcaactcgttcgtttactatgagtatgtttcctaaattattagacggtgtatttttaaaataaatttttatataaaagcttattttaaaaaaaatcaaacaaatctagcttatcgatttaatacttaattaataatatgttaaatgtttttatttcacgtgcagaaaaaagtaagtcaaattgttgccactgcttcctccacactgcccacttgtccagtggttgccgaggtgcttattcctacacctaatttatggaggtcaataacaaaattattattgtaatatacttttttttatatagtactagctcatttcacccgttgttatgtaaactctttagcccatattgtatatgtggcatctgacgaccgtccagtatanaaagcatgaggcttactggcttacttacggtaaaaagtcaaatgatacactttgtattcaaaacacatgttaccggtgtacacatgcatagaccaaacggaacacctcattttagtaaacctagttgacgctttttatacagcaacgcggtacctcaaggtttacgccttcaggcggatcagcacggtggagacggacgagcgcgagaaagg

SEQ ID NO: 9041 - DNA, 1501 bp, Oryza sativa
tgtcatgtggatccagggcggcatcgccggagctacgccagtcggaattggtgtggtgccgtcgccgccgttccctgtcatcgtcgtccgcgttgcctggggagtggggtgtcgaggaggagttccggaggccatgtcgagctccgacccgatgctgcgctagaaggaggggatcgagagaagagacatatgagagttgacatgtggatcaacccaaggacatttttgatatttcacgcgatttttctctcctccttatccggaaattattattttaatagatacggtgtccactagcaaatatctaagggcatgcccaacacagggtatagccccataaaaaaaggtgatgccaagtgggatgaaaccacaccggtgatatccctcacacagtgcaagccatacccctatcttatttttacgtttcagtacctgtcagtcggtcacattttgcattttaacccttggattatttttatttgcatatacatacaatatttgcaatataccccctaaaaatcacaaacatatataaataccaccatcagtcctctcatgaccatctcccctcccaatctctccccggcgctcccctccctggcggtgcgcctctctccccgacactggattgaggcgcaacagcaacggatgaaggcggcggcggcgaatcgaggcggtgtcgccggatcgagcggcggatcgaggcgcggtagtggcagattgaggcgcggcaacgccggatggaggcggcaggggcggatcgaggcacgttggcgccggatggaggcggcggcgccccatcttcttctcccctgcctacttcctcgccatcttcgaccttggcgcaggaggtagttggcctcaacgtcctggggctacgggacagagcgacacctctcccccaattcggttcctcgcccattcctcacattttcctcgccaaaagctgacgaaaccatacgacactctgcagggggtcgcggagctctgcgagggcacggtcccagtcgagctggcacaaatattcgcgtcaagaggggtgagaccacactctagcgtggagcgttgggcatggcctaactcttgagagtgtcttcacctaaaaatcactttgcgcgatatcctactgctaaaactgcgaagtcacgatgtcatgtaacatcatttaccttaaaaaaaaagggacagaaggagtacaacttaaaggtaggagaaaaatagtcatacgagtgaagaaaaacagaacagaatattatcattggctcaagtattatgcattaatggggccccattttgctttccgggccgttaatcggccggcccaattgcaaatgatactttcttttttctggagtaaaaaaaaaaaggaaacaaacgaaaaaaagaccaaagcttctcctcctcctccggctttcccttttctgttcttccttccactcgcaaactctccaagaagaagaagttgcgagccaatccccgcttgcgatcccgacctggccac

SEQ ID NO: 9042 - DNA, 311 bp, Oryza sativa
ctgaaatattaggaaacatattagggatggggagacagaaaagggggaggggtgggggaggagggtttcttcgtggaggaggggatatgggttggcaccggtggcgcttgaggcggcatcacgttgatggaggaggcagcagcttatgggcggagcagttcggcgagggaggcgacggagttctggcggtgcagaggagatcgtcttggagggcgacggcgtcgacagagacgctgacgggagagatcggcgcgggcgggtggacgagctgacgacgggaggttgaggggcgatttttttttttttttaga

SEQ ID NO: 9043 - DNA, 349 bp, Oryza sativa
gggcccctgccgccccaccagagagcggcaagggttttcctgcaaaaaaccctccctccgtcaccgcccgttcctcccccgtttgccacgtcagcttgccgccccagaggtgggcggcagggtctatttttgtaatttttttggccgacagattatttctgtaaatatttttttaaaaaaatctaaaaccgaaaaaattcggctgtggcataggcacccccaccccttccccacctcctcctccccccccaaaatcatcagatccgcgtccgcctcctcctcctccacctcctcccaccccctcgccgatccagatccatcgccggggaggcgccagccatggccggcg

SEQ ID NO: 9044 - DNA, 235 bp, Oryza sativa
cctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatca

SEQ ID NO: 9045 - DNA, 1501 bp, Oryza sativa
ccacagctatgtttgagaaatgaggaataaagaagattaagaagatatgcaaaactagataagctattagtacatagtacctccgttttaggttacaagactttctagcattgcccacattcatatatatgttaatgattctagacatatatgtgtgtctagattcattaatatctatatgaatatggacaatgctagaaagtcttataacctgaaacgaacgaagtaataaattaagtattgattattttttaacttgaaaaggataaatatgatttttaaagcaaattttccatagaatttttttttcaaaaaatacaccatttaataatttgtgaagcgtgaacacaaaaagcaatgatcttttcttctctttgttcaagtctcaaacacaatctaaacatagaaatataattataattattttgaaatagaggtagtatatagctatttttttatcggtgtcttgtcctaaaatagaactatttctctacttaccacatcctctcaaacaatcacaaattatttaagttattatcttcagccactttctcttattaactaatcgtaattttcttcccatcatttaaactagctgggtggcccgcgcaattgcgcggctagcacccaaataaaatcatatatttttttagtatgattttacttaaaatttattaaatagctatctcatgtcttaagagtttgaaagattaaaccttatcatccccgtgtttctaattatatatattttaaaagtcacaccagttgctaccccttatgacatctccttctttatttgcttgctcgatctaccactatttctattcattctccttgaaacctttaaaaattggatcttatagtttttagagtttattgtcacgttgggtttcgtttttataatttctagacgtcccgtcaaacgttgccattatattcctctatggcccgtccactgtctcttttctttatgtcattgagattttaaaaatcgaacataattatcgttttggttcatttttactttctagaaatcccgccaaaccgtcaacggctttgccattgtacttctctacggctcgctcgctgcgtcccttctttattttcattgagattttaaaatcgaacatgattatcattgtttttttttactttttcgaagttcggaacctttaaaaattgaaccttatagtttttagagtttattgtcttgttgggtttcattttttatatttttttagaagtctcgtcaaacgatgccactatgctcctttatggcccgtccgccgcctactctttctttattatcattgtgattctaaaaattgagcataactatcgttggaattcattttttattttctagaagtcacgtcaaacatcagcggctctgaaactatactactatacaccccgcccactgcttctcctttttattgtcattgagattttaaaaattgaatatgattatcaatggggtttttttttactttctagtagt

SEQ ID NO: 9046 - DNA, 1501 bp, Oryza sativa
attatttttaacaactaaaatttaatttataataaaatacagctttgaaagaaggcaccacgttcgctgtggaggctagaaattcccacattaatcggagaaaaagaaaaaaacgaaaaggagagtccaagtagaaatacaatctaaaaatagctgaaattcagaattaaaaataagcaatactgaaagaagtttctatataagaacccaatacaaaattaatcaaaattcaaaataaaaataaaataaaatccaaaattagaaagaaaaaaagagacccaagtagaaattttttttaaaatagctgaaattcgaaattaaaaataagtaatattgaaagaagtttccatataagaacccaatacaagattaatcaaaattcaaaataaaactaaaataaaataaaaattagaaaataaaaggatagtccaagtaggaatacaattttaaaatagctgaaaatcggaattaaaataaggaatattaaaaaaagagtccatataagaacccaattacgagattaattaaatttgggaataaaaaaataaaatccgaaattagcaaaaaaaagaagagttcaagtaggaatacaatttaaaattagctgaaatttggaattaaaaataaacaatattaaaataaaaatccatataataacccaatacgagattaattaaaattcagaataaaaaataaaataatattcaaatttagaaaaattaaaagagagttcaagtaggaatacaattttgaaacaactgaaattgaaaataaaaaattaaaataaaaatactaaaagaacacaatacgataataattaaaatttgaaaaaaataaattctgaaattagaaaaagaaaaataagattttaattgaatacaatttataaataactaaaatttgtgataaaaataaagactattgaaagaaagaccatctaaaacacatgacgagataaattaagtaacaggcctataaaggagtagagtggtggcggttgatacgacatataaaaactattaataaaacaccaaatagaatcctaatgacgattaaaaggagggacgataggcaggccatgaagcaaatgagcaatgcgattgccgggactactagaaagtaaaaaaaaaccccattgataatcatattcaatttttaaaatctcaatgacaataaaaaggagaagcagtgggcggggtgtatagtagtatagtttcagagccgctgatgtttgacgtgacttctagaaaataaaaaatgaattccaacgatagttatgctcaatttttagaatcacaatgataataaagaaagagtaggcggcggacgggccataaaggagcatagtggcatcgtttgacgagacttctaaaaaaatataaaaaatgaaacccaacaagacaataaactctaaaaactataaggttcaatttttaaaggttccgaacttcgaaaaagtaaaaaaaaacaatgataatcatgttcgattttaaaatctcaa

SEQ ID NO: 9047 - DNA, 1493 bp, Oryza sativa
ggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgtttcatactcccaaactgcaactcttctatcgctcgctgacggagcgaggggctcctcaccaggagaccgcgcaggcccccctttgccagttcggccggggaccctgggtgaggttctaagctcccaatctgtggaaggttcgccagactggaaacacacaagacacgggcgatgtatacaggttcgggccgctgagaagcgtaataccctactcctgtgttttggcggattcgcgtatgaagaagctacaaagtgcaagtcagcccccgattctcctgggatcgttttttcctcctcctcttttctaagtgggcaaggtcctccttttatatctcaaggggatcccacatgcaccatctctccctccctttctttcaacttgacttctcttcattaatggacggagatttgcatcgctgccatccgaatcaccttctgacgggacagcccatacctacctccacttccgccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggagctaacacgccggctccggctagggacgagtgcttggagactctcgtcctgactggacggggcgaggcgtgcgtcagaccgcctgtcgccacctgacccacgatctgaccggtctgtgactggtcacagaccggataaacgagcgcgctgcactgcgttacacgcggcgtgacgcgttcgtccaaaccgcaataaatgcagttaggtgagcgccactgtgctcaccaaacccatacacgcggcgcaaaatccacaaggggtcggggcgccccagccctcggggccaaggcgggagcggtccgaccccctcggggagacaaagaggagggcgaacacaccaccctcgggcccgacgccccccccccccgagggtgccaggccacgtgggcgattgtgtctacctcaagcctctagtcacgatactcccggtcccatgtcatcgacagtagcccccggcgttatgccgaggcgattaccctcctcgagggaagcggtcgggcgtgacgccacttcctaaggcctggtgacaggtgggaccggtttccacagttgggcagaaacccaacagtcgcaaatcacgcacatcggcaatggttactcggctgtcaataa

SEQ ID NO: 9048 - DNA, 1501 bp, Oryza sativa
ggtggcactacacgcgggtctgggcctcggtgtcgccctcgggagggacgccgcggccgctgtcgctcgcggcaggtcttgtcccgactgtggtggactcggggccagacccggcgtgcggcccgtgggccccgccgtaaggctgtgaaggccccgcggcgctggatcagccgagcccgggccgctccggtcgctcggattttgaccccaacaaagggtcagacgccgagaccccctgggaaggaatctcgctacaaaagaaccctgatcgcgttaacaaagaaaaagaagaggaaggaacaagaggccgagatgagtaaagagcaccgaagcggatgccggcagtcgtacctgtggggagggcggttgaaggtccaatttgggggctcgataaagctcccccggcacggctccgtctgacctttcttccggagccgcttcttcttccgtccaacttcggtcggtccgccacgcgctcggcgccccctatgcacggaggagagggcggtcgagatttggacattttccgctttcctttcgggtcgttggccgaatctcccccgggcccgcggctcgggccgggtgccctggagctaccacccccgccggagccactggttcgactcccacctacggtcgcgccgctgctacccatgccgacggcgctgccccggcgggaccgacccctgccggcgccgacggccgacatcacagccaggatactttcccggtcgcggtcgctgcagatgggaaggatcctgtctgggatcagtgtttgctcggcggtgtccagacccagcacccgacgaatcaccgtcttcgcgtcgtcctcgccccagtcccagcgctcacccacatgggtgcgcatgggatcgttgggtccagtgtactcccacgtgccgcgggaccgctcttggagaggtacgatgcggcggcggaagtaatcgccaaagaccattgcccccgtgaggccctggcttcgcaggcccctaaggcgagtctgcactacatcgtactcctcgcccagctccgaaaccgccagccatgcggctgatcgttcggggggggggggggcggcggagaaccgaagtcgcaggtggtctggcaatgcggtgtagaaccagtccttcttctagtcctctcacttcttccagagatgactctcgatgtatggcccgccgtgcctcgtcggggctggaagtagcatccccccaccaccgcaccatgcagcagctgcgggacgaagaaggactggaacagccacatcgtcggccacacctgtcgcgtcccaaaacgaccctaaaatatatcctttaaattatgtctagaataattaaaatctatgtgaaagcgtccaaaacttaaaatgtgcaaagtaaaagtcaaataaggcttagaggatttttgtatatttcctaaaagcctaaaatgtgtaaataaattttagtggaattttcagagcacaaataataattgttaagaaataaacaaagttaaaaag

SEQ ID NO: 9049 - DNA, 1501 bp, Oryza sativa
cagtggaagaaagaactcttgaagctgcttctccttgccgcagcaacggagcttcaacggccatggcgagagggtgtgactctccggcgtcccccgccacgcctaccatcgtcgtgcgccgtcactgccgcagcagcagcacgtgtgcgagaaaccctaaccctagaagaggagggaagaggggtaggggatgaactcaccgaggagaaggtggccaccggaggagagaccgtgccgtcgccgtcgcgtccgagtcaagccgcgccggacgccgcccccggagcagcgcttcctctcgtgcccccggagcagcgcttcctctcgttgcgtaagtgtgacgcttccctcctacgcgattcgccggtcgaggccgagcgggaggcgccgctggcggcggtggcgggcggcggcggggaggggcgtcgggagggtggggcacgtggtcgcttcctctcgtgcccccggagcagcgcttcctctcgttgtgtaagtgtggcgcttccctcctacgcgactcgccggtcggggccgagcgggaggcgccgctggcggcggcggcgggggcggcgggtaggggcgtcgggagggtggggcacgcgatcctgggtgccgcccagtgacggtttggagggagaggcaaggggcggcgcgggatttgatgacgtgggcagggattttgcgatggggaaaaggcgtgggagcgttaatccgacgctaattacaattacggtgttaattgcactaaacaactcgtaccttttatattagtctagataattggcagttcctgtgccggtttagtaaaaaaaaaaaagtatactccattttgtgatacgtgtacttgcaatagtaatgaaagacacatgggccctagtgcaaacttgtcccacatgtcagcctctagtgttgttgctgggcaaccagcgctcttttcacggcgcagtggcgcagtatccaacgagcttcccgcatacgcttccaccttccttccgccaattcttcccctttctcctcctcccctccctttcaaaaccacgcaacagctcctacttcccccctatatttctctcccagtgccaactctcaaaccctagcgatctctacttttctccaccggagcacctcgcccatcacccccacccatggcgtcgccgcgtcatgtttccggtttgagcccaggtaagagcccccctccgctagctaatcctactagcccctcaggccgcaacgcaacgaacccgccgctaactcctctaccccttcccgccgcaggagccgccgccggcgcgcatcacatgctcctcgaggcggcgtacaacgacaacctgcgcggcttcaagagtatgcaggggtggattctacctaccggcttggatttcgtcatttcgactcctctcccggtgctgatcttttctttcccttccgtttttttttgttttctttgtgggtgctgtggtggtgttgttcgatttcgtttgatccagacctggcgaacatgctg

SEQ ID NO: 9050 - DNA, 1501 bp, Oryza sativa
ggcgacgccctctttcaacgaagccgccgcctggtggtccacgagcggctcaatgacgtcagtaagagggagagcctgcacaacatgaagtcatgatgcgatctaagaggaaaaagataaagggtcatcgattacactcacgttgattgcggcttcgcgctcagccgcccctttctctcaaagaggggcggggaggcggggacgttgctcgccgtcatggggccactgaccatcacctggccgacacagcgctccacggtttcgctgttcaaacctgtagatcgagaaccaaatttcgataagtcaggaggaatgcgcacgtaaggaaaggaacccagaatacaagaaaaataccccgagaagaaacccgggtcgcgtcctccagcccagagtagtcaagctggatgggctcgagcctggagctgctggatccatctaccaatgaagtcggcagcgacatcataccccgacaaccctctcactcggaggtcatcgatgatatcgatgaaagactgaagggatggggtcaaggcgggtttggcggtccaagacaaaatcttgtctggttgttcctcagggacaatgaagactggatccgaattttctatctgaagatagaaccacctcgcccgccatttactacgagaagaggggcactggaaggggatgtatcgcgacttcaggccatcccgaagtcggaaaccaacacacccggataccttcttaggttccatccagcgcaactcgtagtaaaaacggaagaggtcaggaaacggctctaccccaatgtaggcctcacaaagatgggaaaaaatgctgaggaaggctatggagttggggttcagatggagcagagaaagaccgtagaaattcaagacgagaaggaacaactcagaaggcggaggaagaaaaccacagagaatatagtcctcaaccgcaaccatgcggcccaggatgggttcaggttcagtacctcctggttccctctccatggtcccgcgaccggggagagcgccctcctcctgcaacttcttcaaggacgcgctggtagaagtggacttgtcgaggtccattgccgccggagatcgccagagaagaaaccgaggcaagtgagttagggtttgcgtggaagcggagaagacgaagagtgtttggaggctagaaagttttcacaacagccttaaataggcgcactaccaacggtgcgaattccaaggaaaggagagagatggccgccggaaatttctgggtccgttacgcgaggcggtttttggacttcaatttaaatttactcataacagttgaacttcgcatggtgttgtcgaccactccttgtctctacggttctcacatcgagatcgaccagtcgagaatgacaacaactccaacatcagaagtcgcgatcggttacatgagttcatttaagcagaagttaggggctactatcagggttacagataaggtataccctctacccttggatgtacgctatacggcaata

SEQ ID NO: 9051 - DNA, 1501 bp, Oryza sativa
acctttttatctcgtgtcataaaatagtgctgatttggagttctgtgctttgtcagaacatagaaaaactatgttagacaggaaaattatcttaaatatcatattttataagagagaagctagctgtggaacgaactatagcaaaatgtattttgaatccagggtcacccacgtcccccttcagggaaaatcaaatattacacatgttcctgtgattttaattttctgagaaaattcatgaatatagtgcatataaagatggcaaaaatttgctataggacactcataaaatgtgtaattggctgagagacaccgtaaaaacgtgacacagctgatggacactaaaaaaatggtgtaattagctataggacatcagagacaatattttataattccagggtcaaaagagatgaaaaaaatttcaaaatggcgagattgcccctggcgctatcttctttcacctgaaatcacaaaattagctgggagcagccgccgcgcaaggttgtcgacggcgagtcagcggcggcgcggagcgtgtgcaggaggcggccacgcgcgaggcctgtgacggcggctgccacggcggcgcggagtgtgggcaggaggcggctgcgcgcgatgcctgcgacagcggcggccgcggcggcgcggagcgcgtgcaggagctctgctgcttgcctgcttctgctgcgcagcagcaattgttgtcttcggtttggatatgattcgcaggatggcgaacttgtcattgccgtcgctgcgggaccagccgccgacgccgatgaggtcgcgcaggcgccagcgccgcgatgatgaggacgacgactctcagccggcggaggcgctcttgggaacctgtcgtggatgggcgagccgtgagatgaagatggcgccaggggcaatctcgccattttaaaaaatttctcacctcttttgacccataaattataaaatattgtctccggtgtcctatgctaattacacaatttttgcagtgtccatcagccgtatcacgtttttgcggtgtctctcagccaagaacatattttttgagtgtcctatagcaaattttgcctataaagatgtacaaatctgcaaaaaataaattcaaaatccatcctggttttcaaggtaaaaaaaggacatgttgcatcattaacaaacgagcaaatagtagacatctccatgaacagcgctgcttgtctccttttgtatcttgaaatctaggaaacaatgaattgattttttgctggtttgcacatcattatgagctttttctggaatttacaatacactgcaacatgctgaaaattcaaatttatttgtaaaggggtcgccagtgaccctagacgctagaattgcattccagaatatatctggtcaagtgtttcttttaaatatttgtatgaatctatgcacaggaatatgcagatattttcatatcttgttttggtagttctgaaaattgtgattttttttaaaataaaatcttgttaatgat

SEQ ID NO: 9052 - DNA, 1501 bp, Oryza sativa
atcttttgtcgttgtcgttcatatatcaaaatctttgtgggttcaaggtcgattcacactcaactgcaaaagagttgtgaacgtgtttctttttattatggtgttttgggtttgttaggattttgcgaatccaatgtgcatttcgatgaaagtcaatgcattcatgccataacatcacacttacgtaccttccatctccacaactatatttctatgaattatttttactacatctgtcccagaatataaaaatttttagggttaaacatgggtattaaaaaagtaggtagaattaaatgggagaagattatgattgattgagaattgcaagtagttgagaaaattgaatggtggaaggtagtgattggttggtaggagcatgttggcgaagaagttgtattttgggacaaaccttaagtgttagaagttgttatattttgagacgaagggagtattttgaaggcatagtgtttctcattaccatgtgttgtcacgtaaggttacccttaccgctgttaactaggcttaccgcggggtacggtaatggttactggtggtaggatttggagaattttgaccaaattcaaaatttcaaaaaaaaatcatggatgtagttcttgttttttagtggcggatggtgaagaattttttttaaaaaggagtaagataaaatcaaattgagtgcaaagccgataatagtttagaaaatagaaaaaagaaaaaagttattgggccttaaagttgcactgtgcaaccggcccattaaggcccaatacaagagaaaatatctccataatataaaaaaaggccatgtctaatttatgcattttacattcaaaagttaggttagcaagtatcgtatatattcttctaattatttctaatttatacttttagtggtttttcaatttttttagcattattctgttcagctaaacaacttgcggttaccgcataaatatcacggttaccgcatcaaaccgtgtccaaacctccaaatttttgaattcaaatattcgccgacgaaattcacacggttttaggtggttaccacatggtaaccgccttactgcgggggctagggatgctatgtggtaaccgccttactgcgggggctagggatgcaagtgggtagtcctattatccgcataaaaacctgcttgctagtttatttcttatatggtagtacaaaatttagaagaaaaaaccagcttacccgccccacttgcatccctacgcgggggtgcaataattcccttctaaacggtaagagaaaccatggttgtcaagcattggcaactacaggccaccacgtccagcttaaagaaaatgtttttaggattgaatgtggtcaaaacttctgtaccaatatctctatagtattcatactgactttgttaaaacgatgtctagattgtcctgaaaataaatgttttcatggcagtaatttttaataggttataacatcatagtacaacagaaactagccttagaagttcca

SEQ ID NO: 9053 - DNA, 1501 bp, Oryza sativa
tggcaaggataattagtgaaatatatatagtgcttgggtatacaaacttatgggcctaatcccacccaagcccctacccacctccggccgatctaggttagggttttgggagggagagggagaggaagtggagccgctcgccaccgccctccccctccctccagccggacctgggaggaaggggaaccgccgccgccctccccccttcttctggccagacctggggagggaggggaaccgccgccgccgccctcccccttccctccggccggatctgggaggtagtggaaccgcagccaccaccgccctcccctccctctttgccacatctagaagggagggaaggggagccgcgccgagggtggatgccgtagccccggtgcatcgccgtcgcccacccatgcctcgccatcgctgacctcgcgctcgcgttgcccaccggccccgcgccttgccgtcgccgccccccagaacgcccacggtcgctgagggagcttagggagaggagagctgagggctgagggagagaggagagctgggggagaagagaggataggacttagaaaaaatattattgatgtcgcatctatttatatgccacgccaattttcgcaggcggaccacttaagaggtccacttgcaaaaataaatggaatttttgcaggcggatcgcttaagtggttcgcctgcgaaaatagatttttgcaggcggataacgatttcaccccacggttgtaattttcgcaagtggtcatttagctctgagagccctacctgcctagaaaaaaatgtcatcgtctagaaaaatgatttttctagtattgactctgatcttcttctatatatatatatatatgtctatatatatatacacacacacacatatatatatatacatatatacatatatatacatatacataaaaaaatgaattaattgtactcaaaccatacacctcgcagcagctccttcaaagtcagatattccacttgctaaactcactcgtgtaatgactttgattccattaattggaactattcaaacagcgtgaagctataaagggggttagggaacttgacaaggaagatggagatattgatgaaatgttgataagggactaaaaaatcaaaaagtattctaaaattggacgaagaggcaaaccacgcgatcagcaccacgacgaaacatgtggctctaggaagtcaattctttaggagagccgaaccaaaaattaggaaatgaagggtttaagtcttccgccttcttcttcaaggaccaacgaggatctaatccaggcaactccatactaagctcctttacatgtacgtacaattacagctcgtcttacttctgtctgatctttctagaggcattttgggcactgcttctttggttacacatcatccatctctacatccgggctcgcctacactatcgttccgggttgatgaaagcgacaacgagatcatacttttattgcttctgcgccaacatcgtctt

SEQ ID NO: 9054 - DNA, 179 bp, Oryza sativa
tggcgacgacgacgacggtcgatggggtcatttcctccccacagaggtgggggtccaagctggctgcggcaaatttagtttgttcacgctgttcagaaacggtggttgcgtttcatgtgtacgggctgcgttgattggtgcatgtgaaggcacgtgtctttgagtgtgtccgtggcagc

SEQ ID NO: 9055 - DNA, 633 bp, Oryza sativa
agtgtctggaggtgttctcaagtcatggtacgtttatgcgatgttttcacaccccgaagttctcctccgaagccaaaaatttaatttataagcgactcctaagaaaaaaaaaccggtgcaaagcaagagtaaacccttttaaatcaatgcaaataataatcggaagtggcatgtggaatttttcttgagttctacatgtcgaaatccactaacaggattttttagtggaattttcagagccctagaaataattttaaccaattaaaattgagcaagcaatattttaattccaggaaaatccttttctctttttctttttctttttcccttcccttccgaatgggccgccggcccattctctcctttttctccccctcctccctgctgggccggccgcaggccgaggcccagccaggccgccccgcctccctcctctcccggggtcgccgacaggtggggcccacttgtcgggtccttccccaacctcccgccatccgtgccggtcaccacccccgaaaccgcccgccgcgcccacgcctccgcctcctccgggccacgtcgcccacgctcgcgtgtgcgccgcgttccccgcgcccactcccctctctctcccgctcgtgcccgcgcccgaga

SEQ ID NO: 9056 - DNA, 1501 bp, Oryza sativa
tagctaaaatggtgaaataacaaaagtaggttctaaggtgatcccacagccactagctatgagagagggtgaatttttatttatttatttgttcattatgacaaggtaataagcatattatctatggccgagtttagttccaaaatttttctttaaacttttaacttttctatcagatcaaaacttttctacacacacaaactttcaactttcaaccaaacttctaattttaacatgaactaaacacactctatataaccgggctgtaataggtattttattgttactcccgattgtggatgcgcgcttggttctctctagtcaagtctcccaccatcagatgatcagacgcgccaaaacgacgcagcacgggcagcaacccccgccacaagccacattttgttccaccactcgccagcaacgtcccgccgctgcgatggcgacaccgctccagtccagtctccccctctccagctggtggtggccgcattcaccgacggacgacgggagtaccccaccggcgccgcaccacggccacgtgacctcgctcgccgacgacgcatacagtagtactcctactcccgtcgtaggaggagagtagccgtagccgtagatacctcgacggtctactacaccctagagcccctacgactactactagaggctactagccgtagaagagaaaggcgacgcgtgacgcccaatcggaagcctcccccaccccatctataggcggccaggccagtagatatagggtgcagcttttatcgcgcttctgctgctgcagtctgcagacggcggccgcagcagaagctgccctccgcccccacaagaagtctcgatcccccccacactgctcccaacgccaacgcacagaggaatttcgagccacttcaattccacgcagaccacctctttcactcttctcttccctctcgctttctttcctcttgaaaaagatagcgagagagagagagagagaacaagcagcggctatagctaggggggagagagacgaaaggaggagaggctagggggtagaggctagtaagcctagtatagaggggtttctttcttttttgcttgggagagagattcttttatagtgggaggagaaagggagggaggaggagtactaggctctactagcgccgtagctctactggtgatcgaagtggtgcgcagcagcagcagcatcttcgcggtattctcgcgcttttctcggaagctggtttttacccggtcggaggagagaggtgagcaagcgtggcgtcgtcggcggggcggcgcttccagtccgactccggcgcgttcgcgggctgggtcgcggcggccggcgggggtggcggccgaggggacgacctgtcgctcgggttcaatgctgcagccgcggcggctgcggcgccggcggccgcgtcggcggcatcgctctggggacctgtcgccgccgcgtcgtcgcgccaggcggcggcgctcaactacgggttagccgccgcgggcg

SEQ ID NO: 9057 - DNA, 1501 bp, Oryza sativa
tcaaactgttaaacgatgcgtttcgtgcaaaaactttctatatgaaagttgttctaaaatatcagattaatccatttttgaagttcgtaataattaaaaatttatttaatcacatattattaccacctcgttttgcgtgaaatacttaatctttatttatctttagaagattcaaacaccacctatctatgcgtagacgccttttacacacatttgggtagaaaatgcggctataggcattagtcttctattggttagactaatattgattacgaaaaagtaataattataggtaaaactttatgcatgtgtagtcttagccgatctaaaagtactctgaataaaaatattaaaactaaatttaaaactaagtatcaaaatttaaattctgactacggtttaagtagaagatgatagcaagtacgaagccaatactatttgaagactgcataccggggtgaggacttgcgtcgcgagtcgagacaagccactcaatcgcacaacagcgagcgtaccaaacaagttgggtcaagaaacatgacgtggagcgagttgagacttcttctccaggactactaatttgcgcatacacactagcagatgaattcacgcacgtgctcccaactacgttataacaagtgtcgggttagggttaggttttcgggactggggtggaggagggtggctatggaaaggggaagtgggggatcaagcttagagggatggcctaggaggcaacaatttgacgatgtgtggcggacaagggcggttggtgaggtggcggtgacgccattagagccgcgaggtcagcagcgggttgtgggctgatgatatcgatgagggcaaagtaaggcgaataggagggaaaggaggccgctctggaacattgacaccttttggcgctggtgaggctggagatgatggtggagatagagctaacttggttgctggaggaagaaagaggaggcttgccaaatagaggctttcgtcgctggaagaaggttgctcaattccgtccctcttctccatcggaggaagcttgctgtaaagagaagggggtttgtcagagggcctccaccatcgctagagggaggcgacagcgtcatcgcttcctcattcgcttgcacacgtgcacgggtgaagacggagagaaagaaatggataagatatatatagagagaggagatacgatggagtggttggtggccatgggccgtgggagcgtgcgtgacatgcgtggccctcttcttctcttccctttactgtgaataaacaggtcaataggttgagaaggggaaaaatggttaattagatccatgccactttaagtatgctgattcagaaaaataccaccattattcgtgatatctgttgcgtgccactggaattttgtaagattgaaacatgccattgccgtcacgttttctttcattgcctcgttagatccgtcaacctacttggcttctccgtctccgacatcgacaccaatcaccaccagtag

SEQ ID NO: 9058 - DNA, 1501 bp, Oryza sativa
  unsure (1)..(1501): unsure at all n locations
aaattgatgtacgtaagataaacttgttacgattttggtacgatctagtgtcatgcatgataattgattggccatggaaacattgtggaccctatatttgttgcatgtattagagattagaagggcaccgacactaatagtaagatatttatcgtatttatagcagagctctttatgatatactccctccattttatattataattctttcgatcttttttttttcaaaactctttaggtttgataagtttataaagaaaacaacaactataatactaaattagtttcattaaatttaaaattgaatatattttgataatatatttattttgtatggaaaatatcactataattttctacaaacttgttaaaatttaaagaagtttgactaagaaaatagtcaaacaacttaattataatataaaatggagggaatatctttttttcagggcagcttgaaattagagttttagggatgttttcgaattgttttcaagaaattcaaaaacgaattccaaccaccagcgagatttagaaacccaggaaaattcaatccattttgatcccttggctatatgaaattacaaaagaaaaaaatattgttttggcgctctcgtgatcaatattcatgtgttcagttttagcatcaggtttatggcgtgaaacgttaaagaggtgaaattttcactagaattctatatccaacgcttgatatataaaagggaatcttatttttagcaagacagcatatcgattatgtaatggtttattgtcaaattatctcttgttcatacacataatattccaccaaaaatcaagtttaaatttgacctacacattgagagagagaaaaattaggtataaataataccattactattcgtctgttgaatttgtcccttttaatatctcaatatgtgagttgagtttggacataaaaatttgtatagttgtatatatattgctgcatgattgtcgttaaattttttttagaattttcataactattcggattgtttttagacaaacgaggggatatttcctcaagagtttaaaacaatttttcaggtcaccaccanatttatatatatggtcttaggctgtgtntgcaaccccttgttcccaacccctgtgtttatatatgaaagttgcttaaaaaacttaaattaatctatttttagaaaaaaatagctaatacttaattaatcacgcactaatagaccactctgttttccgtgcggaggaaaaaagttcccatccatgacatgcgaacacagccttagaacacattttcattttgtatagtcactacaatatcggattttttttgttacgatggatctatcactgccatttttatgtgacaaaatcaaaatacttatatatatatatggttttgtacatactagtgggcaatgttaagtcctcaaatgtttgctatttattgaaatgaaaaaaaaacaagcaaggaataagtagtttagacaaattgcttaccaat

SEQ ID NO: 9059 - DNA, 280 bp, Oryza sativa
atatatgcatgattagaccattgtagctggatcacatgttttctgcagaattttgcatttgtgaaattccatgtaaattttctattatgcatgtcgtgtaattctgtaaatctctcagaaataacaaattcaattaaagttgatcatgattcacattttaggttcattgattatgctattgggcatatactctgcttactatggtatttatagtgtggaaggataacaggcttgaactacaagaatggaatggatttggagcaggtcacctggccagaca

SEQ ID NO: 9060 - DNA, 557 bp, Oryza sativa
catcatggtggtggtggtggtggtgaggacgagaagctccgcttgctccaccgcctcctcgcgcggcgcgacgtcgccatcgaccccacgtgcctcgcgcgccgccgcgcgtgccgtcgcccgccgccggccatgcactgtccgtcgctgctccgcccaccccgtggcctgccgccaccgcgctccgtcgcaaggacgagggagagccaagaggaagaagaggaagagccaagagtggagaaggagaggggaggggagccggcgagctcagcttgggggcggcgggagcggctttctaattccatccccccccctcttttttgtaaagcaatgagtatgtttaactttttgcacccttttccaacatcaatattggcctttctaattccatggaccacattcggacaatataccattaagaaaaatcaagctctaaatcagtcgcagtagagctacgtactaaatgcaaaacagagactaatggtatattgtcataatgtgtaaatgcagaagaaggaaccctgaaggatatgacatgccatctgatttggatcaag

SEQ ID NO: 9061 - DNA, 280 bp, Oryza sativa
cctcttcgctcgcgtgctgcgcgccttcgtagatgcctgcaatcgcgaaaagttcctaccgagcagccgttctttctaccacctcggtacgtgttcaatatgttgcgcatatttgatctgtttatgttttactgcttagtttacatgtgtagatctaatgatgcgttaatgctagtatacatctgcaatgtcatgatttatttatagaatatattaaatcattatatgcctataatctcaacaatccaaaaaccttattataggcactgtgattttacta

SEQ ID NO: 9062 - DNA, 463 bp, Oryza sativa
cctaagcaggggatcagagaagaggagcagagaagcttgtgctagttttaactggtttctttacttgcttgcttgagggctgaacagtacacttgcttgtacgttgggcagcacaccatcatcagtctatacacatgcactggctttctatttataggcttgataaaccgacatgtaggaagcttcaggacctagctagagacttgtagtactactacattgtcaaacttcactggtactagtactactgtaaaatcacatcatgcatgtctacacactacactgttctagaaaatttacagagcaaggacttcaaccttgactttagtttcacgagtagtagagagggttagagagtaggctggtatgttctagaaataaattaactccaacacatcgagcaccacaccggagcgctgttgccgttgtccatcgtcgccgccgccctctcattctatccaga

SEQ ID NO: 9063 - DNA, 1354 bp, Oryza sativa
tccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacaca

SEQ ID NO: 9064 - DNA, 1018 bp, Oryza sativa
tctctccctcttttcccctttttcctcccgccggcgtcatcctcctccctcctccctgtcgccgctttggccgcgaccgccgaacgctagccctctcctttgaccgccctaagtcggttcccaaaccgacattaccatcctataaacccaagcttccccctttcctttcctctcccattcgcctccacgccattgccgccgcctcccgtgctctgttcgccgtcgccgttcgtcgttgcgcgtgtcggaggagccggcacgagcaaggacgcggaaggggactccgagcgcgcccactccttcctcttccccggcccgaggccggagagattactcccgcgccgtcggcctctcgtcactgcgcccgcccgcacggtagtgcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagcagttggctcgtctcccctcgtcctgtgcaaccacccggtgtgctcgctttcgcctgtatcgccgtggttcgctccgccgctcgccgctgtcgtccgccgtccgtttcggccggcgtcgtcgtctacctcccgccggcccgcgtggcagccacgtaggcgccacgtcggcgccagctcggccaaaaccgggtcgagtcgaccccggttagccgctccctccccatgcgcgcggtccaccgcgagccgtgaggctgcgcgtgggcccgccgcatccgcgtctccgcgaaccgcgcgcg

SEQ ID NO: 9065 - DNA, 1501 bp, Oryza sativa
agctcgtgcacgccgttggcctcctcgttgatcctgctcaccctgtccagcagcccgatctcctccacgtccaccagcagcctgctccccacgtccttccacccgatcaactgcacgcgcacatatatacgcacgcgtacaacgtctcaaacacacagcacggtatcatcacacggggaatcgatcggtgaacgggttaggaataataccttcgcgccggcgatggtgttggtgctgtagaggctggcgctgtcgacgaggtcgcagtacttgcggaacgagccggcgaaccgcttgtgcgacttgagctgcgagctcacccgcacggctcgccccgatatgatggctcgcctaacgcacgggtagatcgatcgatcgatcgtgtcgtgtcagctaggctcgatcaggcgcgtgaacacgttaattgtagttggttggttaattacctgatccccctgacgacggcgaggtaggcgtcgcagatgatgccgacgagctcgattcggtagggcctcctcccgctgggcacgggggcgccctcgacgggctcccagtactgctcggtggcgttgccgtcggcggcgaccttgtagcccacgcccatccggtaccgctgccggtgcacggaccgcgccatggcgatcgtctgcagcacgaacggctcccacgacagcgtgccgtccatgatcacgtcccgcccctcgttcagcgccgtcaccagcagcgacgccgccgcgtcgatcgacgactggtgcacctgcgcacgcgacaccgtacgtgtcagacacatccagacccacacagaccgatccggctgacgattgagcaggttcagggcaagcgtggtacgtataccagctcggctgtctgcagcatgtcgttgtggtggccgcgcgagctgatggcctggtagatgacgtccgactccttgaacgcgtccgcctccaccaccacggcgtgcgccgccgcgccggaccagaacaacctgcattttgcacgtacgccacggtggtggtcagctcaatcgccgcgtcacgcgtgcctgctcgagtccgtgatcgaagtggacgaacggactgaccccttcatgatctgcttgagcacggtgctcttgccggcgcccatgccaccgcccatcaggagcaggaccgggctgcggtcgcggtgagccgccgggaccatcacgtcggcgtcggcgtcgcgcagctggccgtcgttgcaggtgaccccgatgaccttcagttcctccaccagcgtggagaacagcctcgtcaccttcagcttccttgacaccctctcaaacctcatctttctttttgtccaaaaaaggaagaaacaaaacaattaagaaccagatttcattctttcttgatcataattgtaccaaaatcaatagaatcaatcctggttaattcttacaaaaaatattccagattaataaagcatgattatttacctagtggcttctaacaccatggttttgagctttcttctaggctgc

SEQ ID NO: 9066 - DNA, 1501 bp, Oryza sativa
agaggatggagtagtgtacgagcgacggcgtgaaggcggtggctcggtttatatagagataggtcgccctgcaaaaggaggctagcatcgtcgccctggtttatgtgtgttgcgtgaaggcgatggctcggtttatatagagataggtcgccccgcaaaaggaggctacatcggtttatatagagataggtcgccccgcaaaaggaggctacatcgtcgtgcatgatcagggcgccctggtttatgtgtgttgcgtgaaggcgttggctcagtttatatagagataggtctccctgcaaaaggaggctggcatcgtcgtgcacacgcgtgtttcctctcttctttccaccacacatgattcaagtggctaggagggcatcctcccttttaaggaggtcctcctctcctagaataagtaaggtggtactaaactccccatacatgctatcctatgagttgggcttttgtgattactcaaagaattaatctttgagtgggctaaagcccatctattaattccaacaaatattgtcttagcatttcttgctctgttcttgtcttaccacttctttctttcttttgattttgcaaccgaacattgagttagcatttgttgcattcctctaaaggatgttaaacgaaactgattttgacagagaccgacactcctttgcgtgttctccataacatttggatgcagaattacagtgattcttaaggaccttcttattactcctttactgtttctcttaaaaaatacccctgttactatagtgcagttctagaatatgtggatcatatagacattactcaaagaaaatgtggcgacgtcccgtgctccactcctccatcgtgcatcgcagttgcgtctaggggtgcggcgtgtggcattggaaaattttcaagagctactcgatgtgacacaggcaggcaaggccatctacgatggtgagtgaacactgctgccagctagttttgggttgtttaggccatcgagttgggccaggaaagcagggaggcggcaagcaggcccaagcagtgaagaagatgaactgaatacatcatttttttttcattttcttcacacacatatacatagtacatactatatttttttttcttaaaaaagatcttgggtattcagcttgaattgaagtaggcccgcccctacccctcacggcagcctgatgaccagagaggcagagactgcctattcgataagttattggaatcgagaaaatgtgtaatatgcatttttttaattagatatcgctaaatttctgtcgccacattttggttcgatttcagtcggatagtccgaattgcaggatgcgctttgcatgcgtcgtgggtgactcacatccgtatatcacggccggcatggacagagatatccctcgctcctctcttctgatttgtctcttcccttatttatgttatttgttaattaatcagtattagtaattctcctatttaagttgtaaatacactaaaattatat

SEQ ID NO: 9067 - DNA, 340 bp, Oryza sativa
ttaggcattgcgtgccttgaagttaagggcaggaacaatccgaaaaggtaaaaaggggacgaatatatatcgagctttattcgtttccctccgatccatcacacgcactcgccgatggatcagctgctgacagcggcgcacgcaggatggtggccgggttggaacttggaagctccaaacaccgcgagaagcatcatcactcagctgcaacctgaagcaccgtggtctataaatatagctccaggacaggctctcttcttactctcacccagtatagttctccattgagcaaactaccaaagggtactcatctgaaacagaatgcagtgatcgaccacca

SEQ ID NO: 9068 - DNA, 998 bp, Oryza sativa
ttttctactttctaggttgtaagatgttttagtcttttgttctaagtcagatttcttcagcaagctcatagaaatacgtagtaacacaccaaattcattaaatccattactggctatatttatagtacacttgtttttgtgctaaaaacgcagttatgttttctataaatatggtcaaactaaaaaaagcttgacttggaaaaaaacaaaaacatcttaatttagaacggagggtttcaaactgagtgtatttaaaaacgggtcaagtatttggtagacttgggagactagcggtagcaggagactcacgtaacacgttgcagtgtgcattaagatgtttgatatatggctgagacttgagattagcataagaatgtcatgactacctggtcaaaccctcttgcgaacataattctcccatttttcacgccccaataaaatatttttatgtcgttgctagcgtcctacttgtgggttgtgacagatgccaaacaaacgtaccaatgcaaaaactattcaaacaaacgtaccaatgcaaaaactattcatggctacatcaggtcaactaataccctgcatacatacatgtccaaaaaaaaaaggtaaaaatttcactcaaaaggttagtgactagtttggccaaagtccatatgaaagtaaaactactcagttctaatttgatgtgcaaggagtttttaaagaatctttactggctctagcaaggagtaatttctgatgaggaaaattcttacatagcttaaatagaagggtttattggtaaatacatagcctatcatagtaagcgacaaaacagttcatggccttatacatcaggctaaatagcatagagtttacaacgcgctggaagttgcagcattattgttgtaacattctctggttctgtcgtctaacacaatggagaacaaacgaataaatttcaaaccagaaaaccgcccttaagatgatgtcaactaaagccgtgttccgttttgggcaga

SEQ ID NO: 9069 - DNA, 1501 bp, Oryza sativa
tgatttttttttctgtttcgtattttcaatgacgagcacaatacaagattttttttcctcaccccaaaaacgagtggacgaataaaatatgctactgggatatactttttttataaatatcatttgagtttaccttttaaacactatgtggaaaaatgctcttgaataaaggagaaaatattggggagggtttctctgtatgcgtgatgagagagagaagagcattatgtgcagttctttttcttattacgctcaccgcatctatgtatcatctttaatccagtttagttatgcgatttacaataaaaccattatagcagctacaacaaccaagtattgaaattcatttgttgacgtcggtaattgtagttgtcgattgcaactgcattgcggacatggtaaaacataaccgagcaaactctttatgagattactatttgatgagagtttcctcatcaacaaaaatttttgatcaatggagaaagagaggagatttctctcgttctccgcgcacacgcttcccaaatgttaaaatatcatattaatttatttttaaatttaaataattaatacttaattgattatacaacaatgactcatctcgttttaggtatcttttcaatattctcctttctccttctctcaaataatctcttagttatcgacttgtaaatgaattgttttttcttaacaatgtcatactactcttccataagaaaataatgaaaatacttctaaaaagttatatatatttgtcacatgtttatcatataaaagtagtagaagagtagacaaataaagcaaccaataggcatgctccaattccacaagaaaccaaacgaggagctacaacaaggtaggaattgtgggtgaccccaagcaatactccacctccatccagatattgcaactacccttcctatcccagtcaaaagccttcaaaaatttattatctccaccacatcatcacaagccgcagcagtcagaaaaacaaggggaagaagagcagattggattagcgccgagccgaggcggcctcgacgataagcttcgcctcgccggccgccgccatgcggaacccgcccgggaggcacctcctccgcgtcgccacccgcgccgtgcgctcctcgtcggcgctcggcagcggcggcggcggagggggcgcctcgacctccgccacgtcccccgtcgccgcctcctcctcatccggtggccgcccgcgcacccgctccggcggccgcctcctgcgcgccacctcgccgcccccgccctccgccatcgccgcggccgcgtgctgggagtcccgcacgatgcgccgcgagggggaggaggagtgggaggaggtcgtcgccggggccgaggaggcggttcatggggcccccgtgcctgttgcggaggaggaggaggagtacagggtggtgttctggtcgccgcccaccggcgacgaggtccgcgcagccttcaccagcatcgaggagtaagattcgtttgcctctcgctt

SEQ ID NO: 9070 - DNA, 1501 bp, Oryza sativa
caaagctagtagtacgtataaggaaatggagaagatgatggagagatcgacgtcgatatgatgttccctttctcccctcaaggttcttcggtctttttttctgacgctgattcgcattcgcgcacacaccacacacagctcacaatctcacacatccatcgtcggatcagaccaatcaaagaattttttttttagaacaccaatcaaagaattactagtacattcttctaccaggcacgccgctgtgctgtgtccaacgaaacggatcgatcgagatcatcaaaaattaattaacgcagtgaattaattaagctgttcgtcgtcctggaccggggaccttcattcaatttggtggtacgctcgctcactgcgtatatactccatattaattggggtaatcatgggaggggtacatgattaggccattcccaacccaatgactaggatggtgtccataacattaaataagctgctacataggataaaaaatgatgtggcaagtgaataaatgaggaaagagaaggaaaccatgcgagacatgatttctacacaacatccaagacatcatgtgagataagtaacattaaattgaagcatgaaatagtggtgtttgcattggaagagtagtgtctagtactagtttctcgatgatgtgaagtttatggaaattatatctagtgttatgggttggaaatggtcttagggaaggacaaaacgtacgctggcgcggccggccggctgcaatactacgcccacagcgtgcaagcgtacgagtggtctctccagcggcggtacggtacacggtacgcgcgccacgcgcatacgtccgcggcgatcgcagtcgagacaccgaatgcgtccagggcgcaccatcatgcatgcgcgccggcccggccagtgatcatcatgggtcgccaaacagtaccattggtcgctgtccaagctaggtaccacaccgcgcgctagctgctgcttgttaggtatgtacccggccaactcggccaattaagcagatactaaaccaggatggagtggcagttactgctactgatctgtgggcttagagaaatgggacgcacatgtcagtgacaggtacggtttgcagatgatcgatgcccaaacaaaatgagcaaaattagataattcttgcgtcctaaaataagtatatttttcaccatcttaaatataccaatacaaaattaaaagattagaataccttattttattaaatctcaatgcaactacttcctacttttatctactctcgaaacaattatttttttattttcacaaattgtagtgcaatgatttctctaaaattgaatttattttggaacaaatgaaaatagttaaaaatgaacctatttcaagacggagggagtaaatgtgtggtatagttgatttaatttcagctgcaatattgggtcaacaagtactcactaatgagtaacccgtgtccattccttatactcattggatcgtatagcatgcatatcgacca

SEQ ID NO: 9071 - DNA, 1501 bp, Oryza sativa
caggttcgggccgctgcgaagcgtaataccctactcctgtgtttttgtggatttgtgtatggacaagttacaaaagattaacttcctttcccctcagccttccaaaaaggaaaaagtcccctctctaaatgggcaaggtcctccttttatatctcaaggggataccacatgcacctttctctttaatgggcggagatcggtacggtttccatccgggagcccttctgatgggacagcccacacctacccccacctcccccgagggcagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttccccagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcggtcggcgagcgtaattaacgcgcgcacgatacaatccatttcgattgccacaaccgcatatccacttcatgcgccgtatgcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgcttccttcctttcgccattgttcctcttgccttcgccgcctgagctctaactctttctctgctacgccctactttcgccacacgcgctcgttctcaatcatctcttcctccaccgcca

SEQ ID NO: 9072 - DNA, 1501 bp, Oryza sativa
agggcgcgcccggagtccccttccgcgtccttgctcgtgccggctcctccgaaacgcgcaacgacgaacgacgacggcaaacagagcacgggaggcggcggcaatggcgtggaggcgagtgggagaggaagggaaagggggagctcgggtttataggatggcaatgtcggtttgggaaccgacttagggcggtcaaaggagagggctggcgctcggtggtcgcggccaaagcggcgacagggaggagggaggaggatgacgccggtgggaggaaaaagggaaaagagggagagaaaagggggcttgcccccttgcctcttcgcgaaaaggaggagggagcgggagcgacgcggcagagggaggaggagctctgcctccgtcccttggaggctagcacgcggagtggcggggccgggcgatgacgacggcgatgacggcgggggcggtgtggagcggagcggcgacacgggcgacaggcgcgggcaggcgcggcagaggctgacggcggcagcgaccaggcggtcggccaacacggcacgcgcgcgcgggatgcaacgggaggcgcgtcggattgagcggcgcggctcgggcgcgcgcactggctcgcggggccgagcggctgcgcggcagggcagcggggccgggcggcgcaaacggcgcaggcgcggcacgggcgacgaccacgcgggcgcgcgcgcacgcgaacaatggcgcgcgggcagagcgagggagcggagagggagggctcgactcggcgcagctcacgcgctcgcgcgcgcggcgcgcgggcagagcggcgaagagggagagagagagagagagagcgccggggagggagggggagatgggccgagagagattcggcccattgaccccgggggaggcaaaatagacttttgcggagggatttgatttggaaggatttggattcggaaatgagctcgacgatagatcggggatttgagatctgaggtggcacggacactagactacaagaaaagaaacaaatttcgcaattagggtttttaagagataattttcccgctaggcgcgacgacggaacgggcgctacaactatattatgaggatctaatttaattcggttttacaagttggagcttaaaatttctggtattgtaatttaggaatgtcaattaaactcaatgtttagatgacaaacgacaagtagacttaagctgctcatttacgctgctgcaatgaaggcccgaatttcatcaaagggcctcatagactgatcttgggttcaatacaaaaggcccatgtggagactgaaacccaacgtagccggaggcgcacgcacgccgtggccggagctgcatgagacgactggtgatctgaatgaatgccggctatttaagtcaacaaatctgctattcaagtccacaaattaacaacctgtcatgcaaatgatcaccaaatccgtaattatgtccaaaaacacacctcgtatcacggaaatcaccaaatatatgctactagt

SEQ ID NO: 9073 - DNA, 1501 bp, Oryza sativa
attgtatgtttgtgcactgatatatttcatattaacatatgttatcaatgtttttcaattttttgataaatatttaggtgacatacaagtaacgggtggagatcccatcaaggtatgaaaatccatatccacgacacacgtatgttatcgaaatttatctattttttacatacttatttttacggtgttctctactaatattgtcacgattaaaagcaaactcaattattgatttattagttctattatcagtgcttgtggaaaaagatattctacaaccaaaaagtcaagatgctagtaccaaatatacgtttcattgtatcagaaaaaaaaagataatggtttaaagtaatttctactacgtagagatcatggtaaaactggatgtgcagttgagcactaacatgtgggtatccctttccggtaaatctggggcaggcaattggttgctagttgaattttgagatttatttttaatccatgcaaccagcggcacgtttcaaataagaaattgaatgctagtggaattaagtagatcaaatgacataaactaagtggtaaaataaaaatctgtatccatatgacggcgggtactgtacaatattaatctgcacactcgtgcagaaataggcagagttttttttagaaaaaaaaactttctgaatcgaaatccatggtcgtcgctcctggtatatataatcttcatttgtcagacccacatgacaaactagacgacttttctcagtttccagttcataatgccgaggacaagcgaagctccggtatgtagaggagcacaagtgtactccatgcattaataattccattgaaaaccagttcgtgtcttaaactactaataattgagtacaatcagtgtgtgtaacattcaagactctgcacttttgtctactttcgatgagaactgcatgtgtcttcgtcggcaggaacccagcataacaggagagcaaaatttatagcacaacttatactacagtagtactttgcaatgtgcgggcggataatgcagcattggagtttatgctgtttgggagtattaggtttcagcgaaaagaaaaaaaggaggacacagaaacagcgcgctgatgatttacaccaaaatgcacgtccagtattttctttgtacagcatctatcttgtgctactccagttcaaattactggttgattgttcagggattcgaactgcaactaggacatactccctccgttaaaaaaaaaaaccaatgtgttcagtttcaaatctaggattgagttttttttggacggagggagcagtacttcagagatcacagaccctgctcagtaaggctgtgtttagatccaaactttggatacaaactttcaacttttttcatcacatcaaccaatcatacacacacaacttttcagtaatatcgtaccaatttcaatccaaacttccaaccttgaaaggaaccaaacacagcctaaaagcgagaattgaacttgagacagaacgacaa

SEQ ID NO: 9074 - DNA, 1501 bp, Oryza sativa
catatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgagcacgtctagctagctatatctctcaacatcttccgagctactactagtagctagctagctagaggaagcagcag

SEQ ID NO: 9075 - DNA, 1501 bp, Oryza sativa
ctactccctccatcccataatataagagattttgagtttttacttgcaacgtttgatcactcgtcttattcaaatttttttgaaactattatttattttatttgtgacttactttattatctacagaactttaagcacaacttttcgtcttttatatttgcaaaaaaaaaattgaatgagacgagtagttaaacgttgcaatcaaaaactcaaaatctcttatattgtgggacggagggagtaccaaattacaaacaatgtctgggaatccttcaagccaaacaaagtgactttgtagacctagagatgcgtcaattttagcaagctcatgtgtaacacgattatgttctctaggacaattcataacttgatagacaaaaaaaaatcattgtaagcgcataaatttggcctatctaatgataacaacttttactcttgatcagacagcaagagttttttttattgacaaaatttaggcatattatctgaaaaccccaggtggccgcgtgtggccgcgcgcgtccgcggcgtgcttcttctgaatgctcacaatgacgccatcctcatcagccgctgcggagcactccaccaaggtcagcatcctcgacgcacaggcgcagcgtacgtctcatgcatgcatcctttatcgtacaagaactattactccatccggtttcatattcctaacattttaaacaaggttaaggacgttaaggtctcttttagaattttgcactatcaataactacaccagcggcatacatagattactcttaaaaagcactatcaataaagtaaatatttatttattcactgtatatatattataatagaaaactataactaaagaaatgttttggcaatcgtgcatgtggaaaatataatttgttgtattctgttgtattgtagtgactctctcacagatatatatagagtatatgtgagatagagatttagagtacaatacaaattttaaaacaaatttatttctagaactacatttatctataataatattctatctctagaattttatcttatctctataatttatatttaaactttcctccgaacatttattttaagaagaaattattagcgtattgggaattgaacgcgggatttttagggttgaaaccacatacctcttgtcactgcactatcaaatgcatatcagagcactgcagcatgatcactaaactccctctccccctaacgactgcaaggcgccgcgtcctccaacccacagtgtgggtgatcgcccttcacattccagagcgccctctccccccctataaataccccactgccagcctcatcttcctccacagcatccatcgcaaaatccacctcagctagctacccaagcgcacgcgccaccgcccgcgcgcgagctgagctagcgatcaacaccggtcgaacacctagcgagcatcaccaccatcatcaccatgcaggcgtacatggcggtcgccgccgctccggcgccaccggcctcgct

SEQ ID NO: 9076 - DNA, 1501 bp, Oryza sativa
tgaactgatgaacatcttatccaactttaccttcctcgacgagggagctaacaatttcttttctagaaagagccataaaactttatacacaaaccatctttttctgataagaccaaagaatacagagacctaaaacaaatgttaattacaggtgaaacactaaccccaagcacctcccatcacataaatcttcatggatagttgcataacacatcacaaaaaaaaaaaaaaaaagaaaagctcagaactaaagctttgcatcccccgcaagaaacctaaccatctccaagctctgacctgacgtggaggactccgacgacggaccccgccatcagccgacgtggaggactccgatgtcccccgccctgagcgctcgcgcgacggcggtcgccgccgtcaggcacgacgacacccacgccgccagcaccgcccacaccttgtccaccaccgacaccgccatcgcccacggcattgacatcccgccaccgccgccgccgccgccgcctctctcctcgtcgtcgccgagaactccggcgattcagtgcatggaccagcaagaacggtggttgtgtaggccacgagatccgcgcggccggcgtgatccggggaagatcacggcggttgctgctgtcgctcggatggggacgggattaaatgggcgaaaacgataatcgcgcctttctccctttttcacgagaatggccgatacgaaacaataacaagaaaaagaataatctctgataattgcaaagccccggaagcaacaacctttcgaggctttgattttatctaaatcgcccagccttgcacacagctacgcaatcaatccggctgtattaatattattgcttgaataagatggggtttaataggggcagctgagtaattacttgtcaactttctctaccccgtttgatccatgtaccgtatatggtgtgctattcatggaattaatcaattaataattgattgccccaggaagattcaagaatacatatactcactccgtcttaaaaaaacaacttacaaataaaatataatataatctaatatactccctccattccaaattgatctacatatagttttttttaggttattcctaaataatctacatatttgtgttcatttattaagtctattcgttatttgtgcattggagtaaatggacagtgatgccacgtgcaatatcttgatttgctattggctaggaaatagtggggatagtgtatgcatagagtttgttgctagagtaaatatagtatgagagagttattagtttttcttggtcttggtgtccctatgaaatatacaggtcaatttgaaatggatggagtaatgaataggacgagatgtacataagtactgaattagcacatatcctattttagattaggtttttatggagtacctgtctagatttgtatagtagattatgtcatatcctatcatatactttaggtttttagagcaagtttaatagtatagcctactactagct

SEQ ID NO: 9077 - DNA, 1501 bp, Oryza sativa
ccccattcatcttttcagttcaagaacatatggggtttcctctgggcaatctgaagaagccccaaacactctcacaccaaaacctatcagttgagcagcccactcttactgggaaggggatagggacagtcagtcagtcagtcagatccctcgatttcgccatggcaaacggcgaaagcccgggaccttcaccggcggcgacgcatcggggattcgagatcgagtaaactaacatacagcgccgccggtgaagaccgtgcgaaaaaaaaaaagaggagatcggattacggcgaccagaaccaggtacgtaccggggagcgggggaggatgcggcggcggcggcggcggcggacatcgtctcgtcaggtctcttggtcaccgccaagatcggagctccggccggtcaggacaggagaagtcgccggcgatggcgaggtggagctcaagctcgagctgcttgcactagtgtgtgtgtgctgggctgctacactagcctgcattattatagtggagcccgggtgcttgagtggatcgcgatcaaaatgaccaaatgagcaaagaagcttcttcaattaatgaaaaacaatcagaagaaacgaacaactgagatctgagagcgataatacggaatctcaggctgggggcggggtcgttcacagcgatgccatcagcgtctcaggctggtactggagcttttccttcttttttttgaaattttctaattttgataacaaacctttccgggtgttgtcttgccacgtcaccttaactaactgcgagacgggttagtaagactgaaaaataaattttggaattgtttgtttttaaaattaagaaggtttaaaaaaatttagaaaaaaactctttaacattgactccacgacggcgacggcgatcactgcggtgggcgatggctgacgctgaccgatgtatgatgtgtcttctcatttgcagattactactttagttatccggtggctacgcacttgggccatccttcacaaaccgggacttcgggatactactacggtggtatcgcaacgtttggactaggtgggagttttttatccataagcatgagtcgcgatctagtctattggttgatagccaggttgatagcgactggtttctgttttgtgatgagaaggtcttcttagatcctgttttttttgctgtgtgcattctttacagagaccggggtggactcttagaatgtatcattttgtagtatttaactgagtccattatctttaaaaaacgatgacatcacgactacgtgagccctcattcctgtgggcctcgcttaggcatatggagtaggaacaccgaaaagcccagcccaacaggcctttcaagtccatacatgcccaccattcgtctctcgctctctctattttagtcgacgccagcgatggcggccgcaccacgcgacgcgcccaaaccccccacaaaaaaaccctaccgcgggcggaggggaggagacgtcagggaggagacgcca

SEQ ID NO: 9078 - DNA, 1501 bp, Oryza sativa
agctccagtaccagcctgagacgctgatggcatcgctgtgaacgaccccgcccccagcctgagattccgtattatcgctctcagatctcagttgttcgtttcttctgattgtttttcattaattgaagaagcttctttgctcatttggtcattttgatcgcgatccactcaagcacccgggctccactataataatgcaggctagtgtagcagcccagcacacacacactagtgcaagcagctcgagcttgagctccacctcgccatcgccggcgacttctcctgtcctgaccggccggagctccgatcttggcggtgaccaagagacctgacgagacgatgtccgccgccgccgccgccgccgcatcctcccccgctccccggtacgtacctggttctggtcgccgtaatccgatctcctctttttttttttcgcacggtcttcaccggcggcgctgtatgttagtttactcgatctcgaatccccgatgcgtcgccgccggtgaaggtcccgggctttcgccgtttgccatggcgaaatcgagggatctgactgactgactgactgtccctatccccttcccagtaagagtgggctgctcaactgataggttttggtgtgagagtgtttggggcttcttcagattgcccagaggaaaccccatatgttcttgaactgaaaagatgaatggggaatctcaatgttagtcaaagggggaattagtttctaattttcccttcaataacatgttagctggtgtgtcaagtcctgtaatttgtgaattgtgagagttcaggctagcaagattaagcttgtattttgttagaaataatgtggttaaaaatcatgtttgggtggttttatgagaaaaaaactgaaaacattgttcgcgaacaagcaagtaaacaactttgcaatggtgcttgcctggtctttcctcaactaggataatgttcttttcaagttaattagctgtcgcaactcactagtagaagtgcctatagaatttaatcaaaacggcggctcacttatccttcctctgccccttcgcaactgcattctggaatcagcttgaaatcccgcagactatcaccagcgcgagcgacctccatgctctgcgcccaaatggccgcctcccaacaaaacacttcaaggttttcttcttgctttgtctctggggattatggaatcatcgttatgatgttgtcttccgtggagaatccccctctctgcatagactagtttctagatgtattgaggatgcaaccttgtgggcagagagactagtttgtgctgacaggatcgttgtaatcctggaaacaaattctttcctccccccttcgcactatgtaatccaaagtcgtgtactcctatctttcaatgaaaattcaggtggggaagctctcccccccggtgaccagtctaaaaaaaataatttaatcaatggttcatgaaacactggtaattctgatactaaatacaatttgcatatttatcagt

SEQ ID NO: 9079 - DNA, 412 bp, Oryza sativa
ttcgctggaaaggtttgtctaaaaccctaccctatggaataggcaccttaatggcattagcttcatggcttgtatggcttatcctagcatgcagcctgtaggtaaccttgtaggtagttaattgttttcatgttcttcggcattatttcgtcaattttccacatgctgctgcgcatgcatgattattcatggaaataatgcaatatctggtagatcgagggttttattcagtatgcaaataaagttaatttataaatacatatgcacctgatttatgttcccttaacactagacaaaaaattatctttaaaatttagattcctactctgcaaatgccgtgttatatgttcccagacaagttctctttaaaatcttgattcctaagtgctgtgtttaatctcatttgtgtagc

SEQ ID NO: 9080 - DNA, 1501 bp, Oryza sativa
cctaccataatcctcctcctgccgcacgatgcgccgcgcccgccgccgcccgccataggcttgccaccgtcgccgctcgctcccggaggccgccgctcgtcgccagatctccacggcgtcgctctgccccatccgacgccggagatgaactccttgaaccccggagatactcccaccgccttgaattgatccctcgtcgaccgccgccgtttaacccctttgcttgccagcggcgcgcgtcgccgcaatccgccgcctccggcctctttccggcgaatccgagccgtcggctcgcttctctcgtcccttccctcccccggtgcgctttcttttccattgaggtagcgccttgctccggtgaactcggccgccgtccgccgtccattcggccgcgcccccttcttcctcctcccgccggcccgcgtggctgccacgtaggcgccacgtcggcgccacctcggctttgaccgagccgagccggtcagccgcctccttccttcccccctcctcgcgcgcacggtccacggtgcaccaaccggctgcgcgtgggcccgccacatccttggtccatccggtgctcgcgcgtgaaccgcgctcacccgaaacccttgcgccgcacctcgcgtgcgcccatccctccgtgaaccatgtcgcagacatgcgggccccacccgggacctcgcatggtgggttcggtccacccggaccgccccctctcccttccgcgcgtccctaatgggccgcctccttgcgcccgcgccggcccaatggctcggccgagcctccttcaacccattgggccgcgcctcacgctcggcctaaaagtccatatttcctccctccgtccaagtcagtgtccatctctcatgagctacaagtccaaatttgctccctctcaattttattctctctcaccttcttgttgaccccacttgtcaatgagtcaaagatattcttgagaatgtcttttccaatattccacaaatatttctcttttctataaattcaataaatcattttcccctctttcagaaatcaattccttattccaaaattccatgaatcattttccttggtcagtgactgtcaataatattcttgagaatattatttccataaattccgacaaaacatttccttgcccagaaaatccacttagacctccaaaattcatatccctcgattcgcaactccgattgaccccgttccacttccagaattcccgtaaaatcgagatctatttaatggcactattatttagtctaaataggatccttttcttggtcttttgtttaggttttcgattgtttgcgtatagttgcggttaccggattttcgtcgatcgcgggttttctcgaagattcgtgaagcttcgtgaagaccttgagcaaggcaagtcaccctttgaccaattgctcctataattggaaaatcattattattttgtttgcaacttgcattattagaatcacacacttaacttgcttggcctcggtttgca

SEQ ID NO: 9081 - DNA, 600 bp, Oryza sativa
ggctagggacgagtgcctagaggctctcatcattccgacgggacggggcgaggcgtgcgaaaggccgcctgttgccacctaacccgcgatctgaccggtctgtgaccggcacacactggacctgtcacgaccgaacgagtgtgttgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctatagtcaagatacccccggtcccatgtcaccgacagtagcccccggcgttatgccagggcgatcgccctcctcgaggaaagcgctcgggcgtgacgccactccttaggcctggtgacaggtggggccggtctctacaggcgggcaggaatccagtggtcgcaaatcgcgcgcatcggcaagggaaaaaccgaccgataataa

SEQ ID NO: 9082 - DNA, 683 bp, Oryza sativa
acccgtgggtcccgcctatcggcgccgcccccattgctgacgtcagccctggggcaatattgcgcaataaatacattaaggcttttctttaatagtaaaaacacagagaatcttctaaaaatcataactaattcatccgagctccgattaagtccattcaagtctcagtaaattcataaaaatgcatagaatccattaaaaatggttttgtttcctgttttcagtagtcttatagcctattttgcttgtgtgctttgtttgtcgcgtagatttcggccgtttcgtcgatctgcggttcctcgaaggcgttgctgtggtctcatcagtgcgagagcaaggcaagtcatgcattacaattgatcatattgtacccaatttacaaatgtcccgcatttctattaaatattgcattattttacaatatcatgtgggatgggtcctattacttagctatatgttgtttcccttatgccattgataacttgggtattgaaatgactagatattggtttaggaaatgcttaaccatgcttagttcaactagtacacaaaaggggaatcacattaatgcatagactttgattattggcatagctttggtttagtgccaccgtaatgatgttggttaattaaaatacactacatggtgggctatgggtgcatggttttgttagtcgtgccca

SEQ ID NO: 9083 - DNA, 1501 bp, Oryza sativa
tcctcaaattcctgtgttttttctatggtccaatcaaacggtcattcctatgtttttcatgtgttttgcaatcctctgttttacacttacatttctgtcagaatcctatgtttttcctattcctctgttttttttaattactatacataaaaaaaatcagtatttggttcattccctcactttgccataccatgctttagctagtcatgtcactgtttcttatgtgtgtgtttgtttcgttgccacaattgtatcctgcaatactttcttagccttaggtccaacatgtcatacttccagttttagagctaactatgccacacctatggccaactattttctacccacacacttttgcttcatgccacaatatgcctaactatgccacaatactcccagttgtggcatcattaggcatcatccaaacatcccctcatccttccaaattactagggtcgttcactgcacttgacttgttctaataccttggaatgccatacagtagatacctttagttttggacttggaggcattgtgaacacaggagtagctcttcctctttcaagcagtagttggtactactacacaagtcgcacagggcactggtggagaaaccatctttcgtcggtcggccgatttccacagtagtcccggatgcaataaaaaccggggctaaagatgttctttagtcccggttcaaaagggcaacgggcatatttgatctttagtcccggtttgtgttaccaaccgggactaaagatgatctttagtcccggttcgaatgctgtcagggtctgtcaggccctcccggtatctttagtcccggttgataacaccaaccgggactaaagatggtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgtacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggat

SEQ ID NO: 9084 - DNA, 1501 bp, Oryza sativa
tacgtacaaataaattcaaaatttcagtacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatatatgtatgcatatatatgtattgaaacatatatatgcatggtttatatatatatatatatatatatttatatatatatatatatatatatatatatatatatatatatatatatatatatatatatatataaaccatgcagcaacagggccatgaaaaaaaaaaaaaggtcagctcgatctttagtcccggttatttcacccgggactaaagatagcgatctttagtcccggattggtactcccggtttggaaaccgggactaaatgggggttacgaaccgggactacaaagggtttctccaccagtgaagtctataagtggcatgaatatggtccgtcatctttggtccatttccttgatcagcaagctgcgcagtgtgatctgggttggcatgattttgcctgtttccatggatcccaagatcggcagtctttggacatttgggaggccatccttgggtgactattgaacgaatatatcagatccatggagctacaccattcccggtgcctcctagttctacgcaagttgttcaaacatggacatacagggcagggcctacaaaactaaaatgcatgatatttataggttaagagaagctgtgctccatctcacactgacaagcacttgtgttgagcctccaaattttcggccatttgtctatctcaagataattttctataattctggtgcagtgcactatttatcatttatcggtgccgtgcacttggatcgacaaaggacacgatataaatgataggtgatgtaattaagtagggtagcatgacaaaattatatacagcggcggagccacctccaaggcaggtctgctggccacccaaactccgctgctaccgtctccactacaacacccgacagcgcctatgaaaattagttggtcactaaaaaacgctattagtgaacctaactcaatggtgtcactggctccgccattgattatataggatctccgtgatctggtttgcctaaaaccggcacctatgaggcgttttccatgtaaatgagccttttgacgggataaaaattaagaactagcacctataactactcattggtgt

SEQ ID NO: 9085 - DNA, 1091 bp, Oryza sativa
tgtctcacttttacttttgataaggtattgcaatctgttatcattatactcttctgataaagaactttgctatggtgttcccgtatttccatgctttatgatgtctcatattgaaatgcttttcagtgtctattctattggtcagctataagatcttaatatttgagtatcatgtaataaatattgcgaagagttcttaatatttgagttgcaattaatttggtttgagacaagcagcattatcatttattttgttgggtatcattaagtaaaccttagcttaaatctactaggtgcatgggtagtctaaaaatatgagttctgtatgtaaactatgcagaatctgttcatgctgtattaatctgctgtgcacatatgcccagttatctatgacatataaattataatcatgttgatgctgtcatggccttaagattgaaagaatatacttgttgccttcagcttgatttatgttttggttgaagaattggtgttgttttactccttgattgactgtatcaccttgactgaagtatttggggaatgtggcaattctatgttgaagtgtgtcaatgctaacattgattactgagttgcaagctgactttctgctccaaccaactcttgtgaatgtgcatttttttgccacaatagcggtcagactatttaattctgctaagcaaccctattctatcctctcctgattccaactgtagagcaatagaagatcgataaaatgtctatgcggatcaaaacaccacctttggaagcataatttttctttttcttaccagtaattttgtgtttctgtaacaaaacaagtaaataacatatgttactgctcgtctactgattcacgggtatcttttttagtttcctatgtgcttggattataattgtcttcttggatatccccagactaaagttttctttcaactcctcagtctggtcacaggtctaattcttctgcgcatgctggcaatggaatatatagagaaagaaacacagttgggtagtgaactgggatggactcgagctgcgacctcgtgattctgtgtaccaccgaactgattgctgcactcctccaacca

SEQ ID NO: 9086 - DNA, 1501 bp, Oryza sativa
tatatttatatttagcagtaattcatgtgtctaccttttcatataatttattatagatcttatgtaaaggccttttaccaactcttgcatacaagctaaagcaaacaccattccattagagggacgcagaggcatttggttccccatccaatcaggaatttggtcttcacaattactggccaacgattttctcatttataattcaatatgaatgtctccgaggaaaagatgaaccacaccagtccatcccaaagttagtgcatgctgaatcacaacgggagtaatccatttttttggagataaaaaagagtaatccattgtccggccggggtcaactgaccttgttttgcatgttcttggggcaaaatcaaatggttgtttatataggggcaaaatcaaggtccaaaattggacttctattttcaaaagtggaaaaattggagttattccttttacttatcaatattacttgtgtgttttgcaggagagtaagaaagttaaacgttgttggtcgaatacctgcagagctacagaatctcacctttctacaagacctgtatggatctatgacttgtaatgttaatattgataatgaagtttgttaagctgtatgtcaatgttttgtagaatacatagttttaaccccatgaatataagaattctttttagggggctccatctaacatctttagaggtaagagctctaacaaaatactcatcactatactgatattgatggctttgccctaatgagaaaatgttctgtcctgccattaataaatcaggcaaaagtattatccttctaatgtaatcagtgatgttgtctagctacaaaaacgtggaatctttcactaactcaactgaagctcctgaattcaaagttcaaataaatataccaaatatatctaggatccaaagtaatcataacacaaagttttatactaaaacaaaacagaagaatgaaaactgatactcttattagactctgaatcattgattgatatcttgtgaaacagacaggaaatataattagatgccaaatatatttgaagttcagaatttcagttgtagcattttatttgttttcttacagaactgattgtatacattcaaatttgaaaacatatttcatttccttctatcataataatcgacattagaacacataaaggtccacttaccacctatgaggtaagagtaatatgaaccgtcgatgcaaaatacatggtttggaaagagttggtgtaccgtaaaaaatcctttgaataattaacttttgattgcaaggcaaaaaacagcaaatggtagttgcaagattttgtgtttgctaatggacttgatgttcccggtgttgtttcaggaacctgaatcagaattatttgactggtgccatcccatcattcattggaaaatttgcttccatgaaatatttgtaggagttacatgtcaagctatggattaatacaccatccattggtgggtgttatgttttaattatctt

SEQ ID NO: 9087 - DNA, 1293 bp, Oryza sativa
ttgggcctgttgcaacgtggtgtagcgttggacagtgattggttaatattgattaattactacagctgttttactgctttcaactactgcttttaaatgctagctttatgcaaaagaacctctagcctcctttggttgtatcctgcatcatacctcctcttccggtatgacttgctgagtacagtgggtagtactcagtcttgctctcttttcccccacaccagagctgaagattttcctagttggagctgttttgtcaaagttggtttcgtcgctgccgtcaaggattgcctgtggaatggaaccgctcgctactgaagtcaagcttcccggtttagctcgcttttatcttttccgctgcatttgttatcttttctatttttgtaagacgtggatctgtatgtcaacaattgtcgtttgtgtaccctggctggtcctggacagggatttaatgcacattcagcttagaaattctggttcgagaatttctgggcctgacaagttggtatcagagccgaccttgaccgtaggacaagccaactggaaaacctaagagccctctgaaccccttttcatatgcatatgcccttttgcacttggattttgtttcgggaaaattttggggtttgttcttttgatttgtgggaaaaatcttggtcgcttatttaattggatttctcgactagggacagtctagggagttagtaaaaatttattcggaatttattcggcagtcggtcgggaattgtcgggtgatatgcattaggttgtgtctatgttcggtggggtaagtttatgcgtatcggtatgactatgcatttattttatgcattaatttattgattagccagttgcatcagtatcctcatttgagttcatgaaaaatgttctatgcataaaaatcatcatgctcggttatttatttgagtcttctgttgcttggtttaatttggatttgagcatgaattggttcctatcccttgtctactttagatgtcagtcctatccctcgtttgcaagcgccgccccgagcttcagagtcgccgcccttagctttatcgtcttcttagtctgtttgcttgctagttttcgtgtttaggtttgttgcttgagggttagtcggcggtcgatatcatgtgtcagtggtatgactgcctcaattaggagttgcgtgcctctttttcagtgttttaatcaagattaagataattgcacttaaattcataaacaagattagtttctgagcctcctgtttttcttccttttctcatatttctacctatccccctcaga

SEQ ID NO: 9088 - DNA, 1501 bp, Oryza sativa
gcaggtgtgggacgggaaactattttaacagctcgagtggatatccacccgtttattgcatgtcatctaaatggttatgaaaaaaattgaaaaaatatgaataagttagatcaaatttaactataaatatactatagtaatttgagttttgtttgttatttttattacaatctgtagaagttgaattttaacttgcatgtttgtggagtgatatgttacatattgatctatcttgccaatttttttgaaaatttttcatagcttgttatttttgttacaatctgtagaagttgaattttaacttgcatgtttgtttgtggagtgatatattacatattgatctatcttaccaatttttttgaaaatttttcatagccatttagttaacatgcaataagcaggtggacgttcactcgagctattagaatccatctccggtttgggacgccgtttgacccgccctagcaagcagcatataagtatgctaggcacccaagtacaggcaccccggttggagagataatgcctacctcgatccccaaacggccgaaacctaccaaactcccgccccccgcagctggggttacaaagcccgcaccaccgagctcggcgggaggagcgctcgcgcctcctcttttatgcgggcctcaaccaacataattttcccatatggtactaaaatcttggtttcgcacgtgagcactgcctgtacatgctgactacgttcagctatccgctaatgcacacgcgcgcggtgattttgcatggtgtacgtgcgcgctgttcgtgatcatcgtttggtcgatcttgtctcgcagacatcgtgatacattatcagccgtgattcaactaacaacgggtgcgtaagaaccttagttacattttatattttggaaacacggcgagatcggccaccgttcgccactggcgaacccaaatatggccgccggccatcgatgccacccttgtccaggtcgcagggacctcttctgagaagaatcaaaactctaggcactaatttataaaagtttgctcacatagagaacagtcacaggactgcgggttgattcctagaaatctcaagagcctttctgcatattagcaggtcactgaccagtggacccatttgtttaaattctggataaataccaagaaaatatctaaagcattatttgctgaactgaaaattatacaaactttagaaatgcataaaatgttcatcctagctccattttagatgaacaaagttccagtaaactcataaaatttattctcttttattttgtagattcaaaagatacacttacagtacaagaaaaaatctctaaaattttgtataaagaataattaacatacagcataatctaactacagaactaaaatgaatcaaactaaaacttgttagcttcacatggagtttgaactttattttggtgaactcagatgtggatcaaataatatacaaaatatatccacctttagatagatgtaaatgattata

SEQ ID NO: 9089 - DNA, 1501 bp, Oryza sativa
aaattcaacttctacagattgtaataaaaataacaaacaaaactcaaattactatagtatatttatagttaaatttgatctaacttattcatattttttcaatttttttcataaccatttagatgacatgcaataaacgggtggatatccactcgagctgttaaaatagtttcccgtcccacacctgccaactctcttttttttttgttattttctgataaggcgaatccgaccgtgcgcggtggcgtggcccggagtggatcaggaacacgagggagcggcgttgatggcagcggcggtggtgggcggaccccgagaggcgctgtactcgccgcgcgcgtggagctcgtccacgggctgcggatggaggccacgagcccgttcagcgcgtgcagcggcgccggcgaggcggacgcggaggcgaccagcgcgccgacggcgcggcccatcagcaccggatcagttgaaacaacccacatctgccaacacactctcttttttttttttgttattttcgcttctgataaggccttctgataaggtgacggtggcgtggcgccggaggggataaggcggctgctgctgcaacaacgctggcgcctggtgccatgggagaagagacgcacgcatcgcccgagaccccaaacaccttcgaccagcgctcaaagcgtgcgtatctgcatgcgctgcgtatgcgatgacgtagctggatggtctctcaacttttcgccgttggtggtggtgacggcgctggtgcggggagggcggctgcggcgaaatcgaacacccaggtcgagaacgccatgccgacgaagagcgcgcttgtccttgtctgagccaccggaatcttgcacgtaggtttttcccggccgtgcgcctgtgccgattgttgacgttagtcctggcttgcttcagaagtttggctcggtcgtgtggagcggagcgagatgccaggaggacgtcatcttcttcggatcaaataaacagaaataacagatgcaatgcagtttgcgagagttgcgtggagtgcgcggtgtgcgtgtgtgttccagagtcctgaagaaccggatcgtgggatggcacgatttttgggcatagaattcgtttttctgttgagtatatttaggagagtagctccaatttccgttttgcaagtttacagttcagttcaatgaaagaaaccagaaaattgccccacaattcctctctcattttcgctactctgaaactctgcttttctctgttttgtatcccgctctgaatttattcgtttccctgtctgttgccgtgccagacgcgcatagtttgcacgcgaggtgttcgatccagtgcattgtcgctaacaagtggtatcagagcttcttaggttgggggggagggggtggatctgacactatggcgttggttccggtgacggcggatccagcgagggggagctcgggaagcgtgttcctttaccctcaactcacatcaaccaactacactagttgggtgatacggg

SEQ ID NO: 9090 - DNA, 1501 bp, Oryza sativa; identical to SEQ ID NO: 1124

SEQ ID NO: 9091 - DNA, 1501 bp, Oryza sativa
cggagagccaccgaggcgacaaaaacaatcttctacagtaccgtagaccgtatgcttctgcatcataactactcctacacagaatcagagttcggaccaatactaaactgtcaaaactcagatctactgttgatctagatccaccagcagtagcagcagcagataaaaacaaatctcaagtcccatccgttccgactcacaccgtcagcaaaaacaagattgacagctgcaggtcgtgtcctcttcaatggagtccaaatcgatgtgtgcattgtcgcactgtcctagctccgcggtcgagaatagctgatggaaataaattccgcgcagcgatcctccaaatgctgcaaacgagtgacatattgtatcgagttcgaaaaagtttgaacagaattcagtggttagctgctgacatgtgcttggttaatgaaaacaatatggtcactgcacatttcagacggtccaagatgctactagtaacggttaagcaattccctcatgcatctcgggagacacgcacaagtccctttgtactttcaggtgtgccttttatcctaagagacaggattatctacatctaaatctggttctagagtcactaccagaaatgacagacaacatcaacagccaaacaggaaaaacgctgtgcacatgacttgcacatcactttagtgctcgttggaacagtgttcttattaatgtatagtactgtatagtattcatccccgtcttaggtaagctgttgtatcaggatattgttaaatggtcagtagcgctcattaactctgaagaaattctgaagactgaaaaggacgggatcatctctagaggtggccaaacgggcagcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcaggccggcacggcacggcccgcggcacggcacggcccgtttcgccggcggcccgtcaggcgcggacagggcgggcggcggtcgaatgggaaggcgccacgtggcactaacggctacttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 9092 - DNA, 1501 bp, Oryza sativa
gttcgaacagtttgttaacctctgcagagggggtacactttacccacacgacattactaacccgaatcacccagcccgtgtagaatggccacgtctggtgacctaagggctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccccgattagcaatttactcagccaggggcgtcccattccacccgtgtggtcgcactattgtatgctcggatgtaattccaaaggaatcggtccttagatgcgaccgcacaagtattccgcccaggaatggccttgtgtcgcgagttttatttttaaaactcattttctttcacaaggcaccgacccaggcgtcgggttttccaaagcttttgcaaaccaagttttacccaagaagttactcagattttaagtttgaaggcgaccgttgatactcgcacagagtgcacgaatatcgaggcgcaactagatggttacaagggaacatgatataacaattaacaatggaaggatcagatgcaacaagttgggtaggcccaccggtctgcctttcagacggggcaaacaaattaagtgtaatcctatcaatgcataatattttgcaagcaatataattaagttcaaatataggctcagtatgttcaagggtggcttgccttgctcagggtcttcacgaagcttcacgaatcttcaagatatccacgatcgacgaaaatccggtaaccgcaactatgctcaaacaaacaaaaacctaaacaagagaccaagaaaaagaccctatttagactaaataatagtgccattaaatagatctcaattttatggaaatactggaagtggaacggggtcaatcggacgattggatcgagagatacgaattttggaagtttaattagaatttctggcgaaggaagatatttgtggaacaaggggggattgattcatgaaatttatagaaataatattctcaagaatattattgaccgtatctgacgtgcgggaccaaaggaaatgatttataaggaaaatgattcatgaaattttggaatagagaattgttttataggatcaagggaaaaaagatttattaacccacgaaataagataaaatgatttactgaatttatagaagagagaattatttgtggaatattggaaagacattctcaagattatctttgactcattgacgagtggggccaataagaaggtgagagagagagaggagcaattggagggagcaattgcggacttttagctcttcggtgtgtgagcaccggactcggaagagggagtaaaggtaaacttcctttgttttgttaggccgaggaggaaggctggccaatgggccaagcccacgagccaggggagagagggggaggggga

SEQ ID NO: 9093 - DNA, 1501 bp, Oryza sativa
aggccttttattccttgcaaataacacaagactttctataccaatttccagtgctctgggcctggattactctgaaatctgccaagtaacccggtaacaaatgccaagtcaggtcgtgtgcacaattgagcatactgtaggcttcctacaactgatgcatttggctttgttttcatttcattgagctcacactgatttctgggacattgcgatgccccatacttttcgcctttgactataggagcaggtgcagcactgcatctgttcatattgaatttcttcaacaccttttctatatatgccttttgagaaagtcccaatgcatactttgttctatctcggtgaatctctatgcccaaaacatgtgagtcctcaccgaggtctttcatgtcaaagtttgaggataagaatttctttgtttcctgcagtagactaacatcactactagcaagtagaatgtcatctacatacagaattaggaaaataaatctcccattcttaaactttgaataaatacagttgtcctcgacattctcttgaaaacccaaatttctttattgttccatcaaatttcaagtatcactgtctcgaagcttgttctaagccattgggctgggcgcccccaatcagggcgcgggtcaaggcccccttgagccgttgggctcaaggggagggagatctatctaacagtggcagctgtagtagggttgggcggcgggagaaggagagcacggcacggcgtcgatgtggcatggttggcaaggcagcggtgcaagccgtgggcggcggcgtgcgaaccacggcaacggtggtggcggcgtatccatgtacagaggaaggagaagggaggtaatatagacttattcctgactgggccagatgaaggaactttggcccaaaatgaataggaagctttgctaattttggataaattttaagaaggtattagaaatagaggaataagattttaacccagtatcatatggtatggactaaaggaaatttggatttttgaatgaaaaggaatgaaaataaatttcttagcacaagagcaatcattcatatatttgtaatagtattattcttgtgccgagaaggaaatcaagccacagagattaaattggtggctaggtcaaaaggaggaatttggatatttggatcaagagtcaaaggataggtttaagatcaaaggatgggctaacaattaattccaataaaattggaattactttggtttaggttcaagggcaacattgggaaggtttcttggactacaattcacaaaggggtttttaaataaatttaaataaaggaaatcatggtaaaaaaggaagtatcaaatcacgatataactgaagataggttttaaataaaagtcataaaataatttaaataaacgaagaagttttacgcaagttagttttaggaggtctctctctctctaattatattttcctaggtttagaaggttaataagaacataagaaccggcatgatcagg

SEQ ID NO: 9094 - DNA, 1501 bp, Oryza sativa
cacaaaactaaaattggaaaatattaatgaggctgatgctactatagtggataattctaaccgtgtagtcgaatgggtagatggcaaatctgaaccattcgtttgcttagctttaaaaccatctgcacaaaagtgtcggctagaggagaagaagtatacttttgacttaaccatgtgtgatcatatttttgatgcattgttgaaaaataattatattaaattacttgatcaccatgtcatgccatcacttcaggatctaaaagaacgaatttattgcaaatggcataattcgtttgatcattgtactactgactataacacttttcgtcagaagatacaatcggctattaatgaaggccgattgaattttgcaactctaggaatgtcacatgccaaggatgaccgttttggtaaaacaaatcggtctaggtggtctaataagaagtggtcttcggcgcaggtgggaggtagttcaataaggagcaaatatgggtgccgaagtctagaggtcaagaaaagggcttagctactagtgcacgtgtgggtgtacaaaaggcttcagttcagaaaaatgttattgaacctagggggcatgcacgtgtacaacaactagaaaatttacaccatgtgagtatgaagcgagaggcatcttcggcagagttagtaacaagtcaaaatctgctgaagagctcggggggcaatggcaatcaaccgagacactcacagagcttgtcaaattggcagaagaagcagctagaaaagctaagtgtagagaatgtgaagaagagaggtatggcatggattcctaaaggaagtgttcaggtgcataatgaaacagatgttaaagttgaagtagggtgtaacagccctaggttcataaccaggtatttagaagtgcttttgttgtcctttacatttcatatttactatattgcaatttgatcataggcgatgacaaagttaactctaatcggtaaaattgaaaccacttctatttgaacaataacttgaacagaagtgtacatttataataatttattcaaatactagtttatttatcaccaaaaaatataaattttgtggaatttttacttctgtttagtcctcctaaaaattcaaaccaactttcagcctaaccaatttcatcttttcaccagaattaaaatattttgaatttttgagtgaaactttgaaaaatggaacctagaaaccaacacctgtcaccacaccaaatcccttaatttttgaactagttttacctagtcaaattgaatttaccaagagagggaaagaaaataaatcctggaaattacaagaacgaatctatactcagtttttcacccacctctctcaccctcatagacagccacgacttgggcccacttgtcactgaccttgggtgcctctatagccccacaacacatccatgggcgtgctcccacctcaggacttaagggggggggggggcagagaaaacccctttcatcttcactgcttgttc

SEQ ID NO: 9095 - DNA, 1501 bp, Oryza sativa
ctatgtcgcgtatatatctgaactttcgtattggtagtttattttcaatatcatggaaaacatgtgtattttttcccctgccaggtgagatttatactagtataatatctaagaagtttcttaacattcacggtaccacattttttttagtgataatatgtccttagtacccttgggtatccaaaatattagaaagtatcttaaatttgtttgagaaaatatggtactttgtagtttctgaagaggatctcaatgatcattaaaaaaataaatatttaatattcaaccagcaagtaaatacaaatatttccatccgtaaggagtaaatcaagcctgtgtatcttatacctgactgaattggtctggttagctagtataacatgcatagcctggttcatccttattgttgttttcctcgtgtttatctctgtgtttttaacatgtcatgctgatcagctttcaactatgaggaaggtagagctatctgcatgtacagacacaaggtgactgtagtgcttggcaagtgaggatgaagatgtcatcttccctcccctgtctacaaattaagctctcagtactgacacattccagcagttaaaccatgcacatgcatatgatgcagaacatgctctctagtatatatttcctctgatgcattcctgcagctagcagtacttgcacggattccattctctacagtacatattcccttctcatttctccatgctactctttgttttcattttctcttcccaacaaaaaacatgtataccagaagacattcatatatatatatatagctcttgtattcatcatctgatagaatatacagtttcaatcgggttctgcgctcagtttgttcccttctttgcgcagccttgagtacagacacaagccccatccctagctagccttaacttttccattgcatatgagaacaggctaagtttccctgtgatctgcagagaatttaacaaacaagacagtgattgcatccaggaaagtgcagtacagcacgcacaagcaacatacgggcgatcagaaatatactagctagatgtcaactgtgactacatttagaggcccggtttagttcctacgcaaaaacttttcatcctgtcatatcgaatgtttagacacatgcatgaaatattaaatatacacaaaaagataaaactaattagacacattgcgtgtaaattacgagacaaatcatttaagcctaattgctccataatttgacaacgaggtgctacagtaaacatttgctaatgacgaattaattaggcttaataaattcatctcgcaatttacaggtggaatctgtaatttgttttgttattagtctacgtttaatattttaaatatgtgttcatatatccgatgtgacacactgaaacttttcacccttagatctaaacacggtcatagatgaatttaagaacatccttgtgtgcaccagctgtggcctcctgcaccaggaggccacggcattggcaac

SEQ ID NO: 9096 - DNA, 1501 bp, Oryza sativa
aacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttagtataccctcgggtatccaaaatattagaaaagtatcttaaatttgtatgagaaaatatagtacattgtactttctgaagaagatctaaatgatcattaaataaataaatatttaatcaacgtgcaaataaatacaaatatttccacccgtactcacatatggtatggtaagtggcaaagagtaaatgaaccctgtgaatcttattacctgactgaattggtcaggttagctagtataacatgcatagcctggttcgtccttattgtggttttccacgtgtttgtctctgtgtttgtaacatgtcgtgctgatcaggtttcaactatgaggaaggtagagctatctgcatgtacagacacaaggtgactgtagtgcttgggaagtgaggatgaagatgtcatcttccctcacctatctacaaattaagctcttagtactgacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatt

SEQ ID NO: 9097 - DNA, 1501 bp, Oryza sativa
tttataaatgaaaatatagtccatattgtgggggtctctcactgtttctggtaaaaaaaaatagtcaacattgttcttaagttattgatttgatttaattgtacaaaatataacaatgtgattgaataaaaattatatgtataatttaaatgttatttcaactaatacagggacagaagtaaaggagcgggaggatggtacccatagctacacttaacatgggtaattatcctttcaatggtagatgatgtttccgtcgacagcgatgcgccggtgataattttgttaaactcaaaatataccggtgcagtctctcagagatgcttatagaggtagggtgtacatgtatacatgcatatgagtaagtacacgtgtacatgtgagtacctacgtttatattatgtttcttttttcatgcattacccccttgaaaacgattaattagcaactaactgacagagttagttactttcctaaaaatatcaataaacaaatttccggcggcaaagcacgcggggtcgaggcacctcggactaagtgctaaaaattcaactgacagcacccaaaaacctacaatgttagtatatattgtaaaatcaaagggtatttcattcttattctataataaacaattggcatctgagattattagttttgatatttggagattattggtgaagtggttttggagatgattggattttacaggtgatggataggtttgataagtctgacggttgcggtcagaccggctgggtaaggccaatcagacggagtatagtgagcagtcaggccagtcaacccgtggtctgaccagccgactctgtgtcggttttggtttcgggttgtttcgttggatatccgtggataattcatatatgtttatgacttctagatgaatactatgcgtatgtaatattgttgtttgctaacaataagttaagttgatgagaactatgctcatatatggtttcttggttgatgtatgcataagtggtcttgatgcctcgggagaatgttcccgatgatggattggaagccaacttgggagaagatgatgtccacacgatcatgatatcatgcgggatgcttaggctaaagattaatgcacgcggttggtgaagattccatatgacatacgatggagtattgtgtgcgtatgggatgcgtagtcaaatttggagggagtccaaatttggtacaattggagtttgtaaagtttgtttcttgtatgggaaggtttcttaggagattaagacttactgtacaaggttggattgtggctttaggctacttacgtcaggtatatatagaaagggaggggtgttatcgttttttagagagttgagttaagagaaaaaagttagtgttttgagtttagtcgagatttttatgaggaatgttgttgttgcactttgtaaacacagagagaagtaataaagttttaatctactttgagacatcttcaatttgtgtttgctcggattcgcagacggtcaga

SEQ ID NO: 9098 - DNA, 1501 bp, Oryza sativa
cgcaggtatccttgtcagagcagaacaacacctacaacatgcacatactctggtgtttttctgcatctgctatttttgccaacgagatcatcgactccccaccctccaggtacaaatttgatccttggatataattgactagtgaatgctagaatctagatcattctgaatttatgattgttcttttcactaagatcattaggtccatttttattcttttttttgaacattatccatttttattcttgaaatcgcttttcatctgaaaagatggcaggttttatgtagtttacaacttgtatgttattaatctgagatatctggatattttagcctgaagcatcccaattacctattctacatttttcggccaactgcattcttaatttttcttttttgcacaatgtcatcgattgcatatcgggtctaggcgagcccaggaaccacagttaaggaaacaaaatgtgacctccatgcttgtctgaataaaaaaagaactgttggctaaaagtaggcataaaggaacctaaactggtagctcaattttttatgaagcattttatttcttctttggcgaaccatatctcatttagagtcatttatgagtgtaaattaaagacttctcttatgatgtaatcgcttttgtctatatccaggtggctgtgggattctctctggatattcgtgggtgatggatatatgtcgatgggagacctaaggaatctatagtgctttgtcggctcaacatcgatatgtggcactagcatcgtcttgcttgttggattcgtgcatgtaatagtaatttagttactaagagacatatgttgagaactatcggtgcaatagtaacttggttactaagagaattttttggcaatatcaatatgttatgttgagattggtgtaatataaatttatttactaagagaaatcttgtgacgatgttaatacgctatttttaagtaatttatttactgcgagaaagtatgataaccaattaagtgtagtattattttaagtaatttatttactaagagaatgaatgagaacaacctgacagtaattcatttactgagagaagtaaccaattgagaagggctgaaaacaacctgggagtaatccaattactgagataaggaatgaattggattccgagtaatttatttactaataaaagatattaacagggagtaatttagttactacgtgtgcaagagaaatgtgcgggttacagttggaatggactatttactaataataagatattatctgcgagtaatttatttactgaaagacaaaaatggtgagagagagaaaaaggtgcgggagacggtgggagagccccctggtgagggtggggggtgggggtgggtgctgtgaagggagtagtttagttattgcgcaccccatacgcggtttagcgcatccctatgtatatctgtatatacatatatatatatatatatatatatatatatatatatatatatatatatatata

SEQ ID NO: 9099 - DNA, 1501 bp, Oryza sativa
  unsure (1)..(1501): unsure at all n locations
attcctgccaagtagaaagaagtgttgccacacgagctccatcgtttgctcttcaccttacccccacagccaaaatttcaatcttaaatcgttgactttgattgtactttatttttcatcattggtttattagtcactataaagatatttataaaagttctatttacaaattatttttagctgctaataaacgttaggacttataatcaacaatatcttccgtagttgagtttcttagtgtttctgtgtgtttctcttcttgtcttcaatatctcgctgtagaacttttgtgtgcgcatcctctacatgctcaaaatgttattcactattagttcttctcaaatactacctccatattttaatgtataacgtcattgactttttttcaacgtttgaccattcgtcttattcaaaaaatttatataattatcatttattttattgtgacttgattcattatcaaatgttctttaagcatgacataaatattttcatatttgcacaaaaatttgaatagaacgaatggtcaaatattggttaaaaagtcaacgacgtcatacattaaaatacggagggagtatataactatgttgccctagggattgccagggaaatatatgttcccagggctagaaattatggaaatcacaaaatctccaaaagtgagcaaaattcaaatggtgaatttgaattttcaagaaacttcaatcaaataaatgaaattcgatgaggcagtcattgtgactagcaaatgtgtatatatcttctgtgaattnnnnnnnnnnnnnnnnnnnnnattggcaggctgaaaaatgctaaattatttctttttatgaaattcatctagaaatttatatttggtatttttttttaaaaaaaatatggtgatacttttctctgactccccaaaatatatcaaaaaaaaaatggtggctgggcgcggggtcggcggcggcggccgtcgaccgggtgggggcggcggtcgccggcggccagcggggattttaggatttgtgatttttttttgagattttgtggtgtgaatatgtgatgcttttttagaatttgtgatgtaaccatcattgagaatttgtgatgtatgatatgtgatttggagataatttagggatttcacgatttgaggaagattgatctatgatttagagatgatttggggatgatttgggaatggagtgaaattaatatgcaaggagggtccaatcgggacctggcctctttcatctttagttggactaaagatagatttttaaacctggttacttcatagtcctgattgtataaccgggactatagggggttacgaatcgggattaaaaaccctttctccagcggtgttataactcacaactggacacagcaatatttagccaaaggtgcaatcctaacgaaattgatcttgcctttttaattgagaaccacacagtaggtcagatgcaacccaaagccgaatgaacaattactactaataaaccttcataga

SEQ ID NO: 9100 - DNA, 1501 bp, Oryza sativa
cgatgacacaatatcatggtcgttaattagaattaacgatggcaaaagaacacggtcgttaataagataacgatagcaaaaaaaaagcaccatcgttaatgaaataacgacgggtaaagatcgtttggtcgttaaaactattaacgacggagcctttaacaaccactgacgaccacaaacttagtggtcgttagtgacctttaacgaccacatttggacttttaacgaccaaatctcccatcgttaaaagtcgtttccctagtagtgacatatagttttatatatttaaaaaaattcgaataagacgaaccgtcaaacatgtgctaaaaatttaacggtgtaaaatattttaaaaacggagggagtatatatattcttccctaattcccatatgcagtagtcgtagcgcgtgggagggcctttctcaagtcaaaacttagatccaaagggatgaaaatcgatggatgctgctgcatccggggcggggttgaaagtctctggtagtggtagatatatatatcaaaagaagatgattaaaaagataataaataggtgatccaagtcgttggtcacagatctaccatgcatattcctaacgactgcttcagaccaagtcctaactacaactctgcttgtaatatttgctcagcactgactggactgactctggactagtcctgccactactctttttctgagctccaagtggacagtcagccggcttgatcagtggcatctgccaaatttccatgtatttccaattctacttacctagtagatgatataggatgatgatcgcgtatggtgatatgttgtagcttggtgcaaccactagtacagatccttccatctgtgatggcccataacaagactggaatttgcgggccgtcacaaggaagtaatctcaatcgggctgaagtttcgcccgattgagatatggtcgcacaggcatggtatatcggcataaaaataaagcccgtcacggatgacacttatctgtgacgggctatagttgaggcccgattgagatgagggttccatatctcaatcgggccctaaaaaaagcccgttacagatgagggtcatctgtgacgggctccaactagaggcccgattgagataagtttagtgcccgtcacagatgacacttttttttacggccttttattaaggcccgatagagattacttgtatgcccgtcacggttgattgttttagggccgttacagatatttgttgcacagtataaataccccccaccacctagtgtaattgtatcccactattcactattttggtgggaggctgtagggggcgattttttgtcctttttccaaggaaaacagaaattaaattcctgtaggtgatcaaaatggatcaatcaagtgagtaatattaatcattaattgagcaatttcatcacgtcttacttttgcaataatgatcttataatatgtgcctctaatttgtttttttttattttgtagcaattgatctaagt

SEQ ID NO: 9101 - DNA, 372 bp, Oryza sativa
cgggggaagtgggggaggacgaggtagggaaccgatttcacgcgctcgtggggcggggtggagcgcgggaggcgcggcgtcgtggggcgaaaccggcagccatagcggtagttggggcgacgggaggttcgggaagaagatgacaggtggggcctcggggcccacctgtcggggagagagggaggggaaaacgggcaagggaggtaaagcatacttgagggagagggagagccgagcgggccgagggaggggaggccggcctgggaaggaggggggaactgggccgagcccgaaagggaggatggggagatttatttggttttctttataactaattgattaaatgatctatgtgctattaaaattatttct

SEQ ID NO: 9102 - DNA, 1501 bp, Oryza sativa
gccaccgcctctgttagatccaccaccgcgagggtaagcccggccgcccatccctttttcccctccaccaccagaacaacctccccaccacgccaccctaccggccacctttttccgcctccggtcgccgttcgccatcaccccggctgccgccgcgacgcgccggccgcatcgcctctctcgccgcgtcacgctcttccccggccgccgctcgtccgacaccttccaccgccgggagcccctccgtgttgttgacccaaggagcgccgccgcctccctccgccggccgctccctccgtcgccgcgcctctcggtgagaaccgcctcccctccccttctctctttcttcccttcgccggccgccttccgtgcttgcgcgcgtcgcgctgccgccgccggtggctgcccggcccgtgtgccgccgccgctttggtcccggtcgccgccgccgccggtctagtgtgcgcgatggccaggccgcgccgcccggctgtccccagccgtccgatcggccttggctgatcttggccgtcggggggcgtgcctgcgtggccggtcgccgccgtggactcggtccacggtgggccggtacccaccttgtgtcgctgacgtgtggggcccgcccctttgtggatgtggtccgcgcctttcccccttgctgacgtcagcagtccccttttcctttgtaaaaataaataataattacgcaataaattggtattaattccagaaattcatttaaaatggctcaaaacttctaaaattcatatctaattcattcaaactccgaattgagccattcaacttgcaaaattcatctaaaattaagctctacatgtttgtttactttttatgtactgtttccttagtttttattagagtttttcctcgttttgcgtgccagcgtgtagaatctgtcgtttcggaagatcgcggtcgcgaggataagagttcagaagatccaagtgaagaagcaaggcaagtcacacattccccttgagcatgtttatcccaatttataaatgttttaccatttgcaaataaatatgcatgttttgctaattacatgggatccgggtattacctatatgtttgcttgtgccatgtttacttgatatatgtcctttgtcaacattgggtaataaatcgactagctcatgttacttatgtgacctagctagaactatatgcttagccgtgcttaattaccactagctcagttgatgggataattacagtattagacctttttagtatcagaatgagctgcgtgctcgagacatctggccatgcttcatggtcgtaattatccaactgaaatgcgactacatggtgggctgtgggtgcatggttttgctagttgcacccatggcaattaaggaccggttcgcgggaaaccctggaagaatttatcgtgcttaccacaagccagcgtgggcaacggctgggcttgtagtgtagctttcctctagctgatgcatccaggcaagggtgggcgtga

SEQ ID NO: 9103 - DNA, 1355 bp, Oryza sativa
agcctccctcgccggagcaggtgggatgggcggaaggcgcagtgatctccgcccagtcggcggcggataacatggcgtcctatgtgctggatctcaggaggggcctggccgtgttcgccgggaccgggcgccccgaggaggcggtgctcaggaagaacgtcgcgtgggccgacgcgcgccgcgcggcgcttgctggagaaggagctcaggtgcatggcggcgagagaccaccccgtcattccggagcttgcggcgctgatcaccgccatgcgcgagtccaccaaatcactggtcctgcaggactccggcgatgatgccgtccgtagccgtaaggccgggttgttggacagcgcgatcaagttcgaggacgccgtggtggggaagatgaccgcgttgaaggagaagctcacgcgtggcgccgccgccttcgtgggggaggaggagatcgtgcaggcgctgaacaagcacgccgcgacggccgaggcggagattgcagaatcacaagcgttctctgcggtcctgttagccgatgccaaccgagcagcaattctcgtcgttgtcgtgcacaagaggccggcgccggagacggagacggagacggaggaggaggaggagccgccacgacagaggcgaggcacaggagatgccggagacagtgccgcacaagactagctatagctagattagcaaactctgtgtttcctgtctcgtgccgatcgatcagctgttgatctacatcttgtaaatctaattagtccatgatcgatctgattttgttaatctacatgtaatatcagaccaatatacaggttgtgtcgtatgcatatactagttagtcatactccgtttttccctatactagtgcagggatgtatcgcactggtataggtagaatccttgagaagagtaacgcggacgaacaaagacgatcgatcgaacagagcaaaaattcaggcacccctgtaaaaagctactaccactagtcagatttgaaaaaaatatcgggggccgggcctgggccgtgccgcccatttggccatctatatacctacatatttgtcgacatatttgtaaggaaaaattatttgatatttcatttcatagatgaatggtagtaattcatctaagttgtctctcaacgatgagaattagaatctaaatatttctcgaatatttgacttagaatactactattactttgtggatatagaaaccggagaaggagaagaagctagctcaggtgcttggcggctagagaccaccctgtcaatccggaggttgcggagctgatcatgcgcaaggtcaccatcaatcctgtcggatttggtgagaaatccgtgtgttcttgagtgttt

SEQ ID NO: 9104 - DNA, 811 bp, Oryza sativa
cctaactgcatttaaagcggtctatgcaaccgcgccatgccgcatttaatgcggcgtgctacgcatctgaccggtctgtgaccggttgaatgacggatgggacggcgactgtgtaccccccaccctatctgtgtgtcaggcggcgagcggcgtgctccatcccgtcccatcataatgatgaggggcttcacagcctcttacctcggtcagagctagtacaaccactctgaactgacccgggttcccgttttctagtgtgaacgagaacccgaaagttctcatccattaaatggcgaatgacaaaggcgccttgcatgatttgaggggccccgcgcagcaaccgacgtgcagatagcttctgggctaaggcacaagacatgtaattaatatagagaatatttttccttctccctagatagcattcgcagcacatgtagtatccccttagagtacaaaaggaggaccatgcctagcgaggaggggggatcggacttagaatccctaagccaaagcttgtctaaccctagcttgcatatcggggattcagggactttctaagtacagaagaaccatacacacaggagtagggtattacgcttcatagaggcccgaacctgtataaaccccttttgtctcatcgtcttgaggggggggctgatcccctcaagatgacttagttttgctctcgaagcctcaaatttcacccgctgcccccggccgaaccaaaaaagggggcctcacagttccctggtggaggagttaaccctccgacatctggcgcgccaggtagggggcgcgttcgtgatttttg

SEQ ID NO: 9105 - DNA, 1501 bp, Oryza sativa
agagccttttgaaacgcattagtgggatatgcacataaaccaaacagatgcaatagcattagttgcaggatggatgtttatgccgatggtctgaattttctttcagaatccgcagctttggggactacatgtccttttctactacgggtattacaacaatgatatagcatatattgcaattcatagcttatacttggttcgttcatgcggatatttggtacttcgtgctaccaattcaccaatcatcaaatgcaatgctagcattgtcctcgcggacttctaaagatgatttagtgagttcaattgttgttcacgtgatcttgctggatcagtcttggcagagacacggtgtctaagagacactggatgtttgctgctttggaagcgcatttatccatatagtaccaaatgggagccgcagatattcctcacaatccagttcagggatgctagaactatatgtggtttatgcactaatttcctgtcggtgcatacttggcacacaaatcttcatgatttaggaaaattatgcatatatgtgccatgatcatacgagttgtaatatttattcttataattctaagaccagaaatggctgaaaatccattgctaaaagggtgtagcccaaatgatcacactttttagagagttcaacggggttgacggacaatagatgcttctataaagtgcacaattgttccataggtaatatgactgtggcgcattctaggccgacaaatttagttgttgctgccagcaacaatcataatattttcagttctatgggtctggaaaatacctctttctcttaaagtgttatttgtggttatgcggaccacaattcattctttttctcttatgtttgggcgctacacataattcaaagcattataactatgtgctagaaaagagcaacaaaatagtaaatgccttaaatatgcaattttataccgaaaataattctctattgcagggaaaatgtgtgctctacttgggcaaggaccatttttcgatgcaatgctctattcaaagattgcaacaagtgatgacgaagtatattgattcaacgaggtatcccggtacttcggattcaattaacttcatagcgagcttcttgctcgatagctatggcaattatttactatcctgacatcaattttagggccgatccgatatagcataggagattcttcgtccatatcaatgcaaataggctagaagctctccccctcaattcatgatgagtgtgctattaggattgtccttttcttttaatgttcatagttctagattgtttcaccttgaccacctatgttctactcccccctttcctcttctttcgttgaggtaagtgtactgggctagctgctcgtgttgaattcgttatcaactgtgctagttggttttggaagacaatgctcttctagtgagtactgtcatgaacattacgcaattccatttatcaactagttaggcatacttcttgtatgtgcaccagtga

SEQ ID NO: 9106 - DNA, 1501 bp, Oryza sativa
taagatttagttacatctagagcttatctacgaatagtacttgcgtttccatattgtataagtgatgaggtagaattcatacacgcgaccttcgagcacattttgaatagaaactagtttcgcttacggcttcgctatcacgacacatatccgtccgatctctatgctacagtctacagaatagatatcccgacgtcgtcaccgtgccgccgatcgaaccttaccgaagaaacgccacgattttttcaccccgtgccacgccacggccacggccacggtcggccactcggttggcgcctccccgacgcacgacgacccgcggttccctcccgtccccggccgcctcctgcctccacgcgcggctccacctccacctcccctcccctcctcgccgcgccgcgccgcccagcaatccaactccgaatcatcctcctcaccccgcgcggcgccgctccgaccgaccaaccaaccaaccgcagcggacgccacgcgaggggaatcgaagcggagacgtaggggcggggggaattcggccgaggggaagcatgagcttggcctcccacgcgcctagccgtcgagctcgaatcgcgtgagataaggggccgcgagcaccgtggtgggagagggagatggcctcgcgggaggacgaccgcgccggccgcggtggcggcggagggcggacggagcaggagcggcggccgtccaaggcgtgggggatcctcatcttcggcctcatcggcgccaccaccgccaccttcgcggtgagcagagcatcccctcttctctgttagtctgttacttttgtgttgattgatagtcgatgacctggttgattgattcaatacgaatacagtcctgtttcaagtgcccagcttactagctttcttgtttagtttcacgccttccgtgatgacatgactgtttccatttagttgttgctttgatgaaatttgctcctgtatctgcaattcggcgtcaaatgctccaattaggctgtttgcatcgtttcatgcccaaggtagtggcaccttcagtgcttctttttaaagataatgcaagtttttattgaacccggtcaattatatcaaggtgatacaactgcactgagaacattcctagcctctgcaaggatttagtggttcttatgcagctccttgtggcaacgaagcatgtggctctttaaacctgttattagtagtaatgctcttggcttcatatgtctctttgctgaccaaagccccaaggtcctaaatgctatcttaagattgcacgagcactgcagatgggtaaaccttgtgctaggcaggtacttactcccatcctcatgtttgcgaggtgggttgctaaggattgttgctattattggaaatcctttcgcatctccgttcaactgtgatatacggttattgtttttgctggaaacaaacccttgttgtaagctattgttacgacttacaagttgcaaagatcacctgtgcttgacctttctgtttcttcttac

SEQ ID NO: 9107 - DNA, 1046 bp, Oryza sativa
acttgtctcagctgacatgatagtggcatttcctctgatggtttaattacctcctttctgatcctggatggaagcctaccgcctgttccagctttctttatgctttcaactacctcttttttacatcccctttgttgtgctaaactcttttgctctttctgattcaagagttttcatgccttttcttactagcaaagaaatggaaacattatgtttgtgattatttatttttgttttaccatatcacttatcaaatatccaagctaactaaaaatccttcagctagctatccagaaatcataccctgttaatttgtatggatgttgaggattttgcattgtgccgtccccaattttcctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggct

SEQ ID NO: 9108 - DNA, 1501 bp, Oryza sativa
cctacgatggaacaactctctaaccgtgtttttcaataattcttacgtgatctttgattccaccaatcaaatatttcatattttatgttctttcctattgtatatgaatgtattaagtggctttttgggaatatctggttataaagggaatggccaaagaccatccggttcatgaaagaaattgaaatttttctcatttcctttttcaagagaagatagccccaaaaatctagtagggatttgttgttctagatctgcagaccgaatttgttgtttggtatatttaccatgtttgctgtgtgtgatatgtagctgagtatctaacgtcaggaatttacttgctgcagaatgcttttagaacaaaagcaatggaggttcaccctgatcaaaatcaagataatagaggtggctaacaactccatgctttttttttcttgattcgtcatatatatgtatcgtgttgttatgtatccacgaataccatgaacatcttatgttgtgcagaggctgcagaagagaggtttaaggaggttgtcaaatcatacgaagcaataaaactggagagaaaaaatgatgcaagttgaatgtgaatatgtagcttcactggagctcattgggaagattgaaaggatcaatgaagacagtatcagcaggccttgcaatcaagtggatgatctgttaggttcggctgtatctgttgatagcctgtaagcacaagtttttatttgcgagtttttttttttgggagcacacggccctgatgtagactaggatattgtcgacaaaggtgcaaaaggaaattgctcatttgtgcttagccactaatttggggtgcaaaatctggactgcgggtgagcatttttgttgtgtacacctgctggtttattttttattagtagaaagtagagtgaagatctgatagaaaataataagtagcccataatattatagcagaaaaacaatgtttattacgacttactcagttactctgttgtgcattagagctgtggttagctcaaaccggtgctgcctatcatctatatgcgttaaatgatgcatggatatgaattcggtttgttacagctgaccctgttgattctgcacagcagatcgcagtatcagactgaaattgtgagtgcaatctagccataaaccaacatgtcactttcgaaatgacaccgtatgatcatactctgatacgtggagagtactccctccgtcctataaaaaatgaatcttcccataaaaaatgaatctgatttatagtaatagaatatattaaatctggtactaagttgttcctataatcatgttgccacgaaaaagaaaaataaaaaatgaaccaaaaagaaaagaaaaatgaaccgggcaagcattctgggcttgcgcagttgcgccacactgccacagtccagcccaccatgcggcgcctcctctccgctccgctgcgccgccgcctatgcacggcggccgtggccgcggcggcgcccgacccggccct

SEQ ID NO: 9109 - DNA, 1501 bp, Oryza sativa
gtagtgtgtcatgcatgcatcgatactaaaggtgggacccatgtcagatatagcacctcgtgagaactgatgcagtgtataaagttggcaaaggtacttattgtgggcctcacataaattaaaataagataaagaaaagtcataatctctctcctacatacaggccaaagacacaatttgtctgacgcgtgggccatgtcatgtgctctttccagtagaatcgggacctatgactagtacccagctcttgcttgagaccggctaaaaaacatatcacagtgtgtggtctatccttttctctctcttctaatgcctcctctaagtgcaacactgcgtatgctcttatctgaaaagcatgacgagtgtgtcctgtcaggaatacatgtgcgacactccaacaaatagctggacagatcacccctttggccatcttatctgaaaagcaatcgtaacgttgttcctttggtcgtatctgatcctattctcccaccatgccacttgtaaaccagatttttgaagagaaagttttggtgccgtttcttcgggacaatgatttgtttcaaaggttacgtatggctaattacatccgaaaagaagaacatggttttcctattaataatagaagttggatgcatccatgcatattacaatcaaaagtataattaattaaatacccaaggtataaccaaatcaatatgctgtcagtaacgagctaagcgagcgaaatttcgttgattaatttagagttaaactgaaaatgagcattctatagagaaaaaccaatatagagagaggtcatgtgatatgttttcgacaaaaatgaatttgcatgtacaagttagtctttccaaattaaataataaatgtacttgactattgactcgatggagatggtctttttctgccacgatcagcaaccagtactacatagacatgtatcactgctgacttatcactgtcagtttaacgtgaacagatagtgatggaatattactgccaattcaaacaagctcctgccaaatcgaaaatgaattggcaataatgctcagtattgctgacggttcaaggcatgatgttttctaaacggctatgatgctgttttctatagcagtgaccccctcatgttgcagaatatatggactggtttggtaaaccatggatcacctgaggatatataacgcacctagagtttagcgtagtgaaaatcaagatgagatcgatcgcctaaaaagctcactgctacaactcagttaagataaggacaacatattataggcatgggtccaagggaacatgtcttcgtggaaggaccaccacatgtcgaagatatttactatagcaacctaaatattacaacgtagagtgacaaacactccaaacagatggcaattctccattaattctcgcatataaatagcaccattgtcgcctgtactaccgtgaagaatcgtattccaacaccagttccaccctctacaaggcgcgtctagctaattaagca

SEQ ID NO: 9110 - DNA, 1353 bp, Oryza sativa
cctgcagccctggtcaatttctcaacctcctagggggtggggtggggggtcgctccaatgattgaagaacaatgttcaacattgttatacttaccctacctattatgtgtgataatccacaatgatttttgacacaatgcgatatacgtctaaagaagtggtccttctaagatcatatgccgccaaaccactattgaatcatcactgagaatagataatagataatttgtggcacaactcaggctattagaagggagctatttacctcagatgcttttggacatctaccatttgcagctgcaaagcaaccaaggtgacatgacaattcctgcaaaaaaaaatgacagaataagcaactgaatatcagagacaggacgcaggaaacaagaaatttcaacagctgttatgtcatccttgttgaattgttgagatgaacctcaacaatctgacccctgcgatagattcaaaagcatatggagtgaaattctttctttgtattttattccatgatattgaataagttggcagattaaccatgatactaagcctgagatgcaattcaaaggtcaaacacgggataaaaaaaaaggaaacttgaaatctgaggctcatcgcccccatgcataccatcctgaatttgaaatgttacagatgacatttgaccataaggatatagcttcatcaaaggcaagtcatgcaatttaatatataccacgtattacttcaaaagcaccctcgaatgacaaatcggacttaattaaattgttcacttaattctatacagggtaacaagttctttcagagatgcttggagcaaccaaaattttatttagtcactccattcttctgggatatgtctatgcacagttgatttatgtgaagtgtctgcaaatcaaaaggcaagaatacccaaaagttagtcactccattatgttgacatatgcaagaggaaaagaagtagaagaacaaaatttgcaggaataagaagcatgtgaatcatgtttgagaaaatttgctggaattatatagatctgtacagttcagttgacaaaaaaaatacaagaaaattatagagcatccaaaatcatgttcactgaagacgcaaaatctccaccttgactgttcactgaagctttatatatccataaccaaacctattgcctaatgcatatgtacatgcaattaacagatcatgaggattttcagagacctgtttgcaacttacatatgtgaagcagcggttgagtagatgacgtcaatacctcatcggtggggttgacggcatcgacttgagcgtggagccgcggatggaggcgttggcggaggcataattgatgacgggggcggcagcga

SEQ ID NO: 9111 - DNA, 1501 bp, Oryza sativa
tgagtgtcgtcccctctctcggtgggcaaggtcctccttttatagttcaaggggttaccacatgcgctgcttctacctactctttcataggagggggacccactttaccttgaccgggccacgatccttgccttcgcccggaagctaagcagcagtccgtccttgagcgggacccagcaccgccccccgcctgacacgggggacagccttgtcattccctcataaatggatgaagactcgtggtggtcctcctctcatggagggaactctgaatgacgcttcgatgggatgggacatacctacctccactccgccagatacagaggcgacgtgggggcacaggcgcccgtccaatcggacgtgaccggcaacaggccggtcacagactggtcacgtccgattgacgtgggttagtcaggcggcaccgcatgtatgcccttaccgcataaacgcggtgaggaacagttggggcgctgtgaattgatggctgttcagcctgggtcccctccctgctcgctccccccaccacatggcagttgggcgagggcctcggggcgaggcagcacgagggcccgaggggcacgacgtggcaccccgaggccccccggccgtttctgcgactcgtgaggtgcgggagtagggccaggctgtggagccacgcggctggatgggaaggtaacttcccctcactttgcatacccccgggcccatatctctgacaaatataatagattttgtttgcttatccattcaagtaatagcaccagcatgatgtttaattatatgaatgtgctagtcatcttaattaatatgcatgttttgaaggctgaacgcctgaacacacatcaacaaagaaaatgtggtaagcaaaagaactggaaaatcagaaaatttacttcaaaatgaactgaattactctgtcaaatactaagttcttgtgttgaactgaattatttttcagctgctagccgcttccatattcttttgcccccatcatcatttaaattgcttgcaaatattgcacaagcgtacgtgttgtttcaaactcttcagggccttgagcccttgagccgccgctggaagacggtctagttgatgtgaataatcatgggatggataaccaagggtcaggggggttctttacaaaaagtaatgtatgtggcgggcgtttttttttttttgtaaaattgctacatccggttggcagcccttggattgagatcgagaggaccccattgcacgagtgcatgtgtgcatgcgatggctcgtgtgcacctgatacgctgccgtgctaagtagctgcttggcgcaatatatatgtaacaatttgagtggtttaggccaactcaatttctggaaccatacttaccttgcaagctttcatatcagcatttcttaaaagtttaaactcggtgaatagtcattgggattcgagcataaggtcatattagtttggatggacacttttctaacttacaatcaatttaagccttcccagagc

SEQ ID NO: 9112 - DNA, 1501 bp, Oryza sativa
agcttcgccctcaagaagccgaaggctccgctccctcttcggctaccatctcgccttcgctgccaccttcctttcgcttagcaactctctccttggcgatcttcttcggtggcatcagtggtttcgctcggagctccccacggtcggcgccagctgttgtcgaatggacaactgcgtcacgtcgaaaggcgtggatttctcaacaatagttggaagttaaaacaattgtattgcttagtaaaaatttttggatccccctattacatggccttagggagctatttatagccctattacaggttcccctttagggtttaggttttacagaggaatttacatggctacccttatgatagggatattattgggggcacacggtgtccttgtatgggccactattgggctaaatggctcggcctatttatttggcgaagtcctccgaaagcacaacggcccgctaggcctccttacggtggggttcggtacttggcgaagcccgtgccttcgtgccaaggctttcgcctcaccgtcttcgcccgtgcggccttctgacgaggcctttgcctggcgaagtccgcgtattccgagccacggctttcgccatgtggctttcgcccatatggttcttttctcgacctttgccgcttgcctccggtctgagcctttcacctatgttcttggtttcggtaggtccggccgaaggcccttcgtggtgtacctccaacaccatgcatcatgtccacggtaacaggtaatccctgggtcaaaagagatggtcattttcgggatcaatgtggtacagcctttcctaacagttggcataatctcaggtcatctactttcataatttcattgtcttctgctacatctcctgaataaaaatggggtcatatgcttaactccataaacatcacagaggatagagaaaaacttaaacaaaaggttggtctcaagctagacagatgcacatattgtcatgaaattggggtcacggggacgtaagtttcttgcctacagctagctatatttgtttttatggctgctcttctgatttcattagatatttagatgcatgtaaaattttgctcttatttcaaatagtatatttatttaatttcaagaaatggaatatactaaacagcaccatttcccatagactgatgcacaagaaaacaatcaatcctggtcgcttcttgaggattcttaatttttatttgtttccaacagggaattgttaagtaaaaaatagcaattttattgtgaagaacagaagaatggtgtcttatgaactagattagagccaactggaagttagtagaaaaccatcatattcgttctttttcatgatatgaagtacactaattttgtctggtttactgtcatttacaaatttcttaaacattacacagaaataaaacaacaatgtcttaactcacatgggatggacatggactccataaaatttattagaatttgaaatacaaagcattattaatcccta

SEQ ID NO: 9113 - DNA, 1501 bp, Oryza sativa
gaatggagagtcacgcattaaatccgagaaagtcattaagaagataggttgttggattgaaatatgcctatcaaaaataaatttttcagatttggaaatatgactatcaaaattagatgcagggattataagttaataattactccctccgtcccaaaatataaaaatctagtactggataggatatttcctagtacaacgaatctggtattaggaaatgtcccatcatattataggttcttatattttgggatggagggagtagataatttggttgtgttctagtatcaagttttcaacctctgtttttttttcacgtgtatgcttcccgaactgctaaatggtgtgtatatttttaaaaatccataagaaagttgctgtaaaaaaatcatattaatctattttttaaaaataacatacttatttaatcatatgttaataatcgatcccgttttccatacgcaggttctcaaactcttctaccgaaaaagccttagtacatattgtacacttcgataattcttgctcaccactatatgtatatatatgtgactgttagaaacttagaataattagtgacgccacacaggtagttgccgtagtggagcggatgtgaattgtattatccgtgcggatgaaaaaggaagcattgaagcaagatgatggccagcagaaccggttggtttatttgccacgtaggacgatctgtctgacaccacttgcaagtgtgtgtgacgtgcagccttccacaaacgtacagtgccagcagctagcaaacaagtaaccaaggaacactgagacccggctgttcacactagctggctcggtcactataaaacttactcctatatcgcacgtgcgagctagctatttgttgcttcttttttttttttgcttcgatcgacatggtagatcgaggtagcgctggattcaattttattatcgaaaaaaaactagcttcattctgagtacgcaccatatatatatatttcaaatacacctactcacacgcgcgcacatccatataagtatgtcataacacacgtctaaataagattaaagacctgatatcatgtactccctctatattaaaaaaaaactttattatgtcgagattcaaacctagaattagattttttttcggacggaagaagtagcacacaagcatgcacgcgctttaatggttgaacatactaccatatctcaaaatgtacaaatttattctactcactccatttctacatatgattatttctgagttgtttaaaaaaatataaacatttatatattgttttattttttttcctcttcagctatcttattggttaatttttaaatcgcttgcatttcactccaaccatttgatatgttggaatgcttagatttccatgtgatggatttagtattaaaaaatgtttatattttgtacaaaatttgaatactttaaatgtttagatttccatgtattggaattagtataaaaaatccttatattgtgtaa

SEQ ID NO: 9114 - DNA, 207 bp, Oryza sativa
cgggaggggaggggagaggtgaaggggaggggagaggagggtgaaggggagaggtaaggacacttagaaaaatatcaactgatgtgtcatatatatataccacgctaatttttgcaggcgcacctcatgtggtccgtctacgaaaatcattttcgtaggcacgcccgatttatatttttgtaggtggctgtttggctctaagggtca

SEQ ID NO: 9115 - DNA, 1501 bp, Oryza sativa
tcgagaaggaaggctaccctattgtcaactatgagtcagcacttcagaccaccaagtcgacaacagatagataggctaccccaaatattggactgatgtgattatggtgaataagagcaacgaccgggcttcacaatttaggggcccgaacctatataaaaatcctcgtccccatattttatattacaatctcgcatatatcctagtaccaacgatccccatactatgcaaataccgaaatcgtggtatcaaacgtcgacattttataaacttgatcaaatttgaataaatttgactagaaaaaaagtcaaacgacttacaatataaaacgaagagagtatttagctttgcatcttttctcaaaactatttatctttacatggtcatatgtaacaacatacgggatatcctgctgcatagtagtagtagtttactgactgtttcaagaagtttatccttttcctcctcgatttttattcttagggctctttgaattggaagaaaaatataggaattttaggggatttcaatcctataaaaaaattttctatcctttaaaattcctatggaatggacaatcctatagagattttagaggaaatttagcaagagcttcaacctcttggttaatttcctttgagtctatctctctcatccaatttctgtgtttttcctgcggttcaatcaaacggtttttcctatattttacaataatctattttacgcttatatttctatcaaaatcatatgtgtcccttaattcgattaccaaaaactcatctttcgaactcactaatcccaattcccacgcaacattgtccccgcggagtccacagagaaaaaaaaaagttaacgacggaccaaagccgcccgcccataccattcaccttcatctcaccttcccttctctccacgcatctcctctctcctctcctctcctctcctctccccggcgaagccaccgccgaccatctcccgccgcctccccaccccaccccacgcgcgcccgcgccccggcgagcactcccggaggcgcgccgagggtggcctcctcctcttcctcctcctcctcttcctcttcccgacctccccctcctcgcgcgcatggccggcggcgagagaacgctcggagcgacgacgcggccgcgcccctcccgacgccccccgtcgcctcccggctcgaattgaaggtattcgttagccgtctctctcttccctccccgctccgcatcgtgacccccccggcgtggtggtggcagccccagcggtgggggtgtagattagggatccgttcgaatttaggttgagtaaatttccctccaattaacgctggaatttcttcctctttttttttttgatgcgtggtgcagtgctaacagcaagcagtttggtttgaaagcaaatttgggggattattatttttttggtgggaaatttgagtagggatctgtaatagcggaaaaaggaggagcttcggtggtgaattgagggggtttctcca

SEQ ID NO: 9116 - DNA, 1501 bp, Oryza sativa
aagttgagggcaaactcttaccgaggcgattttggtgtgacggagatgtggagggcaaggtgcgggagtgtcttagcgatcatcgatgacattttagtagttagagacttagaggcagggcctatgtgcgaagagagatagagatagagagatgggggacttgacatgtggacctagggtatttcaaagaattcacatgatttctctcttcaatttaaccgaaaataaatattctaatggacgcggtgtccatgatctaattttcatgtttacagagtgttttctccccaaagtcacttcatgtagtgttctacagctaaaaccgtgaagtcatgatgtcctgttgttaacagtgaaatttggtaaagcccgaagacatcatcggctgagagtcagtgtcggcttccgagttctagagacagccaatggtagtcattaagtcgccatgctgtcgtgttcctggtggaatcggatcagtcaaaggaagcttatctagaagagtccaagttcaaggaggatgtggcatggtagtttatctattaattaggcatagtttgttagtttccttttatctttaggaaaatgtgtttagtgtccgatagggactttatcttttccttttatctttagtttctttcttgtccgacaaggactagtatctacccatgggtataaatatgtacacccggggtctatgtaatctatcaatctcgatcaatacaactactctcggcgcatcgccaccctctttcctgaggtttttacttatcaaccggcggaacttggcacctgacgcggggctgcatcggctttcgatctccggcgaaggggtaagtcctacgttccgccggccttggtgaatctatcggctatgttggtgttgaggctgcatcgcttcgatctcttggatcgctctggtttctttgatatatttgcctacctgatatctcaattctatctctagttgcattgtgtttagagacgcatcggtttagttgggactgtctcggttaggtccgatcttctgtcttagtcgatatatctctacaatcataatgatgttataaatagatttgttatatccatcacattagacagatctatcggctcatcgagtattagattatcatatacaatctcgtgctacatcggttaggttcgacctactagattgttgttgataatataagtcttgttaagccgataggttcatgctaatgttttatcagggtgctagccgataagttatctggatttagccgatgacaacaaaggtttcactgtttaacctaatctgtggattttatggcatcggacctccagccgatgcatgctttaaccctcggatcaatgcttattatatcatatcacattgctagctgattggtttatactggattatgttgttggtatattttattatcatcagccaattgcctttatattattatctacattggacatatagccgattgctcaaaaccctatcactatcgctagt

SEQ ID NO: 9117 - DNA, 1501 bp, Oryza sativa
tggagagcttgctcccgcgccgccgccgctcgtcacggtgccctgtcccgacgcggtagccctccgttcctcttcctcgctcgccctcctcctcctttaactcgcgtggttcgtaggcgccgccccaagccccgctgccgctcgccatggccttgccgccgtcggcgcccgctcccggaggccgcctctcgtcgccggacctccacggcgtcgctctaccccatccaacgccggaaatgaactccttgaaccccggagatgctcccatccttttgaatcgaacccccgttgctccggtgaagtttccccccttttcgcgccgccggcgtgcgccgccacgattcgtcgtcgctggcctccctccggcgaatccgacccggtggctcacttcctcttgtccgtcccatcgttccggtgtactccctctctctcgaatcgtcacgacgagctccggtgaacttggccgccgtccgccgtccatctcggcctccccttcttcctcctcccgccggcccgcgtggctgccacgtaggcgccacgtcggcgccacctcggctttgaccgggccaagccggtcagccgccccctccctccgtcttccctcccgtgcgcgcggtccacggcaagccgtgcggctgcacgtgggcccgccaccatccgtccacccggcgcgccgcgcccgaaccacgcgcacccgaaaccctagcgcccgtccccgtgtgcgccgcttccaccgtgcaccgcctcaccgacaagcgggcccgctcgggaccccgcgaggtgagcccggtccacccggctccccttccccctctctctccccacgcccctctcttgggccgcctctccgtagcccgcgccggcccaataagctcggccgagccgcgcaaatcctctcgggccgcgccaagccgctcggtaaaatctgattcctatccctccttccttttcttatccaaagggattaataaatccttttccctttttcataaatcaattccttattcccaaaattccatgaatcatttcctttgctcccgcacgtcagtgaatgtcaataatattcttgagaatattatttctataaattccataaaccatttctcgtattccagaaaattccgataaatcatttccttgtccagaaaatccaattaaacttccaaaattcgtatctcccgatccgtagctccgattgattccgttccacatccagtaattccgtaaaattgagatctatttaatggcactattaattagcctaataggatctttcttttggtcttttgtttaggtttttgattgtttgcgtatagttgcggttaccggattttcgtcgatcgcgggttttctcgaagattcgtgaagcttcgcgaagaccttgagcaaggcaagtcaccctttgatcaattgctcctataattggaaaatcattattattttgtttgcaacttgcattattagagtcacacacatataacatgcttggcctcggtttgcg

SEQ ID NO: 9118 - DNA, 1501 bp, Oryza sativa
attttctcggactcccagagtccagctgcccagcagcaaagcaatccgcttccactcgggaagcctagtctatgatgcccacagacatcccgaatcacacagattcgtttctgactactcaggtcatccatctgccacgtaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcagaggttcgcaacaaagcctttcccaagccgacccagggttacctcatgccacatagaaggatcaattcctcacataaatataggccattttagttttcacaaatcaaactccaaccacctcgatcggtaatctggcaagcttcgtgttcttgccttaccaggaacccgggttggctccaaccgaccccgccccggcgttccccaactattggcatgcgaggtttccctgaaccgactagttacttagccagggtgtcccattccaccttgtggttgcactttgattatgcttgatgagtttcccacaggaatcggtccttatatgcgaatacgggacagcgccacgcaggcaccacccccgcatcgcgagttttcacaattcattttatttttaaacacaccgacaccacatgtcgggttttgaaggcttcacaaacccatttcccaatttttcgacaatcaacggtgtatgtgggacaattggtatacacgctcaaagagcacggataccaaagtaccacaagggtggagcgacaaggaatcagggtagtacagcctacaggaattagtgcgactactgggtaggtccgtcggtttggcacgcaaaccgaggccaagcatgttatatgtgtgtgactctaataatgcaagttgcaaacaaaataataatgattttccaattataggagcaattgatcaaagggtgacttgccttgctcaaggtcttcgcgaagcttcacgaatcttcgagaaaacccgcgatcgacgaaaatccggtaaccgcaactatacgcaaacaatcaaaaacctaaacaaaagaccaaaagaaagatcctattaggctaattaatagtgccattaaatagatctcaattttacggaattactggatgtggaacggaatcaatcggagctacggatcgggagatacgaattttggaagtttaattggattttctggacaaggaaatgatttatcggaattttctggaatacgagaaatggtttatggaatttatagaaataatattctcaagaatattattgacattcactgacgtgcgggagcaaaggaaatgattcatggaattttgggaataaggaattgatttatgaaaaagggaaaaggatttattaatccctttggataagaaaaggaaggaggga

SEQ ID NO: 9119 - DNA, 1501 bp, Oryza sativa
cgaaatacatgccaatttttctcgtaaaaatatcttgtatatatctgataataatctgaagcgggaccttttaaatagatctaatctaatggtttaaaataacggacccataaatttaagtgaaaaccgacggttagattgaaattgccacgtgtcggtttaggagcgtttgtaggagcgccacgtggcagtttaggagcatttgtaagaagtttaatggacttttagtatataatagattatgaatgatttgcagcccatagttggctacactattaaacttgctctaatgagcggtctcacttggaataaattctctacatccatctaaatgtcctatatatatacctttttttataccaaccagaaaaaaaatgtctggatcactatacattaaacttcttaattttggtttggtttttttttgtgttatttgatgactctggatgttatttgccacaattgggtttttaatcgatatttgattttgggatttgtccgctgtacgtgattaggattttgatttgatctctaattttttttccctttgggcggcgtatgtgacgaacacatcacgcgtgcggggacgcaggtcgtcgctcggtcggacttacagatgatttttttatggttcttcggtttgggattagactattcgagattgcctaccttttatgcgacccccatgggagagagacgaggaagggagagaagaagaaaaagggagggggtgatgagtgatgacgcgttcccattcaggggcgggcccacttcaattcatgggtattcaaatgaatacccaagatttttgaaaaaaaaatgcatatatgaagtatatattccatatgtatatataggaaaaaaggaaaaatgcttatacccattcaaaactcaaaagaagcccaaactgaaccctcccaccacccactatttcaggcccattggcccaatagcaaagaaaagcccactacctctctaaccctatctcttctcctcaccttccttcccatcccaggtgccacgcccatgcctgcacgccagctgtcgccagccctccaggcttacacacgcgccgtcgccgtgctagctcagccgcctgcatgcgcgcgcctcgccgtcgcctaactcgttgcccagccgcctgtgcatgcgcgcctcgcagtcgccggtcgcggcgtcgccccgccggtcgcccacaggccacagccccctcgccggctcgctgcctccgcgcctcgcgcctagccagcgcggcggcgccccgcgcccggcggccgcctgcgcgcctcgccgcctcccgtcctcgagacctcggcaatagtcagcaagatagcaagcggttgcaacggtgagtcgccgagtcggtgaactgaagtgtgttgattattttagcttcattgtttgtgaatgactaactagattaggatttaggaaccactgaaccagtgctgctttgctcaattgctctttgatattgttgtttgtaggtttgaaacatgaa

SEQ ID NO: 9120 - DNA, 1501 bp, Oryza sativa
ccgtaatcagtgccccggagatgtaggctacggctgaactccgttaccaaatatcgtgtctcggtgtcgtcatcgttttggatctcctatggcgttttcttccgcgtttagctaccgatgttgatttcggggctggttttgtaacaagtggtttcagagtctgcaggaggtccatggtagaggcgcgatagaggtgctccacacctcgtagcctgctgtaatgcccagggaggggcattggcgcaaggtggagcacgccggcgatcaacggagtcttgattggtggatcgaacacttctggcggcggccggaaccgtcgatggctgctttcaacagggagatgactagacgtggtgctcgggatgatggcggcggaagcgattggcaaatcaatcggtgggtcggacacttcgggcgggtggctcggactttccggtgagctactctcgacagggagacatgcggccacacgctcgggttgattgaagctggaggcgatcggcgttcttgatcagtggattcgaacactctgggcggggtggcccgggcctttcgatgagttgcgttcgacagggagacgtctagacgtagcgctcgggtcgttcagcggctgggaagacagcatgcgacttgtcggcttcggctcgcgactagattgatggcgatcaatcggaagtcggagcaggtggatcctataggctgttttggaggtgttgacgaggtatttgcacgatggaattgcttcaaaggcggcgtattttgtggcatatggctgaacaaagcctagggcgaatagaccggcatccagtagcggttcaaccctggagaggcattggttcaacctgtttttccctctagcagacaagaagaaaaccacacgggctgtagatcaatgacaacagttgttggtggagtcatcggtggtgcttggcattggtgctagatgttgtcagagatatgaagaagcccaggaggttagggtcacggcggtgtgcgcgtcctgcgtcaaagccgagccggcgacagagatcagggcgatgccgaggagctggctagggtttagctaggtcgtgcagggttcggtcttaagggtttgtggtgtggaagacacggacatggaatcgtctccggttcgggcatggcacggacacaattgaagacaaacagtggataccaagtttcaacacgaaggggaatcggacgaggacttcgattcgttcaggaatcagactcaatttttcccagataaaagtagcagaggaccatgggattgcaacaacgcaatcgaaacaaatcacctagcagagggcgagagtcgtacccgattttcgcagaggcggaggtggtttgggcggcgaggtcacgggcagctggagacacgtcattgcaggtggcgcgcggcggcgtggtactcggcggcattcgtcggagctcgggcaggagcttgcggcagcggctgcggtggttcccggcgaggaaccggcgcaggtcttcggtggag

SEQ ID NO: 9121 - DNA, 1501 bp, Oryza sativa
gtggttggggcgttgctcgaccaccatgaatgcggtctgaccttgcgccgaacctccgtccaacgcccacccgcatccacgtcctcttcctcggatgtcggctgcctggcgacaacctgatcactccacgacaacctcctcaaatgcgacatgttggctcgagcgagacaggggaagtggccgccggcgccggagtggccgctgcggccggagtgaccactggcacactttcactctctcacactctcatccctcagtcgaactcatttacttccacatggggacatttttgtcctcacattataaaaacctctttgcaagtagcgtaccacgttcctcgatcctaatccttgaacccattgatctgggaactttgtgactatgccaaatcctctaaatcaaacatgccacgtggaagtttaacaccaggtaagaagtgacaatccttcgaaatctaaaagtgcagttgcagagatagcataaaaaaaaagacaaattaagcagtaacaatcgctaactcctgctcagtatagggcaacaacaatgtatatagcaaaagtagtccatatagatgggacccacacatatagactataactattgttatcttcacaatgtatatggatagcaactagtattaggaggagagaggaaatagagataaataacatattttatcctctatgggcagcccatatgcttatgggtggcttttgctattttcttgctatgtactagttccacaatgttgttaggtggttgaatagaatattttattgcttatggactggttttatactacattgtggatggccaatgtcatgtaccttatagcaaaatcagttggagagagtagctatatttatggcgctatatttttttttcactaaaaaataatcggtatatatttatattgtaagttcttaaattacatatacaatttcattgtatttacaatgtaactctaaatattacatatgtaagtcctaaaattacatatgtaaatcctaaaattacatactaattacatatgtaagtgacgtgcaagtgggttttactacgtaagtggtgtgtaagtatgatgtgtataaattcgtatgaatatataaataactgtctacctagctagctttaattagctagccagcttaacgctgctcctgcacgatttgcagatcagaggatcaagttgctgaaaaaaaaatgattttagctaaaccgaaatctacacacaaggagtactgcagcatcacctgctttttgggtagtgacggatccaccatggggtctctaaaccccactaaccatattgtaaccatgggagatcccatgaagacctcactattttttttttgtcatacatctattagaagaggggttataattttgtatagtttgttcagaccctcctgttaatcttttctagatccgctcctgcttttctgggtaaagtttcagaaaccaacaattaccattgctagagtacacgaacactaatcta

SEQ ID NO: 9122 - DNA, 1501 bp, Oryza sativa
aaaatttaatgtactacctccgtcccaaaataagtgcagtcgtggatatccgtacccaacgtttgaccgtccatcttatttgaaaaatttgtgaaaaatttgaaaatatttagtcacacataaagtactatttatgttttatcatctaatagcaataaaaatactaatcataaaaaattttcaaataaatttaatgtactacctccgtcccaaaataagtgcagtcgtggatatccgtacccaacgtttgaccgtccatcttatttgaaaaaattgtgaaaaatttgaaaatatttagtcacacataaagtactatttatgttttatcatctaatagcaataaaaatactaatcataaaaatttttcaaataagatgaatgatcaaacgttgaatgtgaatagtgtaaaactgcagttattttgggacggggggagtactagctagtctgttgacaacaaagagatagatatgacttgtcttttttccatcgatccttcaattctcttttcgatcgagagaatacatccagctggtgctggacatgagcaaaatttgtactgcttgtatatgggaaaaatatctgctagagacgaattagtagtacttaaggtacacatgctcgtcttcatttaatctgcatatgatgcttcggtgtttgttgttttttctgcatctaaaatccaaatatagaacatatgcaccattgtttgatgaatacataagatataagatagtcatggtcatatccgagctagtcgtgtcctcattactttatttgatgtgtatttgtgttgtggccattttccatgaaaaaaataaactatccttcacatatacatttgtatgctgcgaaaatatgtgaaaaataaattgatttatattagtgaaaaaataatcaaattgatttttccccatcacatttcatcttatagctttaattttgaggcagtaatcgacacattcatttacagaatgataatgaaaaggtcgatatcctagctatctaatgcccaaatgtgtgtcctgaaatatagcgtaatcatagggtgatttgcgatgttcatacatatatacataatttttttagaaaaataatttttggttcaactatatatatccaatagtctggtatatatagttgctttacttttggtcttccatggaggaggattttgattaaacggttgggtgggttaggttggattcaacccatttttcagtgtgtttagtttggggacatgtgggataggatggtccctgacagggaatattcctcgaagatcgggttggtattgtccctcaaaaatcggcataccaatccaacccacttttttctctcgctgacatgtgggtcattccttcaaaagttggatcatcccatcccctcttccaaacagataggatcatcccatcctaaaaacagggatgagtctaacccatcgcaccttgtccccaaactaaacgcatcccctacccctgtagctgttcgatccttttta

SEQ ID NO: 9123 - DNA, 1501 bp, Oryza sativa
gtcggtcatacgtatcaaaaggctggtcaaacaagcgatataggcagtcaaaccattttgaggcatagccagaccgatgttagtccacatttaataagtcggcttagactataggagttttgaattagatcaatgtatagttagaattgctagtcagaccaggtgtcgtaggctcactactgcattgcgaagggcatagtgtaaatatatttgcatgattgataaacttactatctacggtgttaatattaatgccatgccactaaacactagaggtgcaaatcgacaacctcaagagtatttctagtgaaaataaggcaaactcttctgatccttattaagggtatgtccccctacaaccatctccgttcatcgcccttcgcgagattcatgccattcatcccacacctcaaaggtattccattttattttgctattccactcattttctaacgcccgtatatggaacaaaatgtcatttcatttggcccacgtatgtaccaaaactatattattcaatggattcagctctgatcctctacaagtgcttttctcctcctctcaattaatacagatcgaagtctccaggccacattgctctctgtccacacctaagcattttcactttcctcttaggatccatggcgatgcagagttcatcttcttcctccatcaaccgaaatactccatgtagtgctgtcctcccctcttctgatggtcttccccccacagctcaagtgcgcctgtggtcacccgattagatccttcacatcacatacaccctggaatcctggcaggtgttttctcaaatgtgtaaaacatgttcactatcatcatttttgcatcgcaggcaaatccccctagcatgcatttgttgcttacaggactttgaccagcagggtggatgcaaagtttggatttgggaagatctccttcatgaatatgtcggatgatatggttgggtactgcaacaatggcgccacacattgccacgatgaagccattagtcttctaaagtacgagttggaagagaagacaaccagatgcaacagattgaagaagataataagaagtgccatgcatagcttgaagagtacgttgctaatataaattgaaggtcaatgaagacatccgaagggaccttaaagaatcggacaacttgttaatctccaaaaaggatcagacaactatgggggtagggggatatccccttaggggaagtgagcaactatatatatcagactattcgaggggttgaactgaaaattatttttctaaaaatattatgtatatatatgtcgacgtttgaggtcacgactatggtttttgaatggtatggagatcgttggtaccagagtatatgcgagattgaggtaaaaaagatggagaaaatgatttttatacaggtttgggccccttatctgacaggtaatagccctactcctgttggccgtagccgatgttgctctttattcatctagatcacacaagtacaatattt

SEQ ID NO: 9124 - DNA, 1501 bp, Oryza sativa
cgcctcatccaacttctcatccaaaccatcttctaaggaatcgaagcccgtgcacaattcagccaagatgctgctagagttacccctgttacggaacccacccctccaaccccagtcagatcctccacggcgattctcaagcccatcatccaagccactcagcatcctcttctcaaattcttccacgctctctcccacccctgcgccggataagccaaccaaaacaagcataagaacactagtactattgggacatcttttttaggcatcaactcctcaaacaatcactagtactgtcatcgcaattgggattttgcacgcgaaagctctacatcaacagcctcatcttttcgcttatgcatatgcatatccgaatcgcttattgtcaacaaaaacataatttatgagtacaacttttatatatgtgttctagctattcaaaagcaaatgctataaaaaaactacaacgaaaaaaaacacaaaatcaactctaaaattaaatttaaaaattaaaaattggcttataagcagcatatgtggctgcaaatctgcgttaaacctacatctccagccactcgattcaacccgatggataactacaacgaaaaatggcgaaggtgtgggcaagcacgaacaactccatccaggtcaggattcgacacaacttatattagggaatatcgcatggagggatccgttcgagaggaattctcgatcaggaggaggaggcggcagggggggggggggttctcaccgtcaccgccaccggacaggaaggagcggcggaaggtcgcggcggcggcggcggaggcgggggacgggggaggggggctcgaagggaggaggcgtcggagggatcgcctcagcgccgagctcgccatctcgccgcgaggtggtgcgccgcgccgccacccgagacaccagcgagaggaggaggaggaggaggtggggactggggagcgggtgatttaggggtttgggatcttttgcgtttgggaccctggagaatctccttattttgtgcggttttgagttgctggttttttttttttgaagtattgagttgctggttctgcttgtacttgttcgcgctcctccctctccggtcacattacgaggttcatcgcttagtctaataaattaaaatttataatttaaaattttgaaaagttgatttttaagatatttttaacggtagcgttggcttttaagtcgctataaacaaatatatgaaacttttacctataaattagtttttattccctaataaaccgttttggtttattagaaaatatgagcaaccaataagactcttttttcctttattttcctagcagactcatcattttgctcacctgctctgtgttgaataatgaattttttactgatatcaattttgtttacaaaatatcttcaaattataaatcatgtaaatttaatccatttgttaaagaaaatattccctccaatctttaatatctgttgttaggataaacaactt

SEQ ID NO: 9125 - DNA, 1501 bp, Oryza sativa
agatggtaggtacatggattatgagggataccgtaccatattcacccggtgacccggcgctggggaaacccaaggggttagacacacacgcaaccaatctccacatacgtgctcacgagctattccaacgctgtgctacacatacccatatagatctaatcgacaccaactggactgatgccgccaagcagggacaaggagcgatggcatggagcacgctccccatctccccctgatgccttccaccactccatcatcgtctctaatgttagaatcgtgccatgaacaaggaggtgctcaggcctacagctcctcgtcggggcaccgcttgaagtggaaggcctacgcctttagttgccattgtcctcctgctctcgcctgccactaagaaaacgagggagagagagtgggatagggaaggaaggagggagagtgaggggagtaggactgatgggtcctacacttttttattttctttgaagtctgggattccacgtggacatcgcatcagcaaatactactaccaatactgccatgggagtcagattgcaacggtttctatatatatatatatatatgtatatatatatgtatgtatgtatatgtatatatatgtatgtatatgtgtatatgtatctatatgtatatatatgtatgtatatgtatatatgtatatatatatatatgtatgtatatatatatatatatatatatatatatatagtaaatttgtttggtgctccatggtgcccgggcaccattgttgaaattgagtatatacccaattcaaatgagtatgaaactttttcaattacttaggtatatatatatatatatatatgtatatatatatatatgtatatatatatatatatatatgtatatatatatatatatatgtatatatatgtatgtatatatatgtatatatatatatatgtatgtatatatatgtatatatatatatatgtatgtatatatatgtatgtatatatatatgtatatatatatgtatgtatatatatatgtatatatatatgtatatatatatgtatatatatatgtatgtatatatgtatgtatatatatatactatatacatatacactgtggacactgtagtggtgaaactgtattggtaattagtgtaattatacaagcaatataaatagaatacactaattagcatacactgtccacactatacactaacactaacactatataaataattagtgtatatacaatatacactaattatttttaagcgtaattatttaaatagcattgctgtatttagacgaggtaattagtgtatagcttcagacaatatacactgtccacacttatgcttcagatagtatacactgttcaaaaacactatttattcggctgaatactattcagtttactattcaaaaacactattcagtttactgtttaaattactgttcaatactgttcacttcgagagatattttaactttaggatctttgcagg

SEQ ID NO: 9126 - DNA, 1501 bp, Oryza sativa
taaaaggaggggtttgctcagctgagaagaacaacgaagacaccattcagagcaaagcttccaagcgtgctctcaccctccattccaccgttcttagtagtagtgactttagcctaccttgcatagtatattgaagcaaggaggtgtgttataacgctgtgtaaggtaagaacagcttgcttgtacctaccttcgggtttcccgaaagtgaaaaccgtatgtaagcttatctgtttaatatgaagtaattttccttaagtattcctgcacgtttgttctagacaagtgtttatgctaaggaccctataggagaaacctcttcggtttgttctcgtttttagcctgcatcttgcataggcgtctggagaatcggtatacgtagagaagtgttcccttcgggtggaactgcctagggagacgataaactcttagctagaacaagtgtggcttggaatatctttttaagttgcttctaaaaagacagataggtgaggcatacggtgagtaccgagtaggactttacatcatctgaagcaagcttctgaggctgtctaaataggattcgccaccctgcaaagatcctaaagttaaaatatctctcgaagtgaacagtattgaacagtaatttaaacagtaaactgaatagtgtttttgaatagtaaactgaatagtattcagccgaataaatagtgtttttgaacagtgtatactatctgaagcataagtgtggacagtgtatattgtctgaagctatacactaattacctcgtctaaatacagcaatgctatttaaataattacgcttaaaaataattagtgtatattgtatatacactaattatttatatagtgttagtgttagtgtatagtgtggacagtgtatgctaattagtgtattctatttatattgcttgtataattacactaattaccaatacagtttcaccactacagtgtccacagtgtatatgtatatagtatatatatatacatacatatatacatacatatatatatacatatatatatacatatatatatacatatatatatacatacatatatatatacatatatatatacatacatatatatacatacatatatatatatatacatatatatacatacatatatatatatatacatatatatacatacatatatatacatatatatatatatatatacatatatatatatatatatatacatatatatatatatacatatatatatatatatatatacctaagtaattgaaaaagtttcatactcatttgaattgggtatatactcaatttcaacaatggtgcccgggcaccatggagcaccaaacaaatttactatatatatatatatatatatatatatatatacatacatatatatatatatacatatatacatatacatacatatatatacatatagatacatatacacatatacatacatatatatacatatacatacatacatatatatatacatatatata

SEQ ID NO: 9127 - DNA, 1501 bp, Oryza sativa
ttgattttgcgtgtgttgcgtgaaggcggcggctcggtttatatagagataggtcgcttgatcagggcgccgcacgatctccactccgcataaccgaaccggataagtgaattttcctgcagcaaaacaaaaatgcaaaaggaggttgcatctgcgcaagggtgaggagccaattttgcggaccattcgacacgtacgtcgtgcaagggtgaggagccaattttgcggaccattcgacacgtacgtcgtgcacacgcgccgcatgcctgaggcgagcttgtgttccccctcttctctccaccacaacatgcttcgagtggctaggaggtcattctcccttttaaggaggtccccctctcctagaataagcaaggtggtactaaactccacatgcatgccatcccatgaggtgggcttttgtgattttctaaagaattaatcttcgaatgggccttagcccatctattaattccaacaccaatcacaacgctccaccatttactttccccatctacctccactactcatttaatcacaaccctccaccactcacttttacctactacttcttaataaccgtgtccaaccgtaaaattttttatattctaggataaccgtgtccaaccgtaaaattttttatattctaggacagatgtagtacttactttttatttgctgattcttcaacatcagcaggcagggtgttattggacatctacgtacctgtaattcttagtttcatccgagcttccgattttgtcatttagcaattctgaaagtagttttcttttcccacttttttcctgcacgcgcgaaaggattacacgttaatatattaggttttgtttccccgcttagtggaaatgccaaaggtagaacacgggccattgttttcccagataactccacagaaattctctcagaagttatagtacttggatttggacagctcaacttcaaagtacgtgaggtgaattagagatctcgtcagatagctccaaagcgattttatgcctccctgactgacctatcacgcacggtagttcacttcagcagaggagagaggcgcccacacgcacggggcttgttttctccccattctaggctagctacttgcatgcggcgagacggcatgcacggcgctggtcctcgatccaccacagtcgcctttggttctttctcctgcgcatatatacggggtgcatgtgcatgtgagcaaaacatgcgtcgatagacagcatcatttcaacatcaattcttggcctcctgtcctgtgtgtatatatatgcggctgtggtgtttgttgttttttctttaattcaaacaaaaattgcgcaagctgaattaatccaagacaattttaatctttttcggtgagattgattggatagagctcctaccaatccactttcttgtttggcgtttcatgcagtcttaaatattcagagttcttcacgacccaaaaacaaacaaaaaaaaagaacttttcatgtggccatcg

SEQ ID NO: 9128 - DNA, 1501 bp, Oryza sativa
actgtttgtgtttctcagtctcacactggcctattttcatttttcaattctcaatcagagaaatggacaataacctttgaaagcatgacatgtacagaattcagttatgtgtctaaatcaccaccttttatattaggtatgctcttgatccatgttcagaaacagcatgaaaggtacgtagtatacatctttggtcccagcctcccaagaatccacaagcataagaatcttggaagaatattttattgctatatatatactgccacatttttatcaatattttgaccatcgaattcctactagctttcccccacaatattttatctgagctgtctcagtttctggtacaacttctgttccaaattacttatcattctagatttgtcataaatcaaacattttagtctttaaccatcaattcacattataaactcagatagtttattatcataagagatatattttttttagattcaccatgagaaataattttataatatatgattcacatgttgttagatcacataaatatcttaaaaaatagagatcaaagatatatatgtttgacttagaataaatctaaataacatgtaatttgagacggagggggtatcttatttggagtacttattttcgtggggaagtactggcattgaaggaaacgagtggcagcattgcattcaatgatgataagtcttactagctggcacacagcacttgaaagatttgcatatttattgtcaagtcttgcaactccttttatttttcttacattgtcaaaaaccatgtcagttataaccagtgttaaagatctttccagttgggacccaatgctcgagttccaactgcatatattgtgttagtacaacatgtgcaataactgattagtggttgtttagtagctgttggggtttacaccttcttcctggcacttctagtgccgatgtgcctcaatagcacctcaactgccccttgtttccttatcaatctaataaatagtcgccattgcagatggaagaattaatgtggataaccatgcaaagcagggcatggagactgaatttggcacattgccacgatgaggtactatactaacaatgtgctactgtcatgccacacactacaccaaaggttgcaccgaaagaagatttatactactacattggatgacaactaggccccactactgattaagttagttgcttactggtcttatcaggacagcttgtctcatgagtatagttatggggttcataacaaacttcattaactactgaattagtgcgtttcatctcattttgtgtatatatgtttgcaggcacacttatataaacaagctcacagcgttctgtcttaccagaacacgcttctctttcgagccacactcctaagaagactccaaggatagctccaatggaggtgaagtgcttgctgctcctggctctcttccttctgctaggaacacatggtggtgaagcgcagccgctcgtgccggccgtca

SEQ ID NO: 9129 - DNA, 1501 bp, Oryza sativa
acatccctttatccaattgagaattcaaactttcaacttttccatcatatcaaaacttttctacacacacaaactttcaacttttccgtcatatcgttccaatttcaatcaaacttttaatttttgtgcgaactaaacacaccctaagattaaaacccactcatgtaacttttttcttatatttttccctaccaacggttatatgcccaaaatatttgcatacccaaggcttcgaacccaagacctagggctaaaaaccaaaggagctaaccacttcactaatagtacatttgaagtaggaatcaccattacaatcttttagtctttgcaaaggtcggcgccaatgagagtggtgctgaaccttgatgatgtggctaatatatgacacctcggacggaggttagtaccaaaattagtggcgctgagacgttggatctcagtgccaatttctatggtgctgatgtcgcgattcattttacggtttatttttataataattttttttaaaaaaagtcaaactgtcactatttcggagcggatagatgcacgaatccacctatgaaaataggtacgctggctgtatcacgaggaccttgtgatgaggctgacacgttcttcggtttttcctgatctgaggggtgacacgttcgatcagacctatgcctgccagccgggttcgatcagacccatgccgctcgggttcgatgcttttgctacaccaaggaaaaaaaggttatacgaaagccgggatgaacaaaataatataacgcccaatatttttgtttaggctgagaaatattctactcatcggtatatgagtagacaaatacagaagttgtaagaaacatatgaatgggtgaaagttttatttcttctcgatttaagtacagacggtagaaagtaagacgaaaagttagagtcttatttatagacggaggaggttgacggctttcgtagtaagctggcttacgccagaaggttacttctcccgcaatctggctttctcgacaagctaagcttgtttatggcgccacaagctttcttacgctatgagatatcttttggtataaattttttctccaacttaagatttcttttgaagtaaacttttcactctattataattcatacacatagatatatgttttataacagttaccatttaaaaccatctcattaaattattctaaaactaaaccttctttcctgatctttttagccacgaaagtggtgccgacgtggcaaaatcatgctgccatgccagcacacgtggtgtggtacggcgccacgctcgcggggttagccagcctgatccgcattgattctgatgcatcagctatatactacactagacatgtttgtacacgctacactatcgggagtgagccgagcaatcatgtactgagttacttacatccgtttcaaaataagtgcagtcatagatatccgtgttttatcgttttgaccatccatcttatttgaaaaatttataaaaaatatt

SEQ ID NO: 9130 - DNA, 1501 bp, Oryza sativa
ggacctaaagtgaacttgttcctcgtttagatcaattggaactgtaacaagacgctggaacaaagagtgaaaactgaaaaagaaagaaatattcatacgctgatacgtacaaaacatgtacatccggtatgttactaaagtactatatatatatgtacagaggcagagtatagttcacttgaagcatgtacaaactagtaatagctaaatagctaattactagctatatgtacatccatacatcacaggcgaccgagaaacagcgatcgatcggcttcaccacttcaggtgtagatgaagaaggccaagaatcctccgagcgaggttgccacggcgagggcccaaacgacggccgccacgggcggcggcatgagcgccgcgaccttccacgcgaacatggcggtgacgagcgtcgagagcgcccacaccgcgcgcttgaggcggcccctcgcgggggacccgggcggcgcgcgctcgaaggcggagaggcaggagaagaggaggagcagggcggtgtacgagccgaggacgaaggcgaccgcggctgcgtcccccctggagcggtagatggcgaggccggagttgacggtgaggatgcccagccccgccctgctaatccacgccgatctgccgtttggatccatcgtccacttcaaccatagctagcacttggcaggatgaggactcaggcgagacctcgagagcagaggaactggattgtcttcccggccgtatggataagagtgatcttatcttcagtggatatggatgacaggatgagcggctgttgcttttatacttcctccgtccaaaaacaatctctagctatagggtgtgttcagttcacatcaaaattagaagtttaattgaaattgaaacgatgtgacgtaaaagttgaaagtttgtgcgtaggaaagtttcgatgtgatgaaaaagttgaaagtttgaagaattatttcggaactaaacaagggctatgtggggatataatctcttttaatacaacgaatcttttatatttgttctaatatgatatgtcatattttctcttttctcttaggttaacttttttgtttacagaaattgctggaatctaccccctccgtctcaggacaagcgcagttttacactgttatccaacatttgaccgtttgtcttattttaaatttttattgttattagatgataaaacataaatagtactttatgtttgactaatatttcctaattttttcataaatttttcagataagatgaacggtcaaacgttggatacggatacccatagctgcacttatttttaggacggaggtcgtatgtcacaatatgtactgcaaatataaacaaactatattatggcctggtttagttcctaactttttcttcaaacttcaaacttttctatcacatcgaaacttttctacacacataaattttcaactttttcatcacatcgttccaatttcaatcaaattttcaattttaacgtgaactaaacaca

SEQ ID NO: 9131 - DNA, 1501 bp, Oryza sativa
ctcttatccatacggccgggaagacaatccagttcctctgctctcgaggtctcgcctgagtcctcatcctgccaagtgctagctatggttgaagtggacgatggatccaaacggcagatcggcgtggattagcagggcggggctgggcatcctcaccgtcaactccggcctcgccatctaccgctccaggggggacgcagccgcggtcgccttcgtcctcggctcgtacaccgccctgctcctcctcttctcctgcctctccgccttcgagcgcgcgccgcccgggtcccccgcgaggggccgcctcaagcgcgcggtgtgggcgctctcgacgctcgtcaccgccatgttcgcgtggaaggtcgcggcgctcatgccgccgcccgtggcggccgtcgtttgggccctcgccgtggcaacctcgctcggaggattcttggccttcttcatctacacctgaagtggtgaagccgatcgatcgctgtttctcggtcgcctgtgatgtatggatgtacatatagctagtaattagctatttagctattactagtttgtacatgcttcaagtgaactatactctgcctctgtacatatatatatagtactttagtaacataccggatgtacatgttttgtacgtatcagcgtatgaatatttctttctttttcagttttcactctttgttccagcgtcttgttacagttccaattgatctaaacgaggaacaagttcactttaggtcccccatttgttgctgggtcagacatccgtccttaacccgcaataacaaacattacgcgtcacttaactctgcaaatagtccacgtctacatggatggtttgacttaatccacgtcctaactcctacgtggtattggaagcaaaataaaaaaaatattttttttaaaaaaaaagacaattgcttatttggctccgtttaaactgatcctactttttctagtttgtttatgtgaccttacttttcaaaacaaacaccccatctgacccttttccactgcaccactaaagtttcattttttttaaagaaatataattattatttgtaatgaccaaactaccctcaagaaatcctatccacatctaaccctatctattcaatcccgtctttctcgtatatccattgcagcggcggcacgcggaggggacaagcagccacgtcagctagtggaggtagtggcgacggaggggcgcagagggaatggacccacggcggtgcgtgcgcggaggcggtgcatgcagagaatggagcagcgacggctacggcgagcagaaggactagcggtgatggtggctcgatgacgacgacgaggagcaacggcggcggagctcagctatgacggtgtgcaggcgatggatccggctttagctgggtgtgtgagccatggatctgacgacggctgggcatatgagtcacagatccgacacatgcgggtgacggatcccgtggcggcgggtcagcgacagcggcgctgcggtggt

SEQ ID NO: 9132 - DNA, 1501 bp, Oryza sativa
ctgaataaagggtgttacaatttgccatactttgaccaacatgttgaatatatcacgctagtttcaaattgtacaagagtgacccaagtacgagtatctttaaatttgtaaccatatgtagggataggcatatcaaattagtgtacataacacatgattatacgcagctatgatcaaattagtgtacaaataattgcttctataagatcccctgataatgcaaattgcacacagaaatattgttccctaccaggaaacatgataatgtcttatacaaggatatgtaacatttaacttggacggggatgaactatttgtaaaccatagttaggtccagtaccaattaatgggaacaaaattgtcatgtacagaacatagtgcccgagtgagaaaaagcaacatgagctgggatgtatgtccagaactggattaaacaaggactttaatgcctaactaccaggcatgtcatcgattaagcaatcagtaatcctcaaagccactgcatcaagcatactaaaaacctattcctaaatggaaagtacccttcctagtgttttggaacgctggaattttacagtattttcacaagaaacattttaagttcctccaaaactcccgtgaaactcctccaatccgaatagacccgtatgaattcggccacagccttatcgatatcaacgatctattgctatgccactgctatttgctactagtaccatccaatattcctcatagtacggacgaatccatccccatttttcaggtctccaaaactcaaattaagcacaaaaaaaaagagagagctagcccctctattctctctaactacatgcgcagaaacaaatcatcaccgttgaccgaactacctggaggcacggaggcgcggagggagacgacggccctgcctccgcgggagccgcctctgcagaaacggatcgaggaggcgggcggagagggggacacggcgaggtgggggcgcgcggcgccggggagggcgcaggacgtgccggatgcgagcgccatgggtgggggcggggggttggtgggagagagaagcggagagggagagacggggaggaggaggaaagaggaggaagacgacgacgaggaggaggagcggaaagatctgggggtttccgggccgcccggattgttggagagtttttgggctccgcctctctatccaggctttcttttttggtccacaatttgggagcgcctgctcctggccgtgtgacactgtgatatgcgaacctataagctactagaagaactaatgtaggaatggtcactctagttatcaaacctattttattatcgacaaattaaattatcagtggaaagcttactacagaagaaagcttacgccagaagccagcttacagaagaagccagcttacggcgtaggccagcttacaggagaagccagcttacgacgtaagccggcttacgacgcaagccagaaggttcaaggcttacgatgcaagcctctaccctcctc

SEQ ID NO: 9133 - DNA, 1501 bp, Oryza sativa
tttgataactagagtgaccattcctacattagttcttctagtagcttataggttcgcatatcacagtgtcacacggccaggagcaggcgctcccaaattgtggaccaaaaaagaaagcctggatagagaggcggagcccaaaaactctccaacaatccgggcggcccggaaacccccagatctttccgctcctcctcctcgtcgtcgtcttcctcctctttcctcctcctccccgtctctccctctccgcttctctctcccaccaaccccccgcccccacccatggcgctcgcatccggcacgtcctgcgccctccccggcgccgcgcgcccccacctcgccgtgtccccctctccgcccgcctcctcgatccgtttctgcagaggcggctcccgcggaggcagggccgtcgtctccctccgcgcctccgtgcctccaggtagttcggtcaacggtgatgatttgtttctgcgcatgtagttagagagaatagaggggctagctctctctttttttttgtgcttaatttgagttttggagacctgaaaaatggggatggattcgtccgtactatgaggaatattggatggtactagtagcaaatagcagtggcatagcaatagatcgttgatatcgataaggctgtggccgaattcatacgggtctattcggattggaggagtttcacgggagttttggaggaacttaaaatgtttcttgtgaaaatactgtaaaattccagcgttccaaaacactaggaagggtactttccatttaggaataggtttttagtatgcttgatgcagtggctttgaggattactgattgcttaatcgatgacatgcctggtagttaggcattaaagtccttgtttaatccagttctggacatacatcccagctcatgttgctttttctcactcgggcactatgttctgtacatgacaattttgttcccattaattggtactggacctaactatggtttacaaatagttcatccccgtccaagttaaatgttacatatccttgtataagacattatcatgtttcctggtagggaacaatatttctgtgtgcaatttgcattatcaggggatcttatagaagcaattatttgtacactaatttgatcatagctgcgtataatcatgtgttatgtacactaatttgatatgcctatccctacatatggttacaaatttaaagatactcgtacttgggtcactcttgtacaatttgaaactagcgtgatatattcaacatgttggtcaaagtatggcaaattgtaacaccctttattcaggcacgcccatctgccctgtacttatgagcgggtaacactgatcagggtaacctgttaagattaaatgtctacaggctaaattctgtgatttcttgtcaagtatagaaataattaaacagtggagtaaatttaagataatgtcttccggagttaaaccattgattgctttttgcagcagcagcggcagcaacaacat

SEQ ID NO: 9134 - DNA, 539 bp, Oryza sativa
attttacctatctcatctctttggaccgtgtctaatggctggaataagcctattttcgctcccttcttctgattgttgggccgtgctgtaccgaggaagagactgataatctaattcacaagaccgtacaaccttcttcatttcacctactagcattccttttttcaaaagggatagtttcgtttctctgtatgaaccttattttttaaaagggatagtttctgttgagttgtgatccaaattcatttgcacttaataaaggccagcttctgccgtagcggaacgatatggatcgtcatcccttttagggttccaccatatatatacctcttgtaagccgccatgcggcgatgtaacctcacctcagatatagtgaagatattttgctggctggcgcccgtggtttttttctctcctgttttgggagggttttccacgttaaatctcgtgtcttctgtgattgatctattgttctttatcgtttgttcgcttatcgtttcctaacaagtggtattagagcttgttcccacattagggtt

SEQ ID NO: 9135 - DNA, 241 bp, Oryza sativa
agacatccatgtatgttttctgatagtattcatatgattggcggttaagacttaagacatgctattagatacatgattaatcgtgtttttcatgttttgtattaatatttttagtcattattcaaacgatgacaatctacgcgagcattccattcaagaggtatcccatatcagtatatccttaccctaccagtcacttaaagagatctatgtgctcaaaatctattgtccttcaaatagg

SEQ ID NO: 9136 - DNA, 364 bp, Oryza sativa
atcacatcaaatgtttagacacacatatatagagtattgaatggtacactttatactcaaactgaaaatcaacagtactgaaatttcagacaggtatatatggctcttcctaccatgtgccttgtatttatagacatcaggctgcagtcataataagtaaagactacatgataagaacactactacaaatatagtactactctggaaaacctctatattaaataacaagaattgagcatttctgatagtgctacattctatgggggcgctttttaactagcagcctctgggtattgggacagcttacagatacaacagtgccacaaatctgcattccccgttaccttctgtttgtgaccaaagg

SEQ ID NO: 9137 - DNA, 1501 bp, Oryza sativa
acgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaaaagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctaagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatatgtatgcatatatatgtattgaaacatatatatgcatggtttatatatatatatatatatatataaaccatgcagcaacaggggcatgcaaaaaaaaaaaaggtcagctctatctttagtcccggttggtgtgctgagccatctttagtcccggttggtggctgagccatctttagtcccggttggtgatctttactcccggttatttcacccgggactaaagatagcgatctttagtcccggattggtactcccggtttggaaaccgggactaaaggggggttacgaaccgggactacaaagggtttctccaccagtggattcaatattcagtaaggagtttcctcatgcagacagtgagacagacaatgaccacaggtctatacaaatgaaatatggaatattaaatt

SEQ ID NO: 9138 - DNA, 1501 bp, Oryza sativa
tcgtgaattcgtgatgtataattaagaaaagaaaagaatgtgactgagagaaaaaaaacgaatataattgagagaaaaaaaatgaagaactccctccgtcccaaaatataagtatttttaattttgatatagtttttgagatggtatgttaaacaacaatatctataaaagtaagatattttaaataaaaagagttgtatattatgatagtttgttgaatgataaatctaataacatcaaacttacatgattaatgtttttttgctattaataatcaaagctaaaaatgtttgacttggcactattctaaaaatgattgtattttgaaatggagggagtagtgtttactcatattcttccttatacttaacatgtatacgttatatctacgttgtaacaggctatgcccatatatgtagggataggttatagggtgatttggtataaaacattgatccgatggttatgggaggcggtgcgcacgggtcagtaccacatgtacattgtaacgggtcgggataacagaactaggaatgtgctatggggtgatttgagataaaaacattgatttggtggttgcctacattgtaacaggctatgcccatataagtagggataggttatagggtgatttgacataaaacattgatccggtggttatggaggcggtgcgcgcggttggaggataggaggacaatttcgctattaaggtagtagcaatattggaccaatataagccatctagagaaagggaattgtccatgctaaatgctaatacttatctctttcttgccgattaaataggccacgtatagtgacgagtgggtctaatggacgaatgttcacgcgcgaacacttaatttcggcccagcgcagatgtgtctagtccaacataaaaagctatttcagaaaattttgatatgcacaaacttttaattaaaaaatgaatgcaaatcgaacatataaacttctgtaataaatttacttaaaaatagaaactgtgcggtgccaaaacaataaaggaaaaaacatgtgtttggagtgtcgtctaagccgcacgcaaacatttattccctccgccccaacatataatcatttctagagtttggacacggttcttaagaaagtatgtagaattaaatagggaaatgttgtgattggatgaaatgtagaggtatgtagaaaaattaaatggtggagggttctgattagttgagaagagaatgttggtgtagaagttattatattttgggacaaattctagagactagaaattgttatattttgggacgggggggggggggggggggggggaatacatgatagtatttccggaccgcacactacacgtgctcaagaaataaagagaatgctctttgtttatgtgtagcagaaactcctatatataaaatttaatattccatatttcatttgtatagacctgtggtcattgtctgtctcactgtctgcatgaggaaactccttactgaatattgaatcc

SEQ ID NO: 9139 - DNA, 1501 bp, Oryza sativa
ctttcatctggcggcggcgagaggcgggaactccgggacgagggcgccaccaccaaaatttcgttcgaaaacctcctcccctccccctccgcccgcgccgccgtcctccggcgagcgagcatccgcctccttcccgccgccggagcgaaccccctcctccgaggatccttctccccccctcacacacacccccgtcgtcgtcttctcgtttctcttgcgctggtaagggaactctctagcttttgcttttggggggtgggggtgggttttggtgtgcgccgcgaccgaaacccaaatcgttctgtgttcttgccgatatgtgaaatgtttgtcgcggatttcgtttgatatgtgcagttagtgagattgtgcgtggtgcctcctttactcgatgttttatccagtctgaaatcgagttcactggtgcagacccccgccgctgtctcggcctctcgatctggtctcctccaaatcctctgattgcttaatcctcttcagtctcgcggcagcaggcgattgaacattgaaggtcagtgactaactcagtagcttttgcttcgttgctcatagtcatagttactgatttgtttgctcatagtcatagtaggctgccgatttgtgggttgtaaatgactgatttggatgtgaattaatcgttgttgttatctaatgctttcaagcctagtcacaccaacacagtactgtcgctaaaaggaaaaacccggcctgtttggtagtgttttcggaacgctttgatgatttaggccatgtggagttactaccgttttatactggcgcgtgtttggagaacttcatgagacagattgcagctatcgactatgtaatactgccttcattgtggggtgtaactggacgtgtcagaaaacatttttttattgagaatggtgtgtattgttaataggtttatatgcagactataagctccaatttgctcacctgatggttggtcagtttctgcattggttttcaatgctatgtacattcaacatatactttcctgtttacacgaagagaattatttggtgtatgaatcgtgcggcctccagatagaatcatgaacattcttgaatgtctgatcctgccatatgatttatatcttttacctctactattaatagagtggagccagcaatagagtctgcttattaatgttgtataagtcatttccttcattgtttaatctggctatccttatgtgcttatttttttattgttccttcagttttaattgtacattgtaatattattcatagaatcaacatatctgtattacattgtaccactgatggtatggtagggggatatttccagtttatgaattattttctactctaaatttgcagggactagtgtgtcatgggtgtagctgtacatctactttcaaatagtatttgatgtagagcatgtgtcagtggatactcatttccaggaaagatcatttcatgtgaggtattctgtggtgtattgtgcaagactatga

SEQ ID NO: 9140 - DNA, 1501 bp, Oryza sativa
agctataatatgggacagagttagtagctcttagaaggatttgttcttccatatttcgatagaattgggcttatcatcaaaatgatttttttccctagctgctatcttttctttttgttgttgttgttccgatagaattgggcatgatgctcacatggaatggttttttttctctatatcaccctatactgttgtgctaaatagctaaatagaggaatgatttgtgaaattattcaaggattaaaaataaattaaatattgtaaagttgaaaatggatttaaaacaattttctaagaaatttgtataaatagaaagttttttcataaaaatgcttgatactctggaaacgtatgtttcatgtattccttgaaaagaatagggcatcgagtaatttccttgaaaaatgtatcatcgagtagttttttaaaagccataaaccattcttatactgttaagccaaaatctagattagagtagttttgtccttacgtgaagtaaaggtaggaccccaccattaaacttaatggcttaaaaaccatcggcttataaaacttatatgccaaaatgtcaggttaaaattataagctaacaaacctaaacccaaacaaagaatttgtccttttgtggtgtgtgcttaacatgtgctatgggccatagaaataaaaaaggaacatattggacacaagctttttgtggtgtgtgcatggcatgtgcagtggtccatgggatatatagattaatcccacatcttcatgccactttcctacccattactacaattgtgtatgcctcccattagttctaatctttcttgatgttaccttctccaatacaaaagcatttttttctcaatgatacacttaagaaggaagtaacaagggaatatcatattaaggcccgttcttttatgatgaagatacaaattctacctcagtttcgttataaacgatgcattttgtgcaaaatttttatatataaaagttgctttaaatatcaaataaatctatttttcaaatttaaaataattaaaactccattaatcatgtgctaaatactttctcgttttgggtgcctgcacttaatcttcatccgccattatgttttgatttttgaactatatagcttttgaagtacaatagaaaaatccaatgtgtaacaacagttttgattggttctaatggatagtgatttttttatgcatgatatgataataggaatagttatgagaaggtatgccttataaagaaatatatgaaaatgatacgccagtatacaacttcattattcatcctcatattttttttaagtaaataaggccatgatcaatgtggtgctagaaaagaaaggggtaagggcgcattctaactagatgattgatagatttcgaacaaaggaaaaaaagtctcgtagattaattaaatattacaagttagcaaataactttttaaaaagttgtccacgcaatactagaatgaaaaggtttttagaaattgtacttgt

SEQ ID NO: 9141 - DNA, 1501 bp, Oryza sativa
tttgcaatataaattgttagatttgtattcaaaagtcttgtactaattttttgtaatatatgatgaagttgagttttctttaataaatgaccaatgataattattcagctatatgatttatttaagtaaaatgaaatgagcgtcactagaattgtcattaaaaagtgattactatgtttgtctatttgcacaaatatttgttgtcttgtattttttgacagagggagtaatttgttaaggactacattaaatctttcagaagtcgtttacgaaaaactttaagatgtatataattgtagtataattatattgtacctctactgtaattacattgtgactaagtattaaatcgactagaaaccacgtctaagccctacgagcccttgctcatgagaggaagatattgtcatcagctttctagcaaatccataaaagaaatgctttgaactggagtgtcaaataaaaacgacgggagagggagtacttttttttctcataatgcaagaccaggaatattttaaattttaaattttatttattaaaatatttacaaaaatatatataaagttttataaatctacacccctaataccctttgagagggtattttttaaaagtcattccaaaggactttttttttataatgtggcacacgtccgttgacgtattctaatagtcacatgaagggtggccagtcattttgcagacaaccgcttgtcacctttccaaagagctacaaggaagccagttgcaaaataattgagacaggctatttataggcaggcccttgccgccctcccagagaacgttggagtagtagatttgtaaaactttaaccataaattaatttttaaaatattttaataaataaaattaaaagtttaaaaaattcttgttccaagccagtttgctttatcctccattcctcccaatagcaaacacgtgtcgtaatctacggcacgtgattcctctttgggcacttggtcacaaaggtgctatagtcatgctgtgttctgaaattcaaatttacaggaatatggaattttcactggaggctgaccgaaatttattaaatggggagatagacttatcatcatatagtcatagagattccgtcacgtacaatgatttagctatagttactaggggtactgtagcttgtagaaaaaaaaaaccatttatacaaagggcgaatcaggatttggccaacccatgcattatacctttcatttctccaatctcagagaacaccacttaaaatttgaaatgaagaaaaagctcgtgcactgatctcacgcgaaactgagtacgacgaaagtgcatcggataacagaatacctatggaatttcaataaaactcttagttgcaaatgctcagcagacaccagcataggctaacatacttcttccagcgaagagataatgcttcttttctagttttatcagctgaacatttagaacgttggcaccgaaaatattcacaggtgtacccaagttcatg

SEQ ID NO: 9142 - DNA, 1501 bp, Oryza sativa
aacatgaggtgacagtgtttggaatattatgaactatctgccaaaactctgctcgttgcatgtataggaaattaactctcgagttatctttcaaacatttgcatgtcaaaatttattgagcttctttatgtagcttttgatgtcagctgctgttgatatagtactggagtgtgtctggtgcgaatgtttcatagcttatgtcatatgcttaattgcgtacttgtataagcatacttgtataatcagttatttgatcaatggttgtctggaagcaagcagttctttgattagtgtaatcggagcaaatgatcttcccaaaggcttctgtttcaaatttcgaattgtgtcctattgatcagcctcccgttccttggctgccatccgcaaccaaacgcagtaatgtaaataaatgacgttaccgcctgcaaccaaactaatcatgtaatcggataaattggtatccgttacggctggaggcaataccattagcgtttacgttaccacatccgaaccaaacaccacctaaattggtaagctcaaataagcagactcgggtggcggaagcttggtgggatcatggtcatggatgatgggtatgcacacatccatagctaatggctattttctcttttctaagattattatgttacagacacgcacacatatacactactactaatacacatcatttgcctgcgtgattgcttcacatgactatttttacgtgccactgccatcaaccagtttttctgttaaaaaatgcagaatattcagaggttcaagtggttactgctaaaattttatccctcttttagcacatcttgatcgtctattcaaaggaacggctatgatcggacaacagcgcggaggacacgcgttctccgcttcacctacttcctcccctttaggccctttggccctgcacgactcacctcacccaacatcccacgaaaaccctcgcggcctcggccatcgcccgtcgcgcacctccaagcccacgcacctcgccgccctcgccttcgcctccgttcctcgccgcgctcgcggcctcctccgcgcctcgccgcctccaggactcgtcgcgctgccgcctccaggcctcgccgcgttcgacaccgtctccaggcctcgccgcgctcgacacctcctccaagcctcgccgcttcgcttctcctaccgctcccaagcggcccacgcgtcgccgccgtcctccaactactacacgtgacatctccttcctcgtaaaatcgttgcttcgctctcgctcccactgcggcattttgacgaacagcttgcgggtgcggcagaatggacagaggaaaggaggccagggccagccggtccaagaggggacaaaaggaggatgaaatgaggttacggagggaagctgccgaagttctggatttacagaggaatggcgatctagacatggcgcttgatcgcgctatgagcctcttcaacgcctctccatgtcccatgatctacaacctcgtaggggacc

SEQ ID NO: 9143 - DNA, 1501 bp, Oryza sativa
agaaggcctccgatttctcggacgcgtagcgccagccgccaggttcttcttcttccctccgccgccggccgacgtccacaccgatggaaggcggcgccccgcccgccggcggggagagaaggtggctgccgccgggataccagaggagacgagagcggcggcggcggccgggacaacctcgacgagttacacaatgcaatttatatatttgtattttggcccagtccattaaacaacaaactatatacgtagaaatttgatatatatattttttatgtagaaacattctatgtataaactattcgtgtagaaactttgtgcatacggattcgatagtacacgagtaaagaagatgtacaaacgttttacgaatacgaaagcccaattttatgcatagaaactgtcgacatatagactttatatattcaaataaatttaaagggttaattgatcagtgccactataaatatgttgattaaaaaaataccactattattcgtgatatctgctgcgtgacactaaaatttcataaaattgaaaccataccactccgtcacgttttctccgtctcggcactgacgcgccaaccaccaccaccaccaccaccaacagcggtggcagcacccccattcatcggacctcgccaccaagccacctctttgcgccgaccgcacgccgccactgccccaaccaccatacaggcacacattgtgtcacgccccgaactagccccgaacggaactagcccgtgacgctccaaattaacatgttaatcgataccagtcctaggaaacagtgctggtatcacaggaagacagaatatcacagcaatagaggtctctttattacagagtaggagtatagtcatgttgggcggcggacagatcccgagctcacaactgcattacaaaagggaaagcgaaagccaagacttggcccattcatcacaggcgcgacttgggaactaccccgaaaccctaaaactcatggtagcggacgtgctcctgaaagaactcctcgtcagcgggatccacttcatcttcttcagcaactgggggggattatttatatagagcaagggtgagtacaggagtactcagcaagccatgggaattaagtgtttgatgcaggcttcaaaggaaagactgttgtttttgcaattgattttatttaaactcctctttgaaacaactaagtgagtgcttctcaaacgacacggatgagacagtgtgtctcgtccggtcggagtatgtgcaatgtatcagtctttgaattgattcaaggttggcacccggccaacagctttcaaacggccacccgggcctggctgatcccatcagccgcggattttccaaacatcgaacccattccacaacagtaatttcacaagcagtagtcaatcaaaactacgctaggaatcacctcacatccgcccatgaccgtgggcacggctgctcgaacaatttagtaacctctgcagagggggtacactttacccaca

SEQ ID NO: 9144 - DNA, 1501 bp, Oryza sativa
ccaatccctccatcgtggggattaaccgaacaagcccttgccgattagcattcagattgatcctgattcgactctacttgcctgttagtctattattcttaaaaccatgtaatcttcacaaacacaacgaatagaatagcatagatgtagtcaccaaattaaatgaattgcacttcatttctgtagctgattccactcgtcagtgaactaagttgaataatctatcacaaatccacaattcagctttggtttttgaaactagaaacatagtagcagaaaagctttaaaacgagggtttacagaagctagggcttaacgaaagcgacctgctctgggagacgtcatagatctgccccttgatcgccatgagcaacggcttctcggggtcggacccgtcgtactgcagcaactcctccgccgtgatctcccccacctgcaccggctccggaggcggcggggcctcctcgctgggctcctcccggggcctcgccggcggaggaggcggcgcgaggagactggaccccaccttgtagaccaccgccgctccggccaccgcggcgatcaccgccaccggcgacgcgctcctcgccgccgcccacagctccgccactgccacggccacggccaccgtcagatttttccaagcgaaaaaaatccccacgcgagacgaggaggaacatatcttacccttcttcgagatcatcccaccgcttacaggcccagcgctgcatcgcacgacgccgccgccgcgcagaggccgaccagggaggtagacggaggaggcggcgcgccgccgcgcggcggccggcgacgcgaagacgacgacggctgggcgagcgcaagcagcggagcaagtcgccatttcgagacgaggcttaccaaacacacctctcgtttgtttgtttttcaatataaactggaaccaaaaatcactcacggtttggacaaataaatcttaaaatcactcactgaaaagtcaagtaaaaaattcgtcaatgatttcattcctagtcagtttaattttgtcaatgattaaaccaaatacacacctctcgttcgtttgtttttcaatataaactggaaccaaaatcactcacagtttggacaaataaatattaaaatcactcactaaaaagtcagtaaaaaattcgtcaatgatttcattcctagtcagtttaatttcttcaacgattaaaccaaatacacacctctcgtttgtttgtttttcaatataaactggaaccaaaataactcagtttggacaaataaatcttaaaatcattcactgaaaagtcaagtcaagtcaaaaattcatcaatgatttcactcctagtcagtttaattcggtcaatgattaaaccaaattaacatgagcaaaagcttaaaaaattttacaggtgcgccgggccaaggcagcagtgcaaagccagggctcgcccagtagcgagctaccgtggtggaccctcccccacaaaatattaatttaatatccatggaaata

SEQ ID NO: 9145 - DNA, 1501 bp, Oryza sativa
ctgtctcccactttttcacgttttccggcgagcgcggcggctagccatggatggcgtcggcggcggcggcggcggcatcctgtcgtacgagaagctggaggggtacgcgatctgggtcggggccagcgtggcgtcggccttcttcgcgtccatggagagctgctcctgcatccacgtccacaccgccgacgacgagggcgacgactacgaccccgaggaggccaaggaccgccccctcatgctctcccgcccccaggccctccccgagtactactacgaccgatccgcctcctccgcctccttcgccaagatgtgatctcatctgctgctcccttctctgatccgcttcttgattagtttctgcgtgttcgtgtgatctgtggatgcgtgtggttcaattggcgttctttcggtggggggcattcaagaaaccatcgtccctgcattgtgcggtgtgtttgtgttcataaagtgtgtgactcgaatagcttatggatttgtgattgtaattctcttgagttttttttttggttcatctgttctgtacctgattcctgatttggtcgtataaagcatcttgttctatagatttgtgggattccttcagatttcagatacgtaaatcatgccagcttcaagtttgtggcaaggaaaatttgatccggtttgaggtgatcattttacagggttgctttgctggctttgcacaagaaacgctgcattgctgacgcagatcctggatgcatcgaaatgctggcactagtttctgatgggggaagaagatctttgggaggaagaggaatgcagctaccttttcagtgtcatatgcggaattctttgctccaatgtttttgtggtagttgtaaacgaaagagattgaattgggcgatttgcccttggatttccatttgatgtacctggtaattttcagatctagaaccaaggcaatctatccgtttgtacatgtaaagtgaaattttcatgtcctggcttctcaaatttgagtgaaaatgatctgctagcttgtccatccaaattacagatccctgccaactgacaggatgacatttttgaagttgagcaactattgtatggctaaaattgctagtaatatattttgatctctgcaaatgcagttcttggaattgtaaaacctttctgccttgatgctacaattaaagaaaaatcaacggcagaaaatcactacaagctcaatccacaaaaactttctgcaagaacacaacggagagtccagttcccatctcacaaggaccgagttttgtgcgaagtgctccaaggacaaggcctgttgattattgtgaaacagaagcccaaagcccaaccatcctcacaaatccacgaaggccacgagctaaccaaaaaacaaacctctcagagtcagaggaagctgacaaacaactcgagtttagtaccacctcgccaattcagtaagctccacaccagcttaaatactcactccccacccgctttctcgccgagc

SEQ ID NO: 9146 - DNA, 1501 bp, Oryza sativa
gggcggccagatttttgtcgcaggtcggtttcgtttccgctctccgctccacgcggcgtcgcctccggagcccccagaagcttctcgacccaccaccaccgctctccctctccccgtcaggtgcgttcgtcggaaatcatcgggaaaaaccccgaaatcctctcccagctttcccttttttttttcccttcttctccgcgcgcgtgttctcctcgatctctccgatcatcatcgcgtgtggtggccgattggctgcggttcccttcccggaaattctgcggcgcgcgccgccatttttatccgtctgtctacagggtagggagttctcagattagaaaccaggggttctcccgttttggcgctagttatggtagagatttcgttacctttgcatatgccatggcttcgtcggctctatgcacggagcctatgtatgtatgtatgtatgcttttatttttaagtttgtctcgtctagagtacgcggtggcgatgggaaacagccgctagatttgtttattgtttctttaccctaatcacaggtatgggtatttgagattagttacgaaacatcttagatatatgcggctattcagtttttttttttaatgtgcaagaatccaaaagtctattaattagcatgtaaaaggacttgtgctgataaattctttagtttttagtacaagtgtctgtatctagtttcaatacaagttgcaatccagactacgttaataacactaaaagattgtattgatacaaatccatgattattatggcgcattgaagagaggaaacagaggaaggtaggcttgtcctgcacggcttgaagctctgcttgccttggccaaggtttggacagaggcccttttgagttctatacactggttgattactccctgttacaaatctgagcaatctttatcgacgagggcctagctaataatcaggaaaaatagagataaagtggaaagtagataacaaacgccaaactaggaaatagatgactgcatatctttcagccggatatggtccctcctgctgtaggcgcggacccagaatgcttgtacagctggtatttatacctatttggcaggtagataatgatgattgaacatggtattggtgctttgggtgacagttaaatatttctaaggaaatcactgcacaaatatcattttttttgtttgggaaatatcttgtttttgttttgaaaaatttaaagtttatggtgaaatctcttttgtgcagccttggtattatgtaaatctccaaattctgtagtttagtgttatactgtcgaaatttgccctttccccaatctttgctgttgtttgacaatatgcgcctacacaaaattagtacagtgctacgctcctttgtgcttgaaatgtttccccatattatttattaacagaatcttgaatttacaaggtcattttatcttgcatatttgcatctataattttagttgacctgctttaactcctatatatgcagaaacaa

SEQ ID NO: 9147 - DNA, 1501 bp, Oryza sativa
acgagggccttgatgatgggcgtggggacgaaagccggcggtagcaacggatgagataggaggtcgatgggcgtgggtgggcccctcccgatccagtggcgcgacgacgagcatgcggcagcagtgccctcccgtcgctacgggagggggtggttgtggggggggggcgaggtggtggtggtggtggtgacggcggcggcgtcgccgagagcctcgggaactcctccgagctcatcgtccgccgtgtcgccactctcgccagggacaaggtgtggaacctttccttagacaagctgctaggtgaagatggtgcgcccattcgcgctcgcaaagtccgccacttgccgatgcaatcccctcacccgcctaccaccgccgctccaacgaccgctggtgccactccgccatcgccacggctcaaggggaagagagggagggggaagggggggttaaagaggtaggctaacatgtgggtcccacatggcagtgggtccacaatatttttcgtgaatgataaatgggtctcacatatctatactttctataaagttatagcccactaagtttaaagctcaacacacaaccatgttacatcatcacccactagcaataattacatatttaacctcatgcgagcatacaacatcatctacaaatttatttaattatgcaatcaacatacaagcatatccaattatcacccctcacatcatttgcacaatattttaacaaatctatctattattttttttataatatttaacataaaattatcaatatgtttcacattaaagcgcgtgtatcatttgtttatttcatgataagtactgataaaccctaatgtttcattatttttttcctttttacttctagtttgattgtcaaaaaaatatatattgagaattgattagtaatttacgcagcaaagcgcggggaatcatctattatttttttaattctaatgccatctaaacgccacgaagtacgaaaaccaagtcaacgctgccacgtcagtgaaaccgtcatccaaaaccaccgtgggagtcaaattacaccggttttgacaattgaggggtcatccggtattgcggatcagggatacgaattagattcgatcattagttaggggagccaaagttaacttattcctaagaggaaatatgacttgggcggacggcctccgcgccgtgctgtgctcgccatgccttaccggcccataatgcctaggtggtgctacgacggcccatttgccatcgtgctcgtgccgtggctggcgtctcccgtctactaccgtatttctcctttccccgaccccaagcaaagcacatcgactcctatcggcggtcgcgcgagctccagcgccaaggtgcgttcagttcatccgattccctcctggatccaaaccctaattttcgctggcctcaccgatccttgcctatcctatccaggggatccgttgcgtccggcgggggttaatttcttgcggttgtaggatccccga

SEQ ID NO: 9148 - DNA, 1501 bp, Oryza sativa
agattagccatgtcgaaatttaacattgataaaaattagtcttgataaaagttggaaagatcaatttagaccacaaaccaaacacgtctaaaagacattgttcggtgagctgatcagcatgtatcgaatagcttggggattgtggggttcacgcagacgttacagttttaactgaaaaagcataccatacagttacttttatatagaaaattttcatgcaattacttttatataaaacgttttcacacgaaaaatattggttaaaaagtatgctgacgaaaatcaaaataaaatctttaacttaataataaaaaagggacatcaagcccaacaaccatccacgtaactgatcatatgtcctcaacctaaatcaaaatcaagggaaaatccttagccacatcctgcaatccaagggaggaggatcctttacttgccccgactttaggtcattgacagataggacagatagattcataacaaagagggtttacatgtcagtaacttaaaaattatgtaagatctcaaactatagtggcggagttacctcccgggtaggtcgagcgaccgtccgggctccgttcctgccatctgcaccgtcgatagtcgtcgacacctataaaatttaatctatcagcgagaaacattattagttgtttgggcttgacgacgccgctggctctctgtcaatctgcaatccaagacgtagtcttgacccttgagtctttcacgaattctgctgatcccctggccaatgcagcacggggtagttgggttgggtccggacgcggcgcgcctccacttcttcggcgtctacgaggacggctctactagtactagtattgcatcgtcgccgtatcggatgaaatttcgaggtttcgacgaggtttgaaagtagaagtcatctgacattttggtgagtttcatccaaatttaaatttgaattgataaaaaaagaaaaataatcaaataaaatcttataaatagtatgatatttacaaaacctgttgggatataaattttcaaaaaaaaatgatgtattccgtgtatttactgaaatttacagtagaaaagaaaagaataacgaattaaaaaaagaaaaaaaaatcagtttacctctttttctgattaccgattgaaatttcgatgatttcgccaaagctgaccggttttcgcgagcttatcggtaagcttagggaatttgtatttaaattttggtttataaaatttattcggaatctatcggctttataccggatttcgtaaaaaaatgttattccgccgtaatccaaaacggaaggtcatctcgacattataaaccctgtacaactacagcaccgccccgaaacaaacaatatccaccacctagttgctgccacctcctgagaaccaagcaaagtttccgacctcaccttgctttttgatcagcgtgacgctgctgcatcttgttgggaacttttcctctcctctcctctcctctctctctctctcctcttcccgaaag

SEQ ID NO: 9149 - DNA, 1501 bp, Oryza sativa
cggggtgggtaccagatggaggctttggaactagtcttgccgagggataaccataacctttatccatgcccatacccttggtaaacaggtagtgtatgggtaaaatttgctttacccattagaaatgggttgggtctggatatacccatttataatagggtgggggggggggggggtggggtgcccgtatacctgtttgaccaatcttatctttctctccggttgcttcttccccaaatcctgagagaagctgacaccatggcgtatccctcttcctcgatgaacaccttgcgggagtgcaggacgtgtcagctcaccagtctcgtgcagctgccggacctctttggcgacgctgacgaggtgatccctgacgaggagcagcaggagggagaagacacagccccgtgtggcgagcaacgattggttctcctgccggagcgaagtgtccatgcgctcgtccacggccttgcggaacctgtgcagcacggtgcacgccgcagagtgatgtcgtgtacattcccattccgttcttctgctgctgccagctgtgtggctcctcctggatcctcctcaggtttgggtggtgccttggcggcacggtggtgaatggccagatacgttggcttcttggagaacggcctgacaaaaccatggccaaattcatcatctctgcattttccaagatcttggctccattgttgctagttctttgctttgcttcctggttagatcgttctacccaattacccaaatacccactgtatatgggtaatttgattaatggggaaattggggagggtaagattggggattctgttttatgggtatgcggaattggggatgggtatggccgggtaatactcatataccctccccattggcaggtctaatcagaacagggtcggcgctgagcctgggcagctacttgatgtctacagatatcctccgaactgacaactcatggatgcatagagctagcatggccaggaacatgaaccagcagccagtttgttcattgcgtaccttgatggctcgatctcaaagatcatagccatccttcttgctttgtcacattcatatgcataccttcttgctagcatttgtcacatattcatatgccatgcttctgttttgcgcatgtaacataagttcctcgtgcaacctgaagacatatcatgccatgttgatctttgtcatatattcatacatttttcttcaaatttgtgtatgtaacacaatcaaaattcatacattttgctttaaatttgtgtatgtaacataagttactcccacaatctaaatgcattatatgtgttagctttgctataaatacacacgttttcattttttttaaaaaagaacattatacttccaagtcgtgaatgtaacatacatatcagtataccagagttgagtcccactgtaacttcatatgaaaaaaattctattaattttaatatgctttcatattgtgtcagtgtttaacatgtacaaactatct

SEQ ID NO: 9150 - DNA, 1501 bp, Oryza sativa; identical to SEQ ID NO: 4269

SEQ ID NO: 9151 - DNA, 528 bp, Oryza sativa
ttaatatttgaattcaaattcaaatttgaaacgggtatataaacttttgacttataaactttgggtctataaactttaggtgtataaactttagatgtatagaaatactatatacagaaaatatttgaattcaaattcaaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaacttgaggtgtataaactttaggtgcataaatttactaaaataagaaagtaatgcggtgtcaaaaaaggaaaccaggtggagggaaagagggggagggggggcgaattgatcgctacccccatcaccaggcgagcgatcgcccattagcatttccgcttgacaagcaccgtactggccttcgcgagctcgcactactgcagc

SEQ ID NO: 9152 - DNA, 1501 bp, Oryza sativa
gcgcgcctcgccgcgatcttacgatcttatcgacttatctgccttcgtcgtctcgcgtcgcgtctcgtctcccggacggtttgggccttcacggccgcagggcccacgtgattccccgaggggaaaaagtacactgaaggtccctcaatttgttattgaattacaaaatcgtcccccaaccaggtgtcccttaactaatcaaaaccgatcacattaggtccttcggtagttttgacccggttttgtcttacgtggcggctgagtcagcgtgagactcacatgtaaggatgccacgtcatccttctctctcccctcttctcatcctcggttcctcctccagaaagtattttctacacctaggtgactcctcagttcctccattcctcctctctctatctccattcctcctctctctatatatatgtctgtaggccggtcggcgaggcgaggcaggagaggaggagggcggcgctgcaccgcgccgacggacacagtggggaagcatggcggcgcgggtgggcgacggggaggcgcgggcatgcgctagcgtcgcaggcgcccagttggtggtggcggcaaccgtcgttgacacatggagattaggatgccacgtcagcgaaaccacccatatatattgcctagagactttgagtgagcggttttgtatggtttaggggtggagatttctggttttgtggttgaaggaccttaaaaaatcgtggtgtaaagttgagggatggccggtgaacttattctaaatttggacgatttttatctgcttgcaaccaaaatttgaatgttgaaatctaactttacaaccacaaagtaacatgcctgtaaatttttgctttgctatttgtttatgatgtaccccttactagattctttattttcggggaaatacttttgccttgttttttttctcatatcatctaaaatgttataaaaaatattaaaaattaacaagatatattaatatgctttaaatttgaaatctacaaactacaacataaaaacaaatatgactacatggacatgtatactggttagagtttaatttgtttttttaacttaaggatatcaaatttgaaattaaagcttgtcattttttttaaaaaataattatgtatatacatatgagaacagggagaccactcgagagattatgatccatttttattgttttctcaaaatatcaacagaatttgatccgacatgcttgtggaggtacatgcaacataataagttttatttatttatttatattatttagacatcatattaaccactcctattcttttgaagaagaaaaaaaaaaccacatgcctcgaaggtctcaaaatccgacattcgctttccctttcccaacttcccaacctccttcgccaactttaggacaacagccaaaacgaactgttccaggaaaaccaaaggcaaaaacgagagaaaaatagccaccacgaacccttcctcccccactgtctcccactttttcacgttt

SEQ ID NO: 9153 - DNA, 1501 bp, Oryza sativa
gtatgccagtattacctgcaggctccggtctcagctagatgccataactgaaagtatttattatagctaaataacacaagatttggagggagagatgtccctctaaacagccggacgtcataactgaaagtatttatagttaattaacactgggttttgtagatttagagggagagatgtcacttcaaacattttttaaaaataaattatgaacatgttggagattgaatacagaataaaaccacacacccattgtcattgcactattaagtgtatctcaaagttgtacgcacggagagtggcgtaattctaataaccagatttatttgcacttaacagtatatttgtagttttacgcacggagagtggcgtaattctaataaccaaatttatttgcacttgacagcagaagttttgtaggtatttttgtcaagccatccatgagatttcatttgaacgaagtaattctaagtcatgagatcatctattaaaacttctcaattcaagtttctcaatataatgctcgtgtttctgaatgcctcataagatttctcaatatagtggttcataagttctctcaatgttgtgcgtgatgtaataccgatataaatagttttgcttgatctactgaatcacaaaaccatttgccatttttagcattttccatttgtattctatacagtgaacacattcctcgagcctgagcctgaatttgaacgcagcagcgcttttccaaaaaataaataaataaataaataaataaataaataaattgaacgcagcagtgccaatcaacactactgaatctgaaccgaatgaattcacaccggttacactataaaatacaagtacatttcttttaccattaccgttgctacaaacaaacaccacaataaattcagacaaaattttctgacacactttgcaaaatcggcagcctcttggcagcacacatctttcttgcaagaaagatccaacatttcagccaacgagtaatcccatcaagaagaaaacaacagtttctgaattagaatgcaatatcgaggaaatggtggttgaaacactgaaactgataaaaacacaatcactagaaccaaagccagacatcgtttgatcatgtctttttgtatcgaaaaaatattattactatttatctatttgtaaccgtatggatcatgtcattttatatgccacagatatactttgaatctttttttctaccatattttggtatagaccaaaatacccaatccacacatggaggaggagatgcatttgtaagcgacaatgtaacgttataatgcacgtgtgacaagagcaacatttctcatatgaaaagtgacaatgtaatgtcataacgtgtaacaagagcaacatttctcatatgaaaagtgacaatgcgattatgcgacgtcataatacatgtgtaagttgctatttacagagatacacactaaaatgtggttgaattggacaagatagcacgatgatagacacaacg

SEQ ID NO: 9154 - DNA, 1452 bp, Oryza sativa
gcccctccttctctttcatctcgcctccttcccccccacaccacgtcgcgcgctcctgctgcgcggacgagggaggagaggctacgcctggcccctggctgcatgcgccgccgttgtgactgaccatggacgagtacaggccgcgacggtcgccggcgagcgagcggttcatcgggatgttcgcgtcgccgtcgtcgtccccgacggagccgtcgttcgtggcaggggatgagctccatgaggacgacttcctgttctcgtcctcccccgccgcgccgccctcgagcgcgcggccgggggaggggcccgggagcccgagccgggtgccgcaggggcaggtcgggctcctcgccgcgttgcacgagggggacaagaggctcctgctccgccgtggcggtgggggaggagggggcgcggccgctgccgccgcggcttccgcggggacgctgctccgtcgcaaggcgaccatcgcggccgccgccgcctcggcgtccggcggcggcggctcgttgtcgccaacccagtccccgacctctgccgcccgggccatcccgatgaccccgaggccgaagagcgccgggccagcggcgccgtaccaccagtcggctccggtgaaggtgcccgtccgcccgccccggaggcaggagatgttcaagtgggacgagctcgacgacgacgacttcctccggaacggcgacgccgccatgctgcccccgcacgagatggtcgcgcgcgcgtccgccggcggggccggcccggccgccccgttctccatgctcgagggcgccggtcgcacgctcaaaggccgtgacctgcggcgggtgcgcgacgccgtgctccggcaaaccggtttcctcgactgaattccgcaaaggtgatgtggctctggctttttgttcaggtccgcatgctcagtgtcgtagatcggttacattttagggtataattctagtgggttattggtgtagatcgagaagtaaaaccagatggtaaggcaacaaattgagttggtttttttttaatgcaactgcttgcaattttggtgcccttggaggtgtgtgcgtgcgtgtgtatgtgagtgtgatattactgtgagtttcaacagtaatgagaactggtgtcctgcgtttgggagctctctgtaattcaggaggagcaattttgtttaaggttgttaacctgttaggtgtatctatcttgataattgtctgagacctatggttgttatctcttagaaaattttgttcttttttattgatgtcttcatgacttcatatcccaattatacaatttctgatgcacaagtgtattttatttttggcttgcgtctgatgtgcattatgatatgcatgattcactcattcattattttttaccactgtttcctggatagttgcatatttctcttggtcaatgtatgataccccaccaatacgattcatatgtccaata

SEQ ID NO: 9155 - DNA, 343 bp, Oryza sativa
gcccctccttctctttcatctcgcctccttcccccccacaccacgtcgcgcgctcctgctgcgcggacgagggaggagaggctacgcctggcccctggctgcatgcgccgccgttgtgactgaccatggacgagtacaggccgcgacggtcgccggcgagcgagcggttcatcgggatgttcgcgtcgccgtcgtcgtccccgacggagccgtcgttcgtggcaggggatgagctccatgaggacgacttcctgttctcgtcctcccccgccgcgccgccctcgagcgcgcggccgggggaggggcccgggagcccgagccgggtgccgcaggggcaggtcgg

SEQ ID NO: 9156 - DNA, 1501 bp, Oryza sativa
accaagggcagctctaatcccaaggcggccgctgcgtccgggaaggggaagaagggcgggccacggccgtcgtcggctgagtcgaggaggctgccggtgaccggcaaggcggccgtcgtgatctgcggtctgccggcgggaaagatggtcgcgcagaagaagcggctgtccccatgccttggccgcggatggcgccgggcacccgcggcggcgggggccagggtcttcgcgagcgaggcggtggagacggatcccgggtccccgaaggtttcgtgctttggggccgtgcggtcggagaggtcgccggcgacggcggcggcggcgcctgcgcctcccgtggaggacgaggagaggaacggcgggtgctgggcgagcgtggctgccacgctgcgtcacctatgtcgttcttccagcaatccgctcgaaggtgagctggagacgaacgagtggaacgcaacggcgacttcgtcaccgacggtcgccgctctttcgccgccgcggccggtggcggttgggctgggagagatgaagcgccttgcttcacggcggtggccggagaccatggcagtggctgggcagggaccagtctcggcggcctgaatctggtatatcgacggatcacggtccccgaggcaaacaaccatccgttcttagtacttggaacagcatctcccgtgctaatatccagttgttaactctgaaaaaagtcatctttatcttcttctgcttgtgcatgtgtgacacttttctttattgagcaagctgctccttgtaccttgtgttgtcgtcgatgttagactagattaatcactcactggactttctacactgtagaaccattgcaatgcatcaaccaaattctcttgagatggtctcttccaaatttccaatcaggtatccaactaaagcaaatccaattaaaaaaactaaagcactaatctgaaagatcaaaaaggcatataaacatctgaaaaactaaaaagttgcaaactttatgggctcgcacgcgagactaaaaaagcccataactgagaaaaagaaactggcccaacactttgcctccgtacgatccagcggggcaactctgacacgggccgcgccaccttttttcgacttgcgggccttcctcctcctcctggcttctgcgctgccacgggcaccaaccatctgccggattcgaccgttggaattgctaccaacatcgccgcgcagcgcacgagaaaattaaaaacaaaagcccaaatctccagcgtcaccacggcacgcagtcacgcaccgccctctcggtctcggcctctccttggtgaccgttgcgcgcacagtcactcacacggcgttcaaaacgcaccacaaaacgccccactactccccgagccggtcaagccatagacgttgcccactctggtcaaggctcgagaaagcgagagagtgaaaagcgccgccgtttcgagagagaggtggttggttgctcgccgtcgctgtcgccgtcgccgtgacgaga

SEQ ID NO: 9157 - DNA, 1501 bp, Oryza sativa
ttcgcatacacgtttttcatactactaaacattgtattttttcaaaaaaaattataacaaaagttgtttcaaaaatatattaatataatttaaaattatttatacttaattaattatacattgataaaccaccacgttttctaaaatcagcatgagacccttgaccgacatgtgggcccacaaggtcaggagagtgtggccaccacgtcgacacgctggggccgtcggccacaggaggtggacgtgcggaggccatgggagctgcgtgtgcccacctcgcatgctcaaaatttgatggctgcaattcgcgaatgggttttctttcagagatgagaaaaagcgaagagagagataagggtagaggatagaatgtggcagctgcagccaatcagaggccagaggccaccacactccccctaccctctcatcccttccccccaccccccaccaaacccaacatggccatgggattcataaacattttggaaatcttgggatagtcaccttttgtttttggggcttgtagtttttggaaatttgggggaggtccaactcttgctccttttttttttcttttacaacaccgtgtttagttccaaagtttttcttcaaacttccaacttttccatcacatcaaaactttcctacacacataaacttctaacttttctgtcacatcgttccaatttcaaccaaacttccaattttgatgtgaactaaacacatcccaagtttgaatgtgaaggtgaggtcaccacgtaatgagtatttactcgcatttcgctctttggggacccataagataaaaacttaaagcaaaatacgataagttcaatctttcctagttcccacatgctgctaaattttctcggaaatttttattgtataaacttatgacaaacggtgacatgctggaacgtgatatcatctgaatccaatcaagacaataaacttctaaccaaatttgatcaatctcctggtgaaagaaatctcttcatagatctcctgatgaaagaatttaacactgaaagaaaaacaagagattcacaagagcttgagacaaagttacaaattcccccctaacacaggggcctctgaacaaaactaattttgcaatagaaaaattcagagccggcagtagaccgagccaatgcatcccactgttgcgtgggccccacacgccatggcctaaccacccctcctcttcatccccccataacctctcgctccaaagctccaaccttttcctcctcttgaccaagccaagaacaccaatccccgcatcaccaatccacacaagcttcgcagctcgcgcgccgcgggaggggagggagaaaagctcgcccccgagatttttctcctctcctctctgctcgtgtttcttggattggtccatatatccacggttcttgggggcgcggcgcgccgccattgatctggttttggttttgtgaggaggagaagttgcggtggtgctggtgctggtgctttcttgatctga

SEQ ID NO: 9158 - DNA, 1501 bp, Oryza sativa
acaattagaattgtttttattttaaaaaatgcaagtctaatttaactattacataatatatactttaattaattttttcttctcattggtgtttcgatgacatatatgtgcctatatttttacaacgtaagtagagcatagttaatatgggcagtttggttttttatccgagtgaaaaaaaagaaaataaaaagatgtcgttagcccggcctgcttatgtacatatgtacgtacttttttaccttggaatatatgtacgtaccttttttttttggaatacctactaaacgtccgtacttatgtgcacatgcacataaagattggcaatattgggttttggagataattttaattggtatgttttacaatagatctaatggttgaaaataatgggcctaccatatattaaatgaaaatcgatggctaatattttcttagaatttctataatttattagatcgccacatggcggcgtaggagcgtttctaggggtcctatgtggcggcttaggagggtttctaggaagtttaatggacttttagtatataatagaagatagatagaagatttagggcgttgcacgagttgacaaagctgaacatgtcttctcaaccgtcttcttccactctcaattaagcaacgcaagatgatggtttttgttgcttgatccgatatctgtatagttgaaaggccatgaccgctttgacgctttcggttggacagttggacgactgttcggtgaagccactcagcctctctcctctccaccacttctcgaaatgcaagggcaacacgaacacctcaccccgagctttgtgcgtcgtcgtgtgctcgctcgtgtagtcgtgcgcctagacgtggccaggattttaatctttttttccgttcgctttgtccatctcctcctctcccgtgcattgcatgcaacattcgagcttgcaggacgtgtggttaatgggcgtacgtgctcctgttgccacgacaagcactacctccatttcctcgcaaaaattgcatgtcatgtcactgcagaaaaaagagggagaagtgggaaagaacggctgcaaaagaggggcaaaactgtgtctatatatacgtggtgtcttctgaactctggtggataaaccgcccaagttagcaccttcaccagcagcagcgttcttgctcttggaaatcttctggccttcgaagattcctgcagccgtcgagcaaagaggtcagatcactattgccccagcatgattgcacactttatatatgatcgatcttgtgatggctgcagagaatcgacatcttttgcctgtccttttcgcaggaacatctactagtcggagcacggccactttggttccagggaccaaactccaaagggttgaagctgatctgcatatagcaaagtagaggtaagatggattgtggttggtccatgacattgccagtttgcgacaatgcgattaagctcaatgcctatatatttgctcattctacaagtggcttgact

SEQ ID NO: 9159 - DNA, 468 bp, Oryza sativa
ggtgaggcgggatcaggtccggcgggcggtgcagcgtggggcgtggggcgggcggcgcggcaggcggagcagtggcgtgggggcggagattagcgatttcttgctgtgcgtgggggatggcggcgccgtgggttagttccagcgggcggcgcagcgtggggatggcgcggcgcggcgatgggttaggtccgccgagcgtgcgcgttattttttttcgcaccgtctctttttttttctccgtgcgtggtgcggtttctttggatgacagatgggtcctacgcgacagtggatcagaaggattagaggattgctggatgaactcgtactttttatattaatatataaatattagtatagatatagatcatgtcctcttccaccgtcgtcaatcgtcataccacgggcagtggcaggtgaatcacgcgcgtagacacgtattcgacttgtgagttgtgaggtgtgtgagca

SEQ ID NO: 9160 - DNA, 1501 bp, Oryza sativa
cgccgcctggtggtccacgagcggcccattgacgtcagtcagagggagagcctgcacaacatgaagtcacgatgcgatctaaggggtaaaagataaagggtcatcgattacactcacgttgattgcggcttcgcgctcagccgcccctttctcgcaaagaggggtgggggtgttgctcgccgtcgtggggccactgaccatcacgtggccgacacggcgctccacggttgcgctgttcaaacctgtagatcgagaaccaaatttcgataagtcaggaggaatgcgcacgtaaggaaaggaacccagaatgcaagaaaaataccccgaggagaaacacgggtcgcgtcctccggcccagattagtcaaaggctggatgggctcgagcctggagcggctggatccgtctaccaatgaagtcggcagcgacttcatacccccgacaaccctcgtactcggaggtcatcgatgatatcgataaaagactgaagggatggggtcaaggcgggtttggcggtccaagacggaatcttgtctggttgctcctcaggaacaacaaagactggatccgaatcttctatctgaagatagaaccacctcgcccgccatttactacgagaagaggggcactggaaggggatgtatcgcgacttcaggccatcccgaagtcgaaaaccaacacacccggatacctttttaggttccatccaacgcaactcatagtaaaaacgaaagaggtcaagaaacagctctaccccaatgtaggcctcacagagatgggaaaaaatgctgaggaaggctatggagttggggttcagatggagtagagaaagaccgtagaagttcaagacgagaaggaaaaactcagaaggcggaggaagaaaaccacagagaatatagtcctcaaccgcaaccatgcggcccaggacggattcaggttaagtacctcctggttccctctccatggtcccgcgaccggggagagcgccctcctcctgcaacttcttcacggacgcactagtggaattggacttgtcgaggtccattgccgttggagatcgccggagaacaaaccgaggcaagcgagttagggtttgcgtggaagcggagaagacgaagagtatttggaggctagaaagttttcgcaacagccggactccaaaatggattcccaaaactcccttaaataggcgcactactgacggtgcgaattccaaggaaaggagatagatggccgccgaaaatttctgggtccgttgcgcgaggcggtttttggacttcaattttaattcactcataaccgttgaacttcgcatggtgttgtcgaccactccttgtctctacggttctcacaccgagatcaaccagtcgagaacgacaacaactccgacatcagaagtcgctatcggttacatgagttcatttaagcagaagtcgggggctactgtcagggttacggataaggtataccctctatccttggatgtacgctatacggcaata

SEQ ID NO: 9161 - DNA, 1501 bp, Oryza sativa
aatatagtattttcgctggcattggccaaccgccagcgtcgatccatttttgctggcggtcttcgtaaggtagccgccagcaaaaaatgaatttgcaatggcggctctgttgtatcgtccgccagcgaaaatcctgaccaacgctaaaaaaaatgacagagcgaagccgctccgcctgcctccgtcaaccataaattcacaaatccacaatttaaatccatcacatttaacaaatccatcacagttaacaaatccaccacagtttacaaatccacatatccatgacagttaacaaatccgaaaatcaacacaatttgcatcacaatttatacagccataaatttccattcactggttttcaactggatcaatccacatcacaattcagactaatcggactaactggattggatcgtcatcgctgttgtcgagagaccggccgagtaccgccaccacacgttggatctgggagaagggaggggattagaggaagccactggaaattttggggcccggccatcgtcgtcgtggcagccgccgcgactgcccctctccttcgccgcccgccgctcgtgctcctcctggtcgtagatctatcggtcacgcccctcccagccgcgcattcaccgcacgtgcccctctctgccacggctctgcccaccacgccgctccccgctgccaaatccacctcttccaccgcgaccgccctctccttcaccgcccaccgccggatccgtcccctccccgtcgcctaccgcccacgacttccgggccaccagatccgccgcccgtggcccaagtcgccgtagctccccttgccgccgtaccacgagctttgtcgctgctccccttgcggtcgaccgccacgagcttcgcccgtgctcctccctgtcgccggatccgtcttccgagcgccttgccatcgctcgcacgcctccgcgccgccgtctcctagcaccggagaggagtgggaggcgactgggtatcggaggggtcgaggggaggagaggagatggaggagagggatgcagtgggtggtgggcggtggggccgtggggggtttttaataacgccattgttttctttttgcgagaggtgctctcgatgtacgttttgctgtcggagctcattagcaaccgccagcgaaaattcaatttttgctggcggtcactaaagaggtccgcttgcaaaaagacttctatttttacaagaggtgcacttaaaccggccgctagctaagatcaattttcgctggcggtcattagcacctcatcccttgtttaattttcactggtggttttcacttatggccgctagagaaaaagaaaggttgacgctatgaaaaattgattttgtagtagtgagccagctacggtacagactctaagacacaatgtgtatatgatatgtggggccaaatattaataatgtagtatatatttataggtaactattgtataaattggctataaatgatttggagctggtaattagttggcta

SEQ ID NO: 9162 - DNA, 1501 bp, Oryza sativa
aagtggttgagaagtggacgctcctagcgcgcgtatgccccagcaattatggccacgcgtcgtcttccctttttttttcacgtttttttttcattttctctcattttctgatttttttcccgccaattagcaagttttaaatcatgatttgaaagttttaaaatctcgggttgaaagttttcaaatcttaagctgaaagttttctaaattttcaaatctggacttaaaagttttcgaatctcgagttgaaagttttcgaatccgagttgaaagttttcaaatctgggtttaaagtttttaattttgagttgaaagttttcaaatttgggttgaaagttttcaaatctgagttcaaagttcttaaatctgggttaaaagttttaaatttgagttcaaagtttttcaaatttcagatgaaaagttgaaagttttcgaaatctcggggatcgtatttctacactcattgaagcgccgaatatagtcccgcaatgattcgcctaggttctgggttagagcatgtaggtcgtcctcgatcgcgtggcgcttgtaagtccctcggaagttagcaacgaattgctgccataaatcttcccacgaagagattgagtttgccgggagatggacgaaccatgaccgggcagagccttttagcgcagccggcaaataatttgccaagacgtttcgtctgcgccagtgacatagagaactgtggagtagacttgcagaaattcttctcggtctgtacttccatcatatctctcgatcgatccaggtcggaacttctcgggccaccgcatgttgcgaagtgcgggtgtgaatgccctgcgtccgttgcctgggacagggcgtggcccatgaccgcgatgccttcgtggaggtcgatccgaagaggacgatgaagacgaagaagagggatcgcttgggtcaggagcccgagttctcaaacgatgatcacgtccacgatctcgactcggatgaggagattgggagtttcgatctcgtcggtcgtcgttattcctttcttgtctccgaggactgttttccgatcccggtcgttgtcgtcgcgtcggtcgtcacgaggtcgacggtcgcgattcccgttggagatgttccttcggccatcgtcccgctctcgtcgaagctgggagcgaggacgatgctgtcggtgcggatcgccatcctcacgacgaggagaacgatgtcggcggcactcgttctcgttgcgttctctcctgttacgccgacgtccgtttagatgttcgcgaaggtcaccatcttcatggcgcggtggtgtagggtcacatcttggaggggagcggtcgccggtacgccttccgtcggggttttcatcctccgcatctccggtaggccgctctccgtctctgttcggctttgggccgcctgcggcttcagcaaacacggtgttgaggttggtcacggtctcccgtagtcgctctgtccatcggctggcatctgggtttgttaccggatcaaaagggct

SEQ ID NO: 9163 - DNA, 1501 bp, Oryza sativa
gagtggttaatatgatgtctaaataatataaataaataaataaaacttattatgttgcatgtacctccacaagcatgtcggatcaaattctgttgatattttgagaaaacaataaaaatggatcataatctctcgagtggtctccctgttctcatatgtatatacataattattttttaaaaaaaatgacaagctttaatttcaaatttgatatccttaagttaaaaaaacaaattaaactctaaccagtatacatgtccatgtagtcatatttgtttttatgttgtagtttgtagatttcaaatttaaagcatattaatatatcttgttaatttttaatattttttataacattttagatgatatgagaaaaaaaacaaggcaaaagtatttccccgaaaataaagaatctagtaaggggtacatcataaacaaatagcaaagcaaaaatttacaggcatgttactttgtggttgtaaagttagatttcaacattcaaattttggttgcaagcagataaaaatcgtccaaatttagaataagttcaccggccatccctcaactttacaccacgattttttaaggtccttcaaccacaaaaccagaaatctccacccctaaaccatacaaaaccgctcactcaaagtctctaggcaatatatatgggtggtttcgctgacgtggcatcctaatctccatgtgtcaacgacggttgccgccaccaccaactgggcgcctgcgacgctagcgcatgcccgcgcctccccgtcgcccacccgcgccgccatgcttccccactgtgtccgtcggcgcggtgcagcgccgccctcctcctctcctgcctcgcctcgccgaccggcctacagacatatatatagagagaggaggaatggagatagagagaggaggaatggaggaactgaggagtcacctaggtgtagaaaatactttctggaggaggaaccgaggatgagaagaggggagagagaaggatgacgtggcatccttacatgtgagtctcacgctgactcagccgccacgtaagacaaaaccgggtcaaaactaccgaaggacctaatgtgatcggttttgattagttaagggacacctggttgggggacgattttgtaattcaataacaaattgagggaccttcagtgtactttttcccctcggggaatcacgtgggccctgcggccgtgaaggcccaaaccgtccgggagacgagacgcgacgcgagacgacgaaggcagataagtcgataagatcgtaagatcgcggcgaggcgcgcacacacaccagctctctctctctctctctctctctctctctctctctctctctctctctctctcttcgccgcagcgcagccaccctcacttgtcgcggccgcacggacatggcctccacctcttcctgcctcgcctcgccggccacggcggcggcggcgccccggctgcgggtgcgggtgacgccgagggcggggcgggtggtggcgtgc

SEQ ID NO: 9164 - DNA, 1501 bp, Oryza sativa
ctcgaaacttaattaacatgcatgtcgtcgctctgcttaattaagataattaagttcaactacgaactcggcaattaaacaaagtaaataagctggagagactaattactggatatcgactgcacccacgcacgcacacatgcaggccaagtcaattaatggatccgtactccatctcactctcttgatcactaacggcgacatgttcaagtagatcatagtcgtcatggcctcatggctagaaggatcgcgggagaagtcttccatacatcttgctatgtacttcgtatatatactaatccatatagctagagagcttaacaaccagtcaacagtctgggggagatatatatatatacactacatctattaaagaaaatatacccctctctgtcctaaatatttgactctgttaactttttaaacatgtttgaccattcgtcttattaaaaacttttaagaatattattaaaaacttgaatagtagtagtatatttaacaataaattaaatgataggaaaaataataattatataaattttttaataagacgaatggttaaacatgtttaaaaaagttaatggagtcaaatatttttggacggatggactactggtgtgtcatttgatcgatcagtgataagtccattcaactcgacgccagtttcatctatcgcgcatatcgattatctcaaaatacatatatcacgcattgtttatgcatgctagaatatgtgcaggtcaggtcaacggtttgttgctgacagctcaaaggaagttaattagttgtagggattttcttttcagtctggtaataatatgtagtagcagaaggtatattttgcactcctcaactttcaccaaaacttaaataacaattttcaactttctagttaaagatccgtgcattgtaacaaatgttgtaagagataaaagcaaaaactgtaagtttcagctagttgattaaagcatatattaattgatagaatatgttcgaagactccaactgattttcacaaaataaagaggcaactgtctataaaaacagtgaaaacattctaatcaggctcttaaaaatgcatagtggagactgataatcataatatcatttaaggttagtactatcaacagtaaacctattataatacacggtagccaggatcctcgctcgggtagccaggggaactacccaggacggcagcggcggtgaccaccagatctgcgccggtcccgctggatatcgggggtggcagctggcagcagtaggggtgagctgcgctgggtggcggtgtgtcacaccccaatctgataccgccgtacaacggcacctgacaggagcgtgtcgtagggaaaacggcgcgaaccgcttcctacgaaaccgcgatctcggtaccagtcccaggacatagtgctggtacccacggtgacaaatatgaatcatatcaatccttaaaataaatagaggacttatttacattaacttaggttgcagctcagacagc

SEQ ID NO: 9165 - DNA, 1501 bp, Oryza sativa
tttctcggactcccagagtccagctgcccagcagcaaagcaatcctcttccactcgggaagcctagtctatgatgcccacagacatcccgaatcacacagattcgtttctgaccactcaggtcatccatctgccacaaaggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacctagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcagtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaaccctcgacgaaaatccgataaccgcaactatacgcaaacaatcgaaaacctaaacaaaagaccaaaagaaagatcctatttagactaattagtagtgccattaaatagatctcaatttacggaattattggaagtggaacggagtcaatcggacgagcggttggggagatatggatttcctaagattatttggattttctgtctaaaggaaaaggatttatcaaatcccttggaaaagaaaaggaaggagggatgtcatttagacttactcgggcggcttaggctcggcccaaggggtcatgcgcagcgcggtcaggccattgggccggcgcgggcgcggggagagagaggccgacgcgggtggacgcggtccaccgcgcgggacccacatggcggtggttgggttcacggtgggg

SEQ ID NO: 9166 - DNA, 1501 bp, Oryza sativa
aaatctttatttttttttaaaaaagttaagcgatagaaataactttattttagatagaggaactaccaatgaatcaagtgaatgatggagtcggtgaatttaggcttaaacgtggtacgtatgcatgctgtttggccacggctgctatggctcctggccttttggggtagcgccgtaccgtacctaccttcccaaccaactccaactttgttgagcttgaacacgacccgtgcgtggacagggtttacaaatgcgatctctgttgggagtatgacacccatccaatcaactaaaaccatgagatcgaaccggttgcttttgtcaacataatccattgaagttttgcaaaacgaaatatgagttccaaagctaaccagttgtttacgtgtaaatttgtaataattagttgtaactcgtttagcaaatgataaaatgttattctattattagaaaaggttacgagtgagccgacaacgaaaacaaactggtttacgcccaaaaccaacctttttttgtttttcgattgatttgacccaataccaatctattttgtggaaatgaaaagtttcaagtaacaaaaaatagaaatattgatggaaaagtgaggcaaaattttggcataacctttgctatagttatgatatttcagattttaaacaacactgacaatgcataatgtaacatataaacccaagtgaaaacatcataacaactgtaaaaaaaagttcatccatcaacagtacagcacataaaaatttagaggcacttttctgattagaggcgatttgtaatcgcctcttaagttataaattctacaggcgggaaacacttataaacaattttaagtgtactttttatacacttcctaatttgcattatatgtaaagccattgccttgagacatttttatatctctggaagggtaccttttagcaatttaatcctggtagcgatggagtaacacaaggcatatacaaccaaataatgagaggagtgagatgaggttgagatggttattatagagaagatggaagcagatagtgaagagtgaagagttgccgataggtgggtctactctcatgggctcacacgttagagagaaacgttcctacgatgtactccctctgtcccaaattttaggacaccatctttttaaggaaaatcaaactcgttaacttttaactaataattatactaaccatatatatgctaagtattatgcatgttatatcactttatttatattttaaagtactttcatgttatgctaatttcatatttgttaggaacataacatgtaataaattaatggttaaactatgtcattgaagacagtgtaaaaaaatatagtccttataatttaggatggagggagtactgtatgttagaggagccccagtcgagtgaagatagaaataggaattgtggttttttttcctttcttttcacaaatgcatctaaagaaatattacaagacatgaaggcttattataaaacgcct

SEQ ID NO: 9167 - DNA, 1501 bp, Oryza sativa
aaaaaataagaaagaagtaaggaaagtgtgtttttaaatagatgacgttattttttatctaatgttttataattcgtcttataaaaaatataagtaatgattaaaatgtctttaatgataataaatgatactcacatgattttataaataaaacaaatgttcaaatgctatatttaaaagtcaacaatgtcatatatttaaacaaatgttgaagtattttaaatccttgtaggacatactgtaggttaagtcgaaagataaatacgaaataggagagaagtacatgacaacattaatatcctatattttcagaagaaacagtaaataggaaaataaatgaaaaccatttaaaaggttagatccaattttgtgttttgagaaaccatttttgaaaaatatttgttatatactacctcttccatcctaaaatataagaatttctaacaattataaaaccaattaagcttgaagacaaaactagctcgtagactcccaaaataactactaactcatataaatacatgggaaataaattaaagagcgccaactggcatgtttattttctagtttaatttcgagttccagacttgaagtcgcatgagtttcttcaccacttgattggttgggccaagaagttggtcagttgggctgaaagggatgggatatggcccgacaaaaaggaaaataaagacgggctaaaacctaccataggagatggtccacaggacatatgggtcccactaagtctaagccctttcggctgacttaccacaggaggtggtccataaaacacatggatgcgataaaattggttatctttgtgaatggaaaacaaaaatcagaatggactttcagttacgaatagtagtatcaaattttgcagaccactttgctcttgcccaatcaaaattagcgaaactatacaaacagaaatctcaaacaaggcatttgatttcattcacgggccatctgcaaaaggagttgacagtgctggaaggaacacaaatcaagagctagtttcagtcgttgctccctccgattcccgatcacagcaactctccctaacatcatccagcaatgacgatgcagtatcctgcaacaacagcgtgtgcacctaattagaatgcagagcacttgattcactcgaaaaggcatcgaatcctgtcatcctgagttgttctcaaaataactttgtaccaataacagaaaaaaaaatgaaaggctgtgtctcagtgaatctaatgggaatggaagcatttaccagcgaaccagagtgcgcaatcccttcctttctcttcctctcttccttcgatctcagtgattccactggagtgtaaacctgtcaaatgaaattgagaactagccatcagcatccaacagtagcacagaaaacaagcttaaatcgagctaaatcgaatccgcgggcggcacgcggacgaacgagagtacgagactgacctccggcatgccgatcagccgcatgagctccgcgacgaggcgc

SEQ ID NO: 9168 - DNA, 1501 bp, Oryza sativa
tctcttgtacatccgtggtaatgcatggacttttaacttagtgtaaaaaacctttctactcgttagaagtctcgacttagtccttattctttcaagctacttcactgaattattgtcgtgcattattttatccacttcctagaaaacattttttttccaaaaaaaacgtctacttcatttttaaatatattttccaatacagtaatatgttgaatgctctattttcaaacagaaaaaaattattttattttttgagcataagaagctgaaaagaaaattgtctagggaccaaaatgccccttccttctcttcttcttccctcacctcctccccctctttccctctcagctccctccatctctctctcccctctctctctctctctctctctctctgatctgcagagccggagcccggaggcgcggctgcggctgccaagcctcctcctcctcctccagcgcgcggccagcgagcagcctcggaggccaccgccgccgcctcctcgcccggacggcgggggagcgggcggtgctccgtccagcggagcgagcccccccaatcttggccggaatcggattgaaggtatccattcttcttctacactgtagctatctctctctctcgtcctcctcctccgcctccggttcgtggggcggccggggcgcagatgggagatcccgtccggaccggacctggattggttctttcttccctccaatttgtttcttgtcgtttggtttggatttctttctctttgagccagtaggagtttgtttcatgggagaaatgacgcattttgttcggtttcgctgcccttttcaagaaacttgtgttcaggtttggtgttgtcactctcgaagttttcttgtgaaattcatttattttttatttattttattttttgcgattagtgaacccgccaagaaatcagacgatcatcacaataatcctttttcttctaaagaatactactttttttcgctgtccgtccgcattccctttctcttttttttttttcatcactgacgacagcggcggcggcgattgggttcttgctctccggcgaatatccatcctgacatggattgatacgttttcttgccaataaacctttgcttggattgagagttctcttttgggggttcttctttctgtaagcaacctaatccgaatcaacgggcattccagtttttccagtttcttgcggatttgtttactgcttagtggagtggatgcagttgaaattaatttactgctataaaaaccataggctatccctttcacctatctggcatttacattctgcttccttgagctcatggaggcaatgtataagatgtatatatactcaacgctctgaaaaattgatgttgtgttgaatattgagtaactctggtatctagattagatgttaccatgtggctgatgcatgaacatttaatttcatcacttgcacatgcaggatcttgcgttagttactgtgctgttcgctggatgctgg

SEQ ID NO: 9169 - DNA, 1501 bp, Oryza sativa
ttgatccacctcgttgtctcgtcgggagagaggcattggtggtggggattgattaagaaccgtggtgggacggcacgctatggtacatagagctgccgccgcatttgttgggcgagttcttgatggcgggggcatagccgaacctggccattgaggaccagcacaggtgctcgccttcggcagctgcaactctcatcacgcgacgacgatatgcaacggaaatgatggagatgacaacctccgctggaatgcgcatgtggctaccgagacagccgaggaggaaccgcctccgccgcttgagctcccttgccccgccgctgtcatcctattcacgcactggtgcaggtcgaggagaagccacgcgaccgtcaaggaggcgcccaccggcggtgggcgaggaggagccgcctccgccgctcgttgcccctagacttgccgattgatagatgtggagggagaagaaagagagagatgatgaaggggtgaggaagagatatgatatatgggtcccactattttttttaagaaaatgctaactgaattgccacgcaggatcaaaaccactccgcgttgagtcggggtagggggagggttaattcgtccggtattaatagttgagggtgaaatatgtctggttttcgggtttatgagggtaattcggtctaccgtaatagttcaagggataattcattattttttcaaatattattataacattatttattatatgtcgacctcatgtgttatgatgtatttatgaacatagacatcaatagtttatttaattggagggtccaactggatcacaaattagatatatgattttaaaataatttatagataggatgtttaaagagcattgataggatattttatttttatattgtaaacgatctagtttaatgatgtatatttgcataagtttatagagtaatatattttattttaaaatagtagaatatcatattttatggagcatcgatttcttttcagtggcactacgtacctactttaattatgttttttttacttattaatcgcttttatctaagttggtatacatgttttcctttattccggtgaacggggagataagattcattgtttcttctccgtacgtacgtaagtatcggattacttacgttttgtttctttgtccggcccacaatatagatgtgaaagtacttttttaaaaaaggacatctaatctaatggtctataatattgggtcaccaatttaaataaaaatcgacggtgagattaaacagtgccatgtggcggtctaggagtatttgtagaaacgctatgtggcagtttaagagcgtttctaggaagtttaatggacttttagtatataatagatagatagatagatagatagatagatagatagatagatagatagatagatagatagatagatagatagatagatttcatgttgtttcagttgagaaagttaatttctagaatttccaaagttggtaaaaaaagtatttga

SEQ ID NO: 9170 - DNA, 1501 bp, Oryza sativa
agctcatcaccttgtggaactagccagaaaatcgattggcgtttctcagaattaaagaaataggactgttcatataattataggatggtacttaaaaaaacccaaaagacgtccctgaaattttctttaagaaaaaacttctgccgggcctgatatgtcgagtatcctaacgatcgatttggaacagggagggggtgctatgcatggatttgatgttccaaaggcctacaactacaaagatatgatcgagcagaccaaccaaacaaacaatggcgcaatcgtgactagtggtgttggatgaggcctattttatgattggtggagcaagcatgcacgcatggggcctcacctacctaaccagcaaccatctctatgtctatgtctctgtgtgtgtgtgtgtctggctgtgcatcactcacccacaggtcgcaacaaattaaaattgtttgtatatatctcatgacccatccctatccgatgcacgctttgctctgcctttgctgcttcggctgcctttgttggaaggtcatgatggaaggtgtgcagtagtatagctgctactacctctcctcttctctcctccatcgtcgttggcatttatccgtgacgtttgatcattttttttattattagaaagaattatgtacatataatttattttgttgtgatttttcattagtaaatatttgaatataacatgttttcatagttacgattgtcagggttatggataccacatatctaatagtagttaactaaatctcggcaggatccactacataccatgtcttatacggaaactgacctcgagggagttccggataaggaaagacaaccagagttctacatggaaacgacaaggactacttggattgtatccatattggtttctctagttctacttggacaagtggacacctatgggtataaatacaggccccctaggaggagaagggggacaagacaatcaacacccaacgggatcaacacccgacacgatcaacacccaacacaatcaacaaagaagcctacatacgccaagacacgccgccggatatcgacttcagggataagcacggctagtaccctacggtgtctccggatactgtcaggagagatgaaagcgctatctctgacctcgctgggcacggattcgaggaggaaggctaccctgttgtcgactacgagtcagatcgtcagaccgccatgtcgacaacagttagataggctaccccaaatattgtactggtgtgattatcatgaataagagcaataccgacttcggccaacaggatgtagggttattacctgaccgttcaggggcccgaacctgtataaaaatccctgtctccatcccttttacctcagtcttgcgtatatcctagcaccgacgatccccataccatgcaaataccagaattgcgacatcaaacgtcgacagcggcgcgccaggtaaggggattttggtgcttcaggatttcgacgagatgggttcaaaaga

SEQ ID NO: 9171 - DNA, 1501 bp, Oryza sativa
ccaacaactcctacatatttactgtaattgttattgctgctattaacaagtttacttcattaaaagtatatttattcaataagtttaatctgattttcatgttggagtaccttggtatgattgaattgctacagtttttcatgagttttctgtgaacctcagtagcgtatgtatcttggtcaagcaaccaattcacacaaaccatgctgtgtcctgaactttttcttctttttttttgtcagatctggtcgaacaaaacgaacaagtcctaattaactaattaaaccctagctacacctacgtacatttgcgttttcggcaagttaataccctctgctggaatgatttgttggaacagaaactactgaatctgggcagcagcaagaggcatttgctgtcgtcttctccaatcaaacccctgatttccctctcacgtctcttgttgttcgcattagattcttaattgaacacaaaccaatcatgcaattcatccctccctacatgtcccttgcgttgtccataacttcaaatgggttgtttgatttgcacatacgtgtcatcaaccatatggtttgtgcattaatggcccatcaatcattcggtgtattatgcaagagcgctcaatctggaccattcatctttgatacacgcgtttcctattgtgctggcacgctcgatctcaaccgttcgttggttcatccatgatacatggcctcatcttttcgcttacacttatcagcaaaaatttgaaatttcaactgtaaattggagttggttttgagattttttttatcgtactccctccgtcccataatataagggattttgagtttttgcttgagcgtttgaccactcctcttatttaaaattttttgaaattattaattattttatttgtgacttactttattgtctacagtactttaagcacaactttttattttttatatttgcaaaaaaaattgaataagacgagtggtcaaacgttgcaagcaaaaactgaaaatcccttatattataggacggagggagtagtttatttttcagtctttacttttatatcgctaagaacgtatatataaaagttttatttataaattattttttatttacatatatgtcgtttcgcttatatgcttatgatcagccaaacaatagggcggggccaacaatcaaacactaaaactcgataattattcggtgtattatgcgagcacgctcaatttggaccatccattttcaatccaacggcgcgcgatcgccacacatagcgagtagcaccacctcctctttatggacaccacatttttcctctcctataaatacccctccacacatgagcagcctcttgcaaccatcaacaagatacaccaaaaaaaaaaaaaagaaaatcatatatagtcctagctagtctcctagactcctagtcctagctgcaagaaagccacattggccatgggatcgttgggtccaagcgtggtggggctgcagcccaaggccg

SEQ ID NO: 9172 - DNA, 1501 bp, Oryza sativa
catatctatccttgagcttaatcgatatagtgaggcaaaggggttcatacaagtatacactagaggttcagccgatatgatctttatgtatgtccggtgggtcaatacgttctgctaggggccgctgttgacgcgtggaccgaaaaggagttttcgggttacagccgagtatatatgaacctatagggtcgcacgcttaatgggccggaataagggaattggatagagatccaatatgagcttaattcggataaggatccgaataggagtcctacgggccttggaggcccgagtgatggatcctatatattcgtgaggggtgtgaccggcggaggtattgcatcacgtgagaaaccctagccgttacttccctccccgagcaaaaccctagccgcgcgcgggtgctagcacatctgcgcgtggcgttccgtctctgtacgtgtggataccggtagaggcgccgctggtttgcggtgctgatcggtgcgagagtacggcgaggagaacgcacgaggaggagaaggtcgagccggtgcgatcgacgcgcgctacttcgcgagagttccttcgacttctcaacgtctttttccgctgcacagcgcgtcgagtggtagtgatctatgatctaatacttgcatggttcccggtttacgcgatagaaaattttgatttatgctatcatagcctacgcgtatcccaacagaaatgttacagcagcatggattcatgcagcatgaatttctgtcaaaaattgatcggcagggagtaaatttctcgaacagcttttgtaccaacttgaagaaaacactactacagtagtagaacaccacaaaactactatagatgctggaaatgctagaaccggcacctataacgtttttcctgtcctcctaaactctcagaggagtcaaaaataaaaatcggcacctataccggtttataaaaaaaccaacacatataatgtaagcgctggttttttaaaagacgacacaaataaaaatactatgagtgttgggttttttatttacccgctccaaatttagagccccacaagcacgcaaaaaaatcagcatggagaaaaaaaaaatcatgtttgacccatgccgtgctaccctgcccattaatctctatcccttatctcctcgttcgccccacccccgccatccctctcttccacgtctctctcgattcctccatctccctcctttccatcgcggcgagaaggaagcgacccacctctcctagccaacccaacgatagcggcgacgaacaagctgtccggtctgactcctgccgcagttgaccatggcctcggctctctttgctagatttgtcggcgacagttgtatatacgccagatcccaattcggtgtgcatcctggtgtacctatatggattgcacatggaagtcttgaaaaatgctggccaactaaaattgatcaaacatagtatatttgacttaggataaaactaaaacaacagaaatatttaatttatgata

SEQ ID NO: 9173 - DNA, 1501 bp, Oryza sativa
tatacttatgattagtgggaatatacgattgtattagactattttgtatttataaagtatattatatactacatattaagggttttagtatgtatgcaataagttgtaaagtacttatcggattggctactctcttatttattatgagcacgtttcctcgattgttctaggaatttttataaaagaaattaataccttttgataacaatatctaagtccatctaaaccattatattccttataattaaattgatatcatggactacattgtatatatttaagtgcaacgtgtgtattattagaaatatattctatataaaagctaaatctatttttggcttcataatatttaatatttaattaatcttgcactaatgacatgtgtcgtttcgtgtgtccaagataagctcagctattgagctagatcaaagtctaattaagttggagatagaagacatcgacatggtgtcaaaagaatatataagatctttaattttcaaatattatagaatagagaaaacatataatacttgaaaatacgttcatgataatttagtaatatcattttgacatattattatattttacctagggagtggaaaaatttttagaattgttagtcacaattagagttgtttttattttaaaaatgaaagcctaatttagctatcatataatctattttttattttatttatatttttcatggatgtttccatgaaatgcgcctaattagaaactctaaataacatatattttgcatagtaaatatagacagtttggttttccataataagtgagatagaaaaaaaaagaatgatgtgggcccagcgtcgtacgtacgtatcaaaatatggacgtactttttgtttttttggaatacctatatgtgcacgtacaataagagtttttagataaatttaattgtatttttataatagatttaatggttagaactaatgggtccatcggattctaaaatttattagagcgccacgtggtgatttaggagtgtttttaggggtgctatgtgacgttttaggagcgtttataggaaatttaatagacttttagtatataatagatagatagattgtacatacttcatttgatcgtaatacattcatttagaagtaatttatggtcaaagttattgtccgtcgtcgacagcgatagttattccagaatgggccgacagtactttttattgaatatagtataatgtatttggctgcattttagttcttttagctagaaaaaatattttacaaatataccctctataaaacttattgcaggtatggacccactatcttggcaccagagatgttggcgctgaggtaggatatcacagagcaacattttaacgtcgtcctctcccatttaagaactactccttttttctgcaaattttatagacttgttgtcaaatttgaaaaaaaaggacgatatatattaatgtatcgtaaattcctaatttatttccgctagtttattttta

SEQ ID NO: 9174 - DNA, 1501 bp, Oryza sativa
tcaatgtcattggcatcaagaacctatctataattattttttataaaaaagacctatttacaatacatatatttataaatagattctcagtgccgtgttattagtgtcgtgaatctatttgtaaatgcatttttaattaaatagatcctcttttattacaaataagttattttttaaaagaatttacaaaaagatcatcggcaccaataacgtgtgcaccgatcccttttacatcagcattttagcttctacgggcaagctagggatcatggcgtcaataacttgatgccctacaaaaattcatttataagtctatttataaaagaagtttttcaaaaagtctaaaatgtaaaaaaatcattcatgtaagtacgtccgacagttgatgctactagtactgttattcaacataaaataaatgattttaggctacttagggcccgtttagttcccaaaattttttcctaaaaacatcacatctaatctttggacacatgtatgaagcattaaatatagataaaaagaaaaactaattgcacagttatgggggaaatcgcgagacgaatcttttaagcctaattagtctgtgattacccataattactatagtaacccacatgtgctaatgacggcttaattagtctcataagattcgtctcgcggtttaccgacgagttctgaaattagttttttcattcgtgtacgaaaaccccttccgacatccggtcaaacgttcaatgtgacatccaaaaattttcttttccccaactaaacacacccttaccccttaaacagactaatctaaaaattcgctcttataaaaaatttgaataagatgctaatcaggtagtagaatggcataatcggaggaaggactaattgtagtaagctgcaaaacccggcgacgttgtagctcgaggaacatctgatccaagaaaacggtagtagcaggttaattaacccaataatctgggcagatcttctatttctatttctattatatactaaaagtccattaaacttcctacaaacactcctaaaccgccatgtggctcctacaaacactcctataccgccatgtggcgctctaacaaattatagaaattctaagaaaacaataaaaatccgaccatcgattttcacttaatacggtggacccattgtttcacaccattagatatctatcttataacaggaaaaaaaaaatcacaaaacccatccgtatcccctccatcacgtacataacgtacgtacgtcccccaccttctctctctttctttccatttatttataggtagcaaatttttatgttaaaatattaatattaaataattagaatttcttataatatatttgattttaattatgccatgtgttggagtgttttatatatatatatatatatatatatatatatatatatatatgtatatgtatatatatatgtatatatatatatatgtatatgtatatgtatatgtatatatatatgtatatgtat

SEQ ID NO: 9175 - DNA, 196 bp, Oryza sativa
ctcatcagactatactcaacggtgcactgcaaagtcttctttattgccaatgattgtaactgaatcatctttgccaggagacaccggaggaggaatgacggaatgttcgctccaaaactcctataaatacagctccccgagctgcagctcagagcacacagaacttcacagcagcagcacagtgcaatattgcaaa

SEQ ID NO: 9176 - DNA, 432 bp, Oryza sativa
ggctttgtgggataggtctatcggaaaggaaggttgtcactttgatgtagccgtatttgatgcattatccctcaaatcttaaaatgaaaaaggctataaatatcatagtagtgtttcattatatatttcagtaggttgccctatttctatggtatatcccctcccccattagtttgaccttttagaataaatgctgtcaaactttgctcattattatgttgggttctatcttggtgatgaaagcattattaataaattggttattgaaaataatactatgaaaggtatatatttaaccataaattattaagaattaatgattaaaaattgcatcttgaggcccgcagcccacacatgaaactatatccatagccgttatggtttgcctttcagctagtgcatgttttaacgttgattgttttcgcaccgcag

SEQ ID NO: 9177 - DNA, 933 bp, Oryza sativa
atcgattcctgcagcgttttttaactgcaattcggaattaaatattatgtaatattgaaataagagtacatataagaatccaatagtagattaattaaatttttgaataaaaaaaataaaataaaatctaaaattagacaaattaaaaagagagtacaagtaggaatacaaatttgaaacaactgaaatttaaaataaaaaataataaaaatattaaaagaacacaatacgatatcagttaaaattcgaaacaaaagataaaataaattctgaaatttgaaaaagaaagataagatttcaactaggaatacaatttataaataactaaaattggtgataaaaaataaagactattgaaagaaaaagactatctaaaacatacgacgagattaattaagtaataggcctataaaggcgtagagtggtggcggttgaagggacatctaagaactattaataaatcaccaaatgacaattaaaaggaaggatgacgggcaggtcatgaagcaaccggtcaaggcggttggcaagacttctagaaagtaaaaataaaaaaaaaccctaatgataatcatatttgatttttaaaatctgaacgacaataaaaatgagaggcagcgggcgggtcgtacaggagtacaatggcggcgggcagagccgccgatggttgatgggacttctagaaagtaaaaaaataaattcaaacgatagttatgttcgatttttacaatcccaataacaataaagagtaggcggccggcgggttgtagaggagtacagtggcaacgtttgacgagatttctaaaaattataaaaacctgaaacccaaagacaataagttctaaaaattataaggtccgatttttaaggtttgtgcttctaaaagtaaaaaaaaaaacccaatgataattatgtttgattttaaaatctcaa

SEQ ID NO: 9178 - DNA, 1501 bp, Oryza sativa
ttcaaaagtataagttatatttgtagtcactatatggtatattaaattttttaggagagcccaagaagtcattttagtacttattggttacatgttcatcgattttatcacatgatgaatgaattaattacaaattagtcttgatgaaaaaaaataggtattaaacttttggatagaggaagaacaatcgaccaaacaagatctcacatcataagtcatccaactaaccaaacattagagaagagtgcagtattacaccactataatctccgtccctaaatataagcgattttggttggaggtgagagcatctccaacagtctctctaaatgtcactctccaaatatctatttggccaactctccatctaatttagctagtcaaactctcttttactccaacaggcttccaattcatcctctctatgcttatgctgagtctatgataatagagcccacgtgtcagtctctacgactttcttcttcctccacttctctcaaaatccccttccctctcccctctgttgccgccgccccatccctatccgcccgccgccgatgctcgggctccgtccaccggtgcccctctggccaagctcttaccggccgcctcatctccctcaacctcgccgtcgagcaatgccgtcactgccactccctcccatctccaacccacccagcggatgaggaggcggtgcctcgagtcgagggggcacgtggatggggagccggcggcggcgacgctattttcatgcgacgatggccggcaccaggccgctagacgacgacgaggatgggcgcatgaggcaacgacgggatccgctccccgccggccttcctcgttcctccctcgtcggctcgccgtcgagctaccccgtcgccctcatcatgccgccgatggccgacgccgaagaaggactcatgcgccgtcaagccgccccgtcgaccccgacgccaccgatggcctcgccatttcgccgtcgcgccctcgactccaaatgccgctgccgtcgcctccgaacgccgccagcgcgcggcgaagccgctcgtcgccccgatccatctcccctcgcggtgcgtgttttgggaggaggaatgcccgtggggctcaccgttagccaatcactttggctggtcaaatttggctaagggagggagtgttttggccagccggccatccagttggagaggcttttggatgagtaatttttgctagagtagctagcagaggtatttggagaggctgttggagatgctctaacacatcctagtacaacatcctggtataacgaatctaacatgagtgtccagatttattgtaataggacatggcacgtccaaccaaaatcttggatggagggagtagtgtagagctggccaaatgggccgggccaaacgggcggcccggggcacggccgttcctgtagcaggcacggcccggcacggcctgctacagtaacgggccgtgccggcacggcccgtgtagccgtgccgtgcttggg

SEQ ID NO: 9179 - DNA, 1501 bp, Oryza sativa
ccgctgggtgggttggagatgggagggagtggcagtgacggcattgctcgacggcgaggttgagggagatgaggcggccggtaagagcttggccagaggggcaccggtggacggagcccgagcatcggcggcgggcggatagggatggggcggcggcaacagaggggagagggaaggggattttgagagaagtggaggaagaagaaagtcgtagagactgacacgtgggctctattatcatagactcagcataagcatagagaggatgaattggaagcctgttggagtaaaagagagtttgactagctaaattagatggagagttggccaaatagatatttggagagtgacatttagagagactgttggagatgctctcacctccaaccaaaatcgcttatatttagggacggagattatagtggtgtaatactgcactcttctctaatgtttggttagttggatgacttatgatgtgagatcttgtttggtcgattgttcttcctctatccaaaagtttaatacctattttttttcatcaagactaatttgtaattaattcattcatcatgtgataaaatcgatgaacatgtaaccaataagtactaaaatgacttcttgggctctcctaaaaaatttaatataccatatagtgactacaaatataacttatacttttgaaaaaaccaatgaatgaaatagaacttagacttttggatggaggaagtacttacaaatgctgcatactgcctctattccaaataaatgaatcagtgtctagattcattgtactagaatgaaatagaacttagactttgctacatactccctccgtcctaaataaatgaatcagtgtcaagatttgttgtactaggatgtgtcacatctagaactaggttggttttttattggacggagggaataccagagatattctttgattgttcgtatcagatcatagtatggttacctcctcttttgtagggtgagattaccccagcaattatggtgtactattcaattgcagttctattacttttcaattagccaaattttgttaaaatctgttgcatatgtaatgggtgaaaatcagtatgaagaattatataaaacaatgaattgtgctgcaacgataaataattcgctgcttagtctgaactttatatacgctataacatgtgagagaaaatgaaaaaaaaacagagaaaacgatagaaaagaaaaaaaatgtgcatctcgtcgtcgtcgtcattgtggagattatgggtatcccatacccacacggcatggttatccgactagtcatagggatagcttatatttatggaatatgtaacaaatcatgacttgggtattccgtttccatgtatattatggaacgacctaaagttctggtttgataatagatttaggaaaccgataccgtattggttaaggtttctatcttgtaatcctggccccccatcctatataaggtgggcaggaggccctctagggggca

SEQ ID NO: 9180 - DNA, 1501 bp, Oryza sativa
cccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactgctgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaaccccttttttttcatctgcatatgcctttttgcacctggaattgttttgggaaaatttggagttttgcctctttggtttgcgggaaaaatcttggtcgttctttcagatcggatttttttttaaaaaaaattagctcagtctagggctttagaaaaattttagttggagtttattcgacagtcagtcgggaatttattgggggttatgcattaggtcgtgtctatatccgatgggggcaatgttatgcgcatcattttccatgcaactagtctatgcattaatttactgtttagttgcattagtgtctttatttgagttcatgaaaaatgttctatgcataaaaatcatcatgctcggttacttatttgagtcttcttttgctttgtttaatttggatttgagcatgaattggttcctatcccttgtctactttagatgtcagtcctatccctcttttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 9181 - DNA, 1501 bp, Oryza sativa
tagcattttaaattttatgcacaattttagaaacgttaggagtatatttttgtcattttggttgctaagctcttcgtgtagaaccgttaaagaccagaagcggaattttttttggttgttttgttcgcgtgtcttggccgtacgcaagtcatcctgaaaattcttaaacccgggcgactggcgcggaggagcccgatcaggcgctccccctgcgactatgcgagcccctcccccacgcgctgcatgcaggccctccgcgtctttgctcctatctgtcattgcaacaaatcacccacatattttggaaaccctctattaaggtaatttggtttattttttgttcaaccaaaaatgtttcacctagtgtactcacaatgtttcactatgtatagatctaatattgcagtgaactgaaatattccattgcaacaaaaaaacccacatattttggaaaccccctattaagagaattcggttcattttttgttccaccgaaaaatgtttcacctagtgtacttataatatttcaccatgtatggatcaaatgttgcagtgaactgaaatattctttcactatttgctgaaacattgtttttatataaggtaaaacaatacccgatttaaacgagtgaaacattttcgatctactcagtaaaacaattccgatatacctggtgaaacatcgtgcaacatttaaaaataattcaataataatttttaaaaaaatcgtcggaatatatccatatgtgattttgttttgaagatttaattgcaacgaatgtaatggtaatcggatcatgatttggataagtaatttaagagaaaaatcagtttaaaagtagttttgcacgtaaatcggacgctgacatcagcatccagtttttctccaaatcgatcgggagcccgacctgtagactcgtccaagtcatcctattaaaaacaagtaaagttgagtatcgtaaatttgttgtactaaaaacactatcattgctattggtcaaaccgactcagtgccaacaactactacctctgtttgagattacaaatattttggctttggcgtaaaactacaattaaatttatatttaaatattagtttatctacaacaacaaattattttcattaaatttataattaaatatatttttatcgtgtatattgtgttgaatatgttattatttttttaataaactttggtcaaacttaaggctgtttgactttgagcaaaatcaaaatgacttataatctaaaacggagggattttcttaaaaaaaattgaatcgtgccattatatatatatatgggatgtgcttcgactagtttttttcataccgtattttcttataaaccaaaatatcgctcgctatttcttctctccacctcgatgacttgtgtgccctagcatcatcccttgcgtctctcctgttcgcctggatctggtggtgatgaggaccaatacgtaaacaagaaaccttcaagtagagcacaatatttcaacaa

SEQ ID NO: 9182 - DNA, 779 bp, Oryza sativa
tggtttccgtgtccaacgtttgaccgttcgtcctatttgaaaaaaatatgaaaaaaaattaaaaagacaagtcacatataaaatattaatcatgttttatcatctaacaataatgaaaatacgaattataaaaaaatttcatataagacggacagtcaaaattggacacggaaacctagggtttgcctttttttgggacggagggagtagaccttaagatttgtcccaaaatataacaatttctctaccaacattctcttcccaaccaatcacaaccctctactattcgcttttttcatctacctccaccactcatccaattacaaccctccatcgttcacttctacctactttcttaataaccgtgtccaactctaaaactttttatatttagggaccgatggagtactaatactcctcccgaaatttaggggccatttggatgagtccctgtcacatcggatgtttggacactaattagaagtattaaatgtagactaatgataaaacccatctcagaactctagactaattcgtgagacaaattcattgagcctaattaatccatgattaacctatgtgatgctataataaatatgtgctaattataaattaattaggcttaaaaaatgtgtctcgcaaattagctcacacttatgcaattaattttaatattaatttatatttaataattttaattagtattaaacatctaatataacatggacttaaaatttagtcactatatcaaaacaccacgcttaaaattcaagtggttc

SEQ ID NO: 9183 - DNA, 263 bp, Oryza sativa
ttttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaaaatttgataactattgatatttataaaaaatataaagcacagtataaaatcgccctcccccagg

SEQ ID NO: 9184 - DNA, 1501 bp, Oryza sativa
aatacaggtgatggtgaagtcatttttgaggttgatactgatgttgatagtatgtttcatgttgtgcaatttctcgtgtaagtgagatgtgattctaatttctacttcctctgttgtaaaatataataacttttatctatgtatctgcacaaagatatgttgaggtacttaacagattagtatgactactggacgtaagatatatttttgttttgcactgagaccacacagttcgaaacacactgtgaaactatgaacatcaccttgtcccttagactttacttattacactctcttctaagtttatggtgtattgttcttgatccactgaaacattggctcttcattttgtacagtttgttaaatcctatgagactaattgaaaatcatattggctggggcaatgcccagagttttggctagctaacctcccacatatataaattaaagagattaacattaaagacaagaagactataattccacttaattatttaaataagaggcatgtgtatgggtgtgtaaagacggttgggttaggtaagactgggtgagaaataaatgacaagtggatatatagctaggaaaaataatactcttgagccctctaatatcttggaacattttttttaaacatggtacagacgcatacgcgtacatggacaccctacccttataataagcatctttggaaggctgagctagcacgtctggagattgatgaagttactactaacgactcgctgttgacggaacatcgttcatcgctgaaagaataattagccgtaaatacgagaacatgtgtctagtctaggccttgaatctgggtgagctagtttcatgatttcatcacaaagaacctaaccagttcagctacactcatttcacttggaacaaattttgaatgtcacgatttgggacggaggggagtaaatattcagtggttacaaaatttagatatttattataacaattaatttgagttggaatattgaaaaagggttgtcaatttcttagtttactttttttttcttatatctattaatcatttcctcagcaaaacaagtagaatatttgttaatttttttaacttatactacacaacgaatatggaccgttcttgcttcttttatatatgcatttgagtgaagtcatgacaatttaactactccatctgtttctgaatatttgacgccgttgactttttaaaatatgtttgaccgtttatcttatttaaaaaatttaagtaattattaatttttttcctatcatttgatttattgttaaatatacttatatgtatacatatagttttacatatttcacaaaagtttttgaataagacgaacggtcaaacatgtgctaaaaagtaaacggtgtcatatttagaaagggagggagtataatatttttatgtgcatttctgttcagtaaactgcatttgtacgctttgtaattataaacttcaaattatgtctagtcgcaccgatatatacaactt

SEQ ID NO: 9185 - DNA, 1501 bp, Oryza sativa
atcaagcatactggcaaaggtacccgcctttattggcaagtaaacctagagaaaagcacactcacctcaaatgaggaaaaaaaagattatagtttccatactggtttagtagcattcattcacatagctaaacatgtaaacaggaccaatttcactaggaaatattgtatcatggctgagacaatttctttttacacaaaatcaggaacatttctgatttgtatttcaccactgtactcttcttattgatgtggggagtatttccttttttacaaaagaaaaagaatcagatggtgttcctaataagcgcctagactaattcaagggtttgcatttagcagttgatttaactgtagcagcaacacggtaagaacatttgttgcaagttagtatctgtaccttcatgaagagtgcaccacgttcatgctgcaacctgcaagtggactttcatttctacctgatttggttcccatatccatgttgatttggtgtcgacacctgatagatatttctatcgatgtaattgtgatggtataccgacacaagttgtggtatataattcttcctgctttgctttctcctaatcttagtgcaacgatgcacaattcttctatgtattcccaaaaaacaattctttctgctttttcttccgcgtcgaatttcctccattggaataagttttctgtctttctgaaagtccacggatttatgcacgatacctctagcaataacttatcagttccatctagcagtaactggaaactagatgtcaaaagaaaagctcaatggccggacaataagtttgtttatgattattccttgcattttatctaaggttgtcccatacggagttgcaccaatttgtgggcagaaggcagtgggcattagtactccatgcaataagcatagaaatgcttggtggacacaaaatgagattaaaaaagacaggaaacaacatttatatattatggttccctctccactgccaaagatgcatcatgataaatctgtgtgcaatataaatcgatcgccttagtttgcttgcatgggaactttaggcatctgtcaccatgtgtgtatctctgtgtgcaaggtttgtcagcattgcataggattcttagctccagagaaaaatgcctcaaatcctttttatcctgcccatcccttgagcattccagactcaagatgctcatcccatgacagcttgcagcgagcacagtgcgaaaagccgcactgtcctgcgatgcagattcaagggattgtccgacatatattccctcttcagagcttcactataaatacagaccaactggggttgtgcacttcatactcttcgataaattcagtgcatacacaactagttctataccttagcagcatcagtaaacagagcacttggtgcagaaaacatcatgagctattatggaagcagctcttctggtaatctgactactccattctaacctcaagtcctcatgataaccacaggtgccaaagaaca

SEQ ID NO: 9186 - DNA, 1501 bp, Oryza sativa
tgagcacgagcgtgaaagtgtgggcggtcggtgcaattccatacttggtcttcatctcctcgaacagctgcagcgcaacgtccccgagcccgttcaccgcgtagccatcgatcatgatgtgccaggagtccatgttccggtcaggcatatggtcgaacgtcctgcgggcgtggttcatggcggcgcacttggcgtacatctcgagcatcttgttgttgacctggaggtcggcgcggaagggcgagcggaggaagaagtcgtggatctttctgagctcctcgagcagcttggggttggagcaagccgcggcgagctcgtagaaggcctgcgggtcggcgcgcgcccccttgtcgagcttctccaccgcctccttgactcgcccctcccgtccgagcccgatcagctcccctggccccaccacagcctcccgctgctgctgctgctgctgcggcggcggcggcggtggcccgtagtcgttgcgcggcggcggcggcgcctgtggctgcggagggccgtagttgtagcgaggctgatgctgcggggggccgtagtagtggcgcgcagggggaggggcctgctgctggtggtagtttccgggaggagaccactggggaggaggtccttgcggcggcggaggcggaggcggaggcgatggctgccactgctgctggtgggggtggtggagatggttgggggaggcggaaggggggtaggagtaggagagggggcgggagaggaggtggaggagggagcgggacctggaggaggagaaggcgacggagcggaggagcgggcggcggatggcggcggcggcggcggccatggcggcggcggtggcggcggcggcgaggtaggaaggggaaggcggcggctagggcgatgtgggggtttaagcggaggagatatttccgccacagtggaggcgaaatggcgaatgcgatgggattagtgggctttctgggcccatttagagggaggcccatctatcgctggtcctggctagttagtttttttttctttttttttcgaaaaacaagctttaaacgataaacatgataaacaagctttaaaacgcaccctagtcggtagtattgtccttcaattacaacctggtaaaacccatccatcaactatagtacaatgagatagattaatactgcacgtactaaaaaattcttataaaacttttaccaaacaaagatcttagccatttgatttattcaagtcaagatgcaatcatagtgtaccacatcagttttttaaaaaattttgtaagaatttgtttgtacttgtatcattttccaaccaaataaatcgaccaatttgattgatattttgaactacatagggcgtataacctgcttgtcgtagagaacaagctttctcatctatggacaatcattctccattatatattacacaaattatcatatattcatatgataattatcatatattcatatattcatatggctgtaccattcgtatgacaggtttagca

SEQ ID NO: 9187 - DNA, 1501 bp, Oryza sativa
gccgatagagttagatcttgttattaatctagattatacagcacatctaccatcttttagaggttttcatcatcttgcttagatcttacatttatctttacgcttaatgctgcatcggttaagttcgatctattaagtattatctataactataatatctagcttgttttatgattatcaattgagatagtgtcggagttttagccgatatttcctgatttagcatcttttgccttcatatgcttgattgttatgctaaatctgccctttgtattaagatctcatcgcaccagagtatattaggctttcttgtttgatatattttgcttattttaatatcttagtataaagtggtatcggagtattagccgatacatgctagatctatctgatcggctatgctataaatgcctatataatcattgcttttatgtatcttttgacttgagtgatttatactatctcggcatggcgaccgatctatcccaatcacttagtttaaacatacatcgaaggaaagattatatatcactaatatctacagccgatcgagtagatttagtcttatcttattcattcattactgccgatcgattccaacatgacatcggcttgaagataaatgatatgtcatcggcaactaaccgatcggctatcgtttatggatttgaccgtggttttttcttgtctttctttcttgttgaatgcaggatcaaatcgccttgaacctaaaagcacgatttaggacctgcacaggagttaagcagatcttccaggccagtgtgtgtttttcgcatcaacacgcttttggcacgcccagtggggcacgagttgagcgatttttcatcatgtcgggcggcaagcaaaatcccccggctaccaagcaagcgtccgatcaaccagcggaggttgacgttgagaacatcatcccaatcacttaatggcaagtacttgaagaaatcttacacaagtgtatggattaattcatgatcggctgatttttgccaatacatgctagccgatgtgatgatatcgcctttagatggccgatatggattatatcgcccttagtggttttttcttatcataattggttgtggtttgccgatgtatgatgcccgatatgattatatcgcccttagtggctttttcttatcataatcggttgtggtttgccgatgtatgatggccaatatgattatatcgcccttagtgtttttttcttatcataatcggttgtggtttgccaatgtatgatggccgatatttgatatatcgcccttagactaaattataattttatgaatgacttcagcattgcaaaattaggggggcaaatatatatgaaacgtggatttcaaaaacaaaatttaaaggaaattcgcgacaattctaaacttgaagttctttacagcccaaaagtttacaaatttaaagttgaagttacaagattagctcatccagacacatatttttggatggccgatattgccctctgcct

SEQ ID NO: 9188 - DNA, 1501 bp, Oryza sativa
ctcctgcctcgtccttcctctcgttcgccgacgacggcacgaccgctagggtcggcagccgtgcactccacctccacctccgctgcgtgctcccctccctgcgtcggcgccctcttcctcctcgccgcggccttcccagcccaccacgtcctctctggcttcatgtaacatcccggcccagggcttaataggattaatagaatactcatatcaacaggttgcaacttcttttccggaagctggtcttcaaagaattatgaggttaagcgtacttggtctggagtaatttgagataggtgacagaccggtaaattcttcccgggtgcacacgagtgaggacaaagtgtgcagaaaagacttgtgaggacagtttatgacctataaaaggtatggaagctactagatttaagtgggtccggtctaagaaagacaggatgatcacacttcatccccaccacccagcagaacggcgccaccaccagcaccatcgacctctccttcgacgagagccgccgccgcatctcaccccccccttcccccccccaccctgttgacgcgggggggggggggggggcgtgttgtgttcgggtgggtgctgcgcaggctgctgtacaggagcaagcagcgggggttcttggagctggcctcatacaagcagcgaggacgacggcaagccagacctcggcgtcaccagcaccggcggtggctgattactgctgctgcttcaccatgtcctctcttgcagtagcctgtctaggtctgttcttttttcctatcatctcttcttttttaaaaaaaaatgaaaagggcaaagacttgtaatttgtaacctgtaatgtagtagtaccaaccatcgagggctggactggaacaatcttaataaaataacatcaattagcacgacattgcagcatcagacatttagaatttcagatgcatggagcaaaatttattcagatgtttaaacacatcaagggcatatcgcaaggataaatctattaaaaatcctatttgttcagatataggactacctttcttcagagggagggaaactgcattagttctcccaaactgatcaaactgggaagttctcttggcctttttctcatgcagatgaaagaagattgtgatacttttttcatgtgcagatttcttggcttatctaactctggatctctgcatgctgacgaggttagcaggtcgctcaagtaactgagcatggagatgaagaccgacaaagtatgcttcagagaaaagattctttgaaaattctgtctttttttaatacgagtctgcacaactttctttaccccgtttatgttccaaagttcttcataaccactttatcatacatcccaagaaaaaataaacatacatactgatgattgccttgaaaaaacttacttactgaataatatttacatgtatatgcattctggattagtcctgttgctaaaaatggccacttagaaaacgtttttgacaagaacatgccaattag

SEQ ID NO: 9189 - DNA, 1501 bp, Oryza sativa
aaaataaaaagaaaaaaaagaaaaagaaaaggggaccatctggtaacatcaaccgggactaaagagagaggatctttagtcccggttagtagtaccaaccaggactaaagatgcatctttagtcccggttatttcaaccgggactaaagatggacatctttagtcccggatcgttacttccggttggaaaaccggactaaagaggattcccaaccgggagtaaagatggtttctctaccagtgaatgctttcataccaatcaaccaatcagaacaatctgaccttagcttctatctcaattcgaggggacgcctctcaaccatacacagatgcatgtactccctccatccacaaaagttacacctattagagcaagtataatagtgagctataagcctactatatgcttttgtggagaagagaggtaacaaaaacttaagggggttggttctcatgcaagagctatcttaacacaatctccgagataaatacattaaatttataagtgagagatagagagaggaaaagaaaattgtagccaaccatatagctaatctattatatgtgttggttttaagattggctaatagtaggaagtaagctatactattatgcttgctcttacatttgtcaccaagacaaaaaaaaaataaatcatcttgtatgttataaaatcaaggagtgaatgcaatcatgcaaccaaaaagtatttagatgactccttgggttctaatcaaacatttaatttatctcctaatttaaatcttgaatgcataaagactataaatagaaacaacttatttgtaaaaactaaaatgtgaaatatgtctatcttttatatggatggaggaagtattgttttcgttagtctatctgtctggcttcttctttctataaacttaattacttcttcatatttctggcttcttctttctgtaaacttaattacttcttcctctgggacaccatcttctgccggctagatgccacacaaataaagtacaattcatcgaatattgactccaggatctgctgtcagctgttgcatggatgcattcaacaacacaaatgcacaatccatcgaagttaattccagggttctagtttctctaacctttgccgtccatatatacagcttcagatcatgctgttttagcttccaggattttgttaatggcgaaggatgtcgtcatggccacttctcgggtcaggacagagataaattagtgagatgatatttacgaatatagatcagaaacttgcatgatgagataggtatatggttatgtattgtttagatgggctctagatggggtttaaaattggatagagatagaccgctttaaaggtgttatgttcgatttgatttatgaccaacggtgaagattatcctatctatttaatcaaaggacacattttcctacttaacgtgggactcgtagaaagtgacctagtatagctattcatatagatggtatatattgggaggtatgtctctact

SEQ ID NO: 9190 - DNA, 772 bp, Oryza sativa
ttactcgttcgtgtgagaacggatgccatcattcgatcggacttacagatggaaaattgatgtgacgaacggaaagtaacaaattatgtaagtaggtatatgatatgtgcaatcctttcgtacgctatacaattatatgtggtgcgagcctttctaatgtggcacacatgtatataaggcctaatttatagtctgtatttgtatttgtcacggttattcgtcgaatctctactattataaaaatggaagatatttttgccggtactttagtacgtcatccgtatttgaacatgcttttaagttacttgcttttggaaatatagatccgtgtttgggttggtttttaagttcattcgctttttgaaatacgaaagaagtcatataagaaatctcttaaaaaaactcgcatgctaacttgagactatatatagcacttctaattgaagctcatgattttgttaaaaaaaatatccaagcgaattcccacagcaaacttcaccttagctaaaccgtctaataataataagattaaaatggcttcacccgtcgcaatgcacgggtatttttttagtcaacaaatatacatgaaaaggttgccgacaccgcctgcgtggcatctcggccgaaaacttcccacctgcagcacagccgcactccaccacagtgctgtctcctttcaactcggaagctctaggcggagctaagcacaaacccaaggtcatcgtcgcctcccgctacctcttgtttcctccttcaaatccacttccctagc

SEQ ID NO: 9191 - DNA, 301 bp, Oryza sativa
tgtaaatatgatacaatatatgtcatacttaaaaaaggctatttatataatttttctgaatccaacaaatagtaaaataccatgtaaaatgtcgaacacttttatacgttaaaaacgaagcaattacttctaatagctactcgcctactgcaacttcctcacgtaaaaaattagtcagtccaataggtataatgtataattgattggtagatatataatccagagattaaaggtggtgtttacatccagggacttaactttagtccctgtctttagacactaatttagagtattaaatata

SEQ ID NO: 9192 - DNA, 701 bp, Oryza sativa
tgtaaatatgatacaatatatgtcatacttaaaaaaggctatttatataatttttctgaatccaacaaatagtaaaataccatgtaaaatgtcgaacacttttatacgttaaaaacgaagcaattacttctaatagctactcgcctactgcaacttcctcacgtaaaaaattagtcagtccaataggtataatgtataattgattggtagatatataatccagagattaaaggtggtgtttacatccagggacttaactttagtccctgtctttagacactaatttagagtattaaatatagactacttacaaaactaattacataaataaaagctaattcacgagacaaattttttaagcctaattaatctataattagagaatgtttactgtagcatcacatagaatgtttactgttagaggttgtttggatggtgactatactttcccataactttggtaagctattttgaccatcttagtgtgtttgcttggttgccacatttttatcatgtcacactttttgattttatgatcccacttattatagacacatatctttaccaacactttagctatagaactttgataaactgaagcaagcatccaaacagcccctaacaccaacatatttctgactataatatgtcttttcttctattccttttattttttgtaacttattttcttgggtataaga

SEQ ID NO: 9193 - DNA, 1501 bp, Oryza sativa
tgaatcatatcacggtggaaaccaaagctgctgcataaggagacaagtaagcgggtgagccgacgagggggagaccttggaggagggcgcggcgaggggcgtcccgcggaggttgcggagggagaagagcgcccggaagcgctcggcgatgggctgcgccgcgtcgagcaggcggtcgcagaggaacccctccatctccggggtcgcgccgaacgccgcagatgcctcctcctcctccgtcgccgccggtgagccaatcgagtccgccggcgagcgaggtggtcactccggcggcggcggcggcggcggcggcggcggcgagggaatcccgcgtcccaaaggggaaaagaacgcttcgccttcggccgaggaaaaaaagagaagcccatgaaacccactagaaatggaggcccatgaatgatgcatatgcgttgctatgtgggccttggccatatcaaaaatgggctacagtgctacggaattctttaaatttttttgtttttacttattaaaatattttaaacaaataacttttggtttcaaagttttaaaaatctacaaccctaacgctttttgggagtgcgtttttaaaaaataacgtggcacacggttattggctcatgctaaccgccgcatgaagagtggtcgaccattttgttggcaacccccttctcgctctctcggaaggctacaagcgattcgcctgtaaaataatcagggttagccatttataggcaaccccttaacgtcatcctagagggctataaggagaccgtctgcaaaatattgtaggtcgctattttagagggtgggggttgcccgtgaagtgccacttttcttcctcatgaccattacaatatatcaatggacatgtgtcacgttataaaaaaaattatttggagggcgctttttttttggaaaaaaactcctaaagaacggtaaggggttgatttgtaatactttaaaaccaaaaaactatttttatatattttaataaataaaattaaaagttaaaaaaaatccccgtactacgtgcgggcgtacgggtcagttcgttgaggtgtccatatccatttgcttcgctagcttccaacaaagaagtgctgtgtgtatccatggcgcctttctctttatcacaatcatttctgtgtgtgtttttggacgtgagtgtgtggtcacattttgtcaacattattttcttaagaactagtaagaactcttatttacatattaatattcatctttttaagtactccatccgtttcacattttacatttgtcctaaatcacacgtcttatctttatcttttgaccatcaatttttagaaatccatgtagttcaacaagtaaattatatatcatgaaatatttctcatgacactaaactatttgagttttaagaaattattgatgatacaaattagaacgtttgattcagtatatagatctagaatgatttgaaacagaaggaatagttaaattggacatgcgtaaaaatcac

SEQ ID NO: 9194 - DNA, 1501 bp, Oryza sativa
gtgggggcatagatgcaattatcccttttgattacacaacgtaaacgaccagaaaaccattgccaggggacaagaagaaaattggaaaggaaaagactgtaaaaggaagaaaaaccctccttaaagaaaaaaaaactcctattaattatttttttacataccactatcttataatcctcataaaattttagtgtagcagaaattaatttcagagaaacgtatttatccatgtgatttttacgcatgtccaatttaactattccttctgtttcaaatcattctagatctatatactgaatcaaacgttctaatttgtatcatcaataatttcttaaaactcaaatagtttagtgtcatgagaaatatttcatgatatataatttacttgttgaactacatggatttctaaaaattgatggtcaaaagataaagataagacgtgtgatttaggacaaatgtaaaatgtgaaacggatggagtacttaaaaagatgaatattaatatgtaaataagagttcttactagttcttaagaaaataatgttgacaaaatgtgaccacacactcacgtccaaaaacacacacagaaatgattgtgataaagagaaaggcgccatggatacacacagcacttctttgttggaagctagcgaagcaaatggatatggacacctcaacgaactgacccgtacgcccgcacgtagtacggggattttttttaacttttaattttatttattaaaatatataaaaatagttttttggttttaaagtattacaaatcaaccccttaccgttctttaggagtttttttccaaaaaaaaagcgccctccaaataattttttttataacgtgacacatgtccattgatatattgtaatggtcatgaggaagaaaagtggcacttcacgggcaacccccaccctctaaaatagcgacctacaatattttgcagacggtctccttatagccctctaggatgacgttaaggggttgcctataaatggctaaccctgattattttacaggcgaatcgcttgtagccttccgagagagcgagaagggggttgccaacaaaatggtcgaccactcttcatgcggcggttagcatgagccaataaccgtgtgccacgttattttttaaaaacgcactcccaaaaagcgttagggttgtagatttttaaaactttgaaaccaaaagttatttgtttaaaatattttaataagtaaaaacaaaaaaatttaaagaattccgtagcactgtagcccatttttgatatggccaaggcccacatagcaacgcatatgcatcattcatgggcctccatttctagtgggtttcatgggcttctctttttttcctcggccgaaggcgaagcgttcttttcccctttgggacgcgggattccctcgccgccgccgccgccgccgccgccgccgccggagtgaccacctcgctcgccggcggactcgattggctcaccggcggcgacggaggagg

SEQ ID NO: 9195 - DNA, 1501 bp, Oryza sativa
gaattttttagcctcccaacggttattttcaaatttgaacggtcaaatagccgttagtgccacgtgtcgccttcccgttggaccgccgcccgccctgtcacgcgccgccggcgctttcggcctgacgggccgcccgggccgtgccgtgccgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctaccccgccccctgtgcgcggtgcatgccgctaggcccactacagtacctgtctccacctacaacaaatcaactagatattttgaaaactctatattaaggaaatttggtttattttttttacccaaaatgtttcaccaagtgtattcacaatgtttcactatgtatagatctaatgttgcagtaaactgaaatatttcattataacaaaaaaacctatatattttgggaacccctattaagggaattcgttttattttttattccaccgaaaaatgtttcacctagtgtacttataatgtttcactacgtatggatcaaatgttgctgtgaactaaaacattctttagctatttgctgaaacattatttttatatacggtgaaacaacacctgatttaaacaagcgaaacattttcgatctactaagtgaatcaattccgatatacttggttgaacatcgtgcaatatttaaaataatttaataataagctaaaaaaaatttcgtcggaatatatccatgtgtggtcttgttttaaagatttaattgcaacgaatttaatggtacaatcggataatgatttagataagtaattaagagaaaaatcagtttaaaatagttttgcacgtaaattgggcgctgacatcagcgttctatttttctccaaattgattggatgcccgagccgtacagtcgtctaattaatgtgaatagccgctgctacccaagcctaattcaccttatcattatcattcctggcccctcgccgcaccaccatcgctggaaaacggaagccacacaccacctctatctccacataggggcatcatcttccttcagctgaccgacgagcacgcagcggtgtgtcgatgttgtcggtggggtatacggagcttgtggtgagaaggtagtggctgatggtggcaaacctgacaaggcgggctgcgtatgtacatgtcagtatgttgccgcaacgaaatattagtactaattagtaatactttctccgcctcaaaatataaaggatttgcgttcagatttataaggtataggatagtatgtcacatcacccaaaattccttctattttaggaggaagggagtaccgttcaacgtgtttaagtccctatcacatcggatgtttggacac

SEQ ID NO: 9196 - DNA, 1501 bp, Oryza sativa
tggtgtgtggcttccgttttccagcgatggtggtgcggcgaggggccaggaatgataatgataaggtgaattaggcttgggtagcagcggctattcacattaattagacgactgtacggctcgggcatccaatcaatttggagaaaaatagaacgctgatgtcagcgcccaatttacgtgcaaaactattttaaactgatttttctcttaattacttatctaaatcattatccgattgtaccattaaattcgttgcaattaaatctttaaaacaagaccacacatggatatattccgacgaaattttttttagcttattattaaattattttaaatattgcacgatgttcaaccaagtatatcggaattgattcacttagtagatcgaaaatgtttcgcttgtttaaatcaggtgttgtttcaccgtatataaaaataatgtttcagcaaatagctaaagaatgttttagttcacagcaacatttgatccatacgtagtgaaacattataagtacactaggtgaaacatttttcggtggaataaaaaataaaacgaattcccttaataggggttcccaaaatatataggtttttttgttataatgaaatatttcagtttactgcaacattagatctatacatagtgaaacattgtgaatacacttggtgaaacattttgggtaaaaaaaataaaccaaatttccttaatatagagttttcaaaatatctagttgatttgttgtaggtggagacaggtactgtagtgggcctagcggcatgcaccgcgcacagggggcggggtagaggtggccaaatgggccgggccaaacgggcggcccgcggcacggccgttcctgtagcaggcacggcccggcacggcctgctacagtaacgggccgtgccggcacggcccgtgtagccgtgccgtgcttgggccgctggccgagcccgcgggccggcacggcacggcacggctcctgtagcaggccggcacggcacggcccgcggcacggcacggcccgggcggcccgtcaggccgaaagcgccggcggcgcgtgacagggcgggcggcggtccaacgggaaggcgacacgtggcactaacggctatttgaccgttcaaatttgaaaataaccgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 9197 - DNA, 1501 bp, Oryza sativa
gaaatcctattaaaacttggcaatattaattaatcccctagcgttttcacaaaccagcagcgaacctccacttgccattcaaactcacatacatttgctagttcacggaacacataagattttttttttaaaaaaactaaaatggcaaagtagacgcataaagtaattctaaggctaaaactacgcataaggtatacgtacactgtgcatgcgtatacaccgtagtatatagtagtagaatatttggtccaaatagaggtgtaactttcttccaaaatgggccttcctactctggcccaaatggtcatatggcccatcaaaagtgagcggatccgactcgacaacaagatcccccgcgcgcgcacaagaaaaaggagccaaatctggctaccgatcgatcgatgtcattggagatgaaaacggatacggatggaaactagctctaccatattcattttcatattttctttttggaatcggaatcgaaatcggaaactccggatacgaaaacggaatcgaatattgtcgaatacatatacggagcgaatacgaaacggaacgaatacggtaacaaataaatatcaaagtaaaaaacccctcaaaccgagattctcaaatcaaggaagagatatagctcgttattttttctaatagaacatatcaacatttctaaattttagtgttagtaattttcttatatccaattttgtggttgagggagaggattcaatcaagagtaagacattagcgagggaaaatagacttattcctcttcttgcaatagttagctaattttgattaagaaattgattttttcatacgggcctcttaaaaggtccgcatgcaaaaataaactcatttttacatacgggcgtcttaaggagctgtatattaaaataaaatttaaaacaagtttaccgcacttatataaactccaaattagattatttttttctaaatgtttctaaaatcacgtttgttggcggatggcatgaggctcttcgaccagatctgccgaaacccgtggcgaaggctatggagcaagaacggcgtgaggcgaagagtcgcgcgagggccttgccaagccaggggcgtctcgggcgaagggtgcaaggcgaagactatctgccgaaggaagacgacttcgccatggcaagttcgcccccgcaagggccgaggaagcctttccggcccatcaagcctaagggccggtgatcactagacggcccatcaggggcccatgagaccctataacattatgtacccctgtaaatgtccctttcataagggtaatcatgtaaattcccctgtacaacctagatcctagtagtaagagcctgcaatagggctataaatagccccctaggccatgtaacgggggatcccaagtgaaattcaaaatttagtacacttcattttcccaaccactgttgagtaaccacgtccttcgacgtacgcagttgtcgtttcgacaacagctggcgccgaccatggggagtcc

SEQ ID NO: 9198 - DNA, 1501 bp, Oryza sativa
atagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctccaagcagtgaaagctctaaccctaccatatcttttatctcaactcctgaaataggaatctccatgtcagtgttttgtcgtccatttcaacgacccgttaacaggaggcttgcatttaaccctatcaatcctgcta

SEQ ID NO: 9199 - DNA, 1501 bp, Oryza sativa
tccttgacgctggagcatggctccatggactcgagcttggccgcgacgcgcccgacgcacccatccgtcacccggttgaggtacaccaacggcgtgttcccaatcaactacagcacatcacaaaaaagattcaatcttcttctttttctctctcaaatcacatcccaataccaatccaaaaaaatgccaccacgatgaagaacaagaaaccattttggcgctcgctcacctcggtgacatccttggcgatggtctcacccattatcccgtcaggaatctgaaacaaaccaaataaaaaacaaaaatcaagaacacacacacacacacaaaaaaatcaccctcaaaatcaccacatcaacccagaaaaactccaatccaatccaatccaatccgagacaacagagagggggggcactgcctaccgatctgacagcgaaacaacaacaatccttgctcctccttgggaaatggcggctcgtggagttggaggaggaagcatcaggacgcgaggttttatacaggagaggaggaaggggaggtccatgactgcgcggaaaggcgcggtccacggtgcaccgtgtcactgcaggtggggcccgcaggagatagacccgatggccggtgtacgtggaccgggggaggggcgttcgttgaacctggacggccatggtttgccagaaggcagcaacgagagagagaggcgatcgaattcagtgagctgtggcgtaattgcccaagccacagctctctctctccctctctctctctgcctataaataagtgtttgcagctacgaaaattcaatcggggaaaaactatatgggattatcctattgatttatttatggtatgcaggatatggaggcttcgcaaattcgtttgttgtcgcctgtgggacatcgatatcagagtagaattgtttaggctcgtactccctatgtcaaaaaaaaaacccacttctataaatgaatctggacatacacggacatagtgtatgtccagattcgttttttttacgaagagagcacaacatatgtctattgtcgatacttttttgagatcagtatataaaataggtggtactagattaacgatgggctagatggttaataatgagcatatatgtgcaatagatgaaacatgtctatacaagtatagtggtatactgctacaggtaatttgttactatgtgtcagttcaattgtacagttttaaatattattactactatatcacaatatgatacttgagtgtttttactatgggagactcccctgctgtgttttggttaagagtgagcccttctcatatgagtgattcttactctcccgtcccaaaaaaaactcaacctaggaggggatgtgagacaacgaatctggataaatggtagtccagattcattgtactaggaggggtcacatcccctcctaagttgagtttttttttatggaggaagtatactactccctccgtttcaggttataagactttctaccattgc

SEQ ID NO: 9200 - DNA, 1501 bp, Oryza sativa
atctgccaactgcttgcatgccacaggcaaccgccggcaatgatatcattcatgggattttttttccttatgataatggaataaaaacatcggatattatttagtttaaaaaaaacatgggatattattttattatctgaaagtcacaattataagaaacacccatacccaatcatatgtacagtactaccttcgttttatattataagactttctaacccatatatatatatatatatatatatatatatatgaatgtaggcaatggtagaaagtcttataacctgaaacggagggagtagtatacttcctccataaaaaaaaactcaacttaggaggggatgtgacccctcctagtacaatgaatctggactaccatttatccagattcgttgtctcacatcccctcctaggttgagttttttttgggacgggagagtaagaatcactcatatgagaagggctcactcttaaccaaaacacagcaggggagtctcccatagtaaaaacactcaagtatcatattgtgatatagtagtaataatatttaaaactgtacaattgaactgacacatagtaacaaattacctgtagcagtataccactatacttgtatagacatgtttcatctattgcacatatatgctcattattaaccatctagcccatcgttaatctagtaccacctattttatatactgatctcaaaaaagtatcgacaatagacatatgttgtgctctcttcgtaaaaaaaacgaatctggacatacactatgtccgtgtatgtccagattcatttatagaagtgggttttttttttgacatagggagtacgagcctaaacaattctactctgatatcgatgtcccacaggcgacaacaaacgaatttgcgaagcctccatatcctgcataccataaataaatcaataggataatcccatatagtttttccccgattgaattttcgtagctgcaaacacttatttataggcagagagagagagggagagagagagctgtggcttgggcaattacgccacagctcactgaattcgatcgcctctctctctcgttgctgccttctggcaaaccatggccgtccaggttcaacgaacgcccctcccccggtccacgtacaccggccatcgggtctatctcctgcgggccccacctgcagtgacacggtgcaccgtggaccgcgcctttccgcgcagtcatggacctccccttcctcctctcctgtataaaacctcgcgtcctgatgcttcctcctccaactccacgagccgccatttcccaaggaggagcaaggattgttgttgtttcgctgtcagatcggtaggcagtgccccccctctctgttgtctcggattggattggattggattggagtttttctgggttgatgtggtgattttgagggtgatttttttgtgtgtgtgtgtgtgttcttgatttttgttttttatttggtttgtttcagattcctgacgggataa

SEQ ID NO: 9201 - DNA, 558 bp, Oryza sativa
tggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcctgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacgtgtaatcaaagtggatcaaaccatccatctagctcgcgcccaaacaccgatcgctcggga

SEQ ID NO: 9202 - DNA, 230 bp, Oryza sativa
cagatatacaggacttgttgtcgacaatcccatgagaaattctcccaggatcaagtataatgttgttatcttcttcgatccctgccacttctctagaggattgttttgtaacattgaaatgttacactgtttaattagttatcgtaatctgaaatatctaaggacattatgtggctactatgattggttgatgcatgctggcttagtgattgatctttcttgtcgctagt

SEQ ID NO: 9203 - DNA, 312 bp, Oryza sativa
tgaaaacccaaatagggtaaaattatgtcctatgcttgatgtcaaagcaaataaaaggcataaaggttataggaaagtaagggcaaatctacatagagaccatatttttggcgccattatgtactagtaacaaattgaggggccaaacacaagcttccataagaaatatatatatagctaaagaaaaggagtaacatcgtttgattagaaaacagagccaagaatacaattgcgctgaagtggctacgaaaatatttttattgtaaaactattcttattattatttggacctctgctttgttcgcttatagc

SEQ ID NO: 9204 - DNA, 1501 bp, Oryza sativa
acttgaaaaattcaaatttcaagttgaaagttttcaaatttttgaaattttgacttcagatatagatttctttttaatttgttagttaataaaaatctcacgaaaaaatactaactactaccatcattatctcaaactgtaattatctaagagactaagataaatagaattagtctaactaccaaaaactagcaccaggggcgcgcacgcgccaggtagggatccccgatttagtctccctgatgctcactgtaggatcgagaagtcgactagaggggggtgaatatgtgatttaaaattaaatgacacctaatcaaaactaacctaagttgctaggctcggtgagggacaagactaactaagcaactaatttatgttttgcaatcctagggtgaaagtggctcaagtatatcactaggaaagtaaatcacacttcctaagtctagtttagcaatcctagggtgaaatgatctctagtatgtctctagaaatgtaaattgcacaaatataaatacaacaagtaaatgagacaaggagacaagagatttttcaccgaggttcggaaactcgccagtttcctactcccgttgaggcgagcccaactccaccgctcaaccacgaaaccaccgcatgcccccttcgtcaaggggtgggcaaggcgggagccggcccacggagaggactacccaagcctcgatcactagagtagttcttccttcactccgaaggtggtgaactccaaaccactcacaaaaccggcaatgggcctcctccacaatcttctcggagaggtgtcacgtcctgataaattcatcccaaaataaaaatcattctctaaaaggaataatagaattaattaaaatttgaaaagaaattggcaaacactaaaatacgtactagaaaaattcgaatgtggcctggagaatttttgttaaattctctttggtctaaaaggagctctcaaattttacttgaattttcagagcaacggaattatttattaagcaacaacaacaattaacaaagtttactaaaaagaaaaactaaaaataaatcccccttccttctttgggctgagtctaagccaaagtcttcctctctctctctccctcggcctgcggccgaagtctctcttccctccctatctttttctttcttccctccttcccagccggccaactccctcctcctccttcctcccggcctgccttggcccaagcctccccgcccccttccacccggggcgcctcctggcccaagccgagccacgctcgcccacgccctcacgcgcgccgcacaagcgttgactgcgcgcctcccgagtgggacccgcctaccaggcgcgtctccttcctcccgctcggctcttctctctcccgtgaaaaccctagcttcttcctccctcaaatccgcacgattcaagcatgggattccaaaattgattgggggcttttaatcccctttccttcctctttatttcccccttatttttccccttgat

SEQ ID NO: 9205 - DNA, 1501 bp, Oryza sativa
acagtgagcatcagggagactaaatcggggatccctacctggcgcgtgcgcgcccctggtgctagtttttggtagttagactaattctatttatcttagtctcttagataattacagtttgagataatgatggtagtagttagtattttttcgtgagatttttattaactaacaaattaaaaagaaatctatatctgaagtcaaaatttcaaaaatttgaaaactttcaacttgaaatttgaatttttcaagtcaaaatttgaaaactttcaacttttcatcttaaacttgaaaaactttcaacctagatttgaaaactttcaactcaaatttgaaaacttttcaactcgagatctgaaaacattcaactcaagatttgaaaactttcaacccacttttgaaaactttcaactcgagatttaaaaactttcaactcagatttgataaattttcaactcgagatttgaaaactttcaagtcgagatttgaaaactttcaaatcagatttaaaaaattttaactcgagttttaaaatatttcaactcaaaacattttgaaaaaaatatgtgggctaaagattagaaaacgtaataaaaaaaactggaaaaaaagcaaaaaaaaaacgccaaaaaaacgaaaaaggaaggcgtggcgtggggaggggccgcacgcgcacgcgcgaactagctctggtggattaaatccagtcctatgtagatggaggtgaccatattttgcaaggatcaataatgggggcggtggtgcgagggagcaggggtggaggcctagcgtgggggccttcaacataggggactggcttgacacatgcaccctcgcctctcgagtctcgtacctcatcatgccttgtctcgagagatgggaggggtatgtggaaaaggaggtggataaatataaagagaggcaatagtaaggaagagaaatgagaagggtgtaaaataaaatagagattggataggtcggtggctgacatgtagggtttgcactatagttgtgatttgttaaatgattcaattcttgggctcaaatagaaaaaccaatgaccgaccccaagactcactgtaagcacctaaggccggtcacagtataatggtgtggcgtgtggactcgtgcgacacatcggagccttgccgtgtcgttatggcccatctccttattttgttgcttggctcttcagtaggaaacggcttccccacctgatctacaggcaacacaacgagggacatacctccgcgcccgcgttggtgaggtcatcttctcgctgcgtcgtcccctcgtgtgtttagctcactaattaaggctgaacctggcccatttgagttcatttgagaggtcacatgcactgtgggagctgtggacaaacgcttccctaagcctgtttggcatatatatagatgcatggcctgcaccgtgattggcatatataatagaatgaaacatctcgaccttcgctcaaggagttacaaccaattattacagaatt

SEQ ID NO: 9206 - DNA, 1429 bp, Oryza sativa
ccctcttgatttctccgctgcatgacataatctactatttacaatcatgagtactctttttgccctttgagccccgcatcggtatagccgatgaggcaactatatgtgggacgttacgccgggctcacttgccaagtcttgttattcctgctgagctagtgtgaaaatatgacttttagaaaaggactgtagcaacgggacatctcgaggtaattcgtaacaaatgcgattgtcaggcttggcagtgcaccgcgtcggacgaggacataaggcccatgggacatgtctcctccctcaggcctataaaaatgccacaatagcctttcccgggctatcgaggagtttccacagccgaccacttagaatgtgacttcgtgtcacttctcggaatagaccacgtatcaaacatcggatgtttggacactaataataaatattaaacgtagactattaatgaaacccatccataatcttgaactaattcgcgagacgaatctattgagcctaattaattcatgattagcctatgtgatgctacagtaaatattctctaattatagattaattaggcttaaaaaatttatctcgcaaattagcttttatttatgtaattaattttgtaagtagtctatatttaatactctaaattagtgtttaaatatagggactaaagttaagtccctgaatccaaacaccaccttagctatgctatagaacacaatacacatggttgttcccaagaagactaacatttgggcccatcttacaacagagccttgaatcagttcccgtgcagctaggccatcagttccacacacccacgagtagaccaagtcaccgtccccaagcaaccctgtgccaccgcctaggttttcgagtgtatcggcttcattgtggttccgtgagtcatgcagcgagagagtgcatggaccttcccgtgggattacaggtcattaaatggagactgtatagagcgatgctatgccttcacaatgaagcaaactggctaaatagagacctttggctagaatgtagatattctttatttcaggtgatattataatatattttttatccatagcaaagcacgaatactcaactagctagtatcgcgtaaaatgtactactggacatgattgttcgattggtgctctgcatgactgcataattcatttcatcgaattaagaatttaacttgtcatatatcccaccaactactggtccatgcttgcatgcaaatccatccaggaaaacaaaggaactattacacaagcaacttgcgtgcaactaaactatagcaagctatagctcacctataaatatcagacgaaaacccacaagcaaaccatcccaaactgacacaagctagagcagtctagaacactgagtgactgattaccaccggctcattcgatttcagacaaaatta

SEQ ID NO: 9207 - DNA, 1501 bp, Oryza sativa
acaacgatgtacttcgaagggtctaagtgtaagtttactgccactctgtgttgtggagggggccggatgtaaatttggtgtctacatgaagcgccacgttaggacagtcccaactcataacactagacatgatttccataaactccacatcatcaagaaactagtactaaacactactcttccaatacaaacaccactattccatacttcaatttaatgctatgtcttggatgttgtgtagaaaccatgtctcatgcaagacatggtttccttctctttcctcatttattcacttgcaacatcattttttgtcctaggtggcaacttatttaatgctatggacaccatcctagttattgggttgggaatgaccttagcagtcagacacagtcaaatgtcgtttggacctgctgtaatacattaaaccaagatcgtggacctaaatatgcaatttttaagtttacggacctaagtgacaccacctctcaagtttaaggaccggcatgtatttttctatatttattaactaccatagttgagttgacacacatcatataacattagataaagaaaattaagtacatgcatgctccctctgttccaagatatataaatacttcagtaatttctttcatgaaaattcaggggaggggaaaatctagattacctttcattatcctcttgctgacacctgggtggggttgtcgacatggggagatatcttgtacattttatcactgcaaatacctcttaatattctaaatagaatatatttgaagacaaaatttaaatgcttgaaataactagcctacaaatgtacattcattccgctaattaattatctagataattgaatcacactgcagaacacattggagcagagtttgcaatttcggatctgaatttctaaaatacaccgataaattagtcggtgtatacaatataatataatcttatgattatgtgccttgttgtttgtttggttataaaggaaaggatgatcttatagtagatctagtggttgcaatgcagtgtggaccatcttattctcagggctaagttttagtaaccccttcacgctgggctggaatggcaatccaaccaacgggattgcatagtttggcctaaacgagagtacatagtttggcccatgtactgtgggccattttgactaaattcaatcggtcatattacatttcaagaatttcagcgtcgccattgcttaggtgcaaggtccatattggtatacgtgacacaatttgaggacatcatcatatcaaatacagatctattttcatgctttcgtgggtgacatagcaaacatataagccacaattatctccagataacaatatatataatgggttttacatattacaatctcaaaaaaaaatcaacttacaacaattgaattaaagtaatttaatggatgatagatccgcacatcaatttgccaaaagaaacaagacttattcacgcggaatcatgaaaaaaaggctca

SEQ ID NO: 9208 - DNA, 1501 bp, Oryza sativa
aagagttcatggtgcatgttttacttaatgcttctcaatacaacatatatgaccacgctaatataagccacgtagccaggtcggccggatacttttggttacgtcaaaactctcttaggataataaattagacagtgtaggtataaattactggtaggtaactttgttgaacaaatactggtgggtaattaatgggctagaccgggatgattaaagagattaatgggcatggtcagcacattatattgtggacatataaatcatattgtctcagcatattggggctgtttatacacatttgttgataaattttctgtcaataatttgacaggtacaaatataatataatcatataacattatatatagtgtatcttgcatttaaatataatgcaagtatatgtaactttaaaaagtcccatggtaacatgctgtttttacaaagtggaggtcaccggatcgaatcacctcacctatgcccgtgctgtatgtttttttcttcctagttgcacaaatcttgaaaaaaattcaatggtttaaaatcatgaaaaaattgtagttacatgattttattataattatatagtatgtttgataaattttaggagaaaatttattgataaatatataacaaaatcgtttcagatttgttcagacttcagaccagtcatgacttgcatgccttatttaaatttccagccagctgatcagcaagtcgcacacgcttggatgcattatatatactcctatttattataactggagggagtatactccctaggacggagaaataatgcatccaaggacggagaaatatatactccctgaagttattaattactccctaggacgaagaaataagctttcttacctgtttggtacagctccaactcctaaatttaactccagaagttgggtctggagtggagttgtggagctgcctaaacccagctctacaactctaattcattttgtgagagaactccactcagcttcactcccaattttggtggagctgaaactgtttggctgagctccagctctaggaggggtggagctagagctggagctgtgccaaacaggcccgtagtgtgcaagtataagtaacagagaataacatccgagacccaagaaactctgaaaaaacaatattatattgatagatccagaaattatgatatcgtgaaaaatgtacaaccgggcatgattgtttgattataattggtgctctgcatgactgcatagctctattcatcgaaataattacggagtaagaatttaacgtgtcatgtctctcgccaacaactactggcaattatcatatctcggtatctcacacatgcatcatgcatgcaactacatatacgaagcgagctcatctataaataccaggcgacaggcgacaccacaagcaaatcatccaaaagcgacgcaagccagagcagcctagaacactgagtcactgagtaccaatagctcactcgatctctcggatataccaa

SEQ ID NO: 9209 - DNA, 1501 bp, Oryza sativa
cgtcacaaacctcacgtatcagtatcagatacgtacttcgataaagacacatattagatacactccgatacatatccctttttttcataatttcaaaataatacaaaaaaatcgtcatcgggacgtagattcctagcaccaccgccagacacaatgcctcaggttcgttgtcgtcgcgaaccgtcagtgccgtcggacatggcgaccccatctctgacggacacggcacgccagtatctgcacctccataggacacagcatcgccgccaccgccgccagacgaaatggctctaggcccgcggtcgtcgggaaccgtcggcgccattgccgaacatggcgactccatttccaacagatgcagcacgccggtatctcgacctccacggggcgcaacaacgccgccgctggacattgcaacaactccatcttcgccatgctggctgtcggtcgatctccgtcaccggagccttgccggcaaaaccctcgcgccaccagctttgcctcgtcgaggtgactctattcccctagtttcctctttcctttagccaccatatcaagctgccaccgtcacctcccttgccagctagagctgaggttttcccttcgttgttctggcctcctctcaaagtccctctacttgccaccactttcctcggatgcaaagaaaaaatgaacacgttcaatcgctgacgttgccgtctcctgatcatcggagcaccagcgccctcctcttgtttcatggaagaagaaaaaagaatgagtagagaaggagagagaataggaaaaaaatattccctgacaggtggatcctagcatgggagtgaggctcgattgggttcatggggtaaaactatactttcatagttgtttctttctccaattcctctgaatataataaaatagtcccatgggtgtctaacagctaattaccacctttttacagtatactatagcataaacgcgtttttgcggtgtccctagttaattacacttttttggatgtcctgtaacaaattttgcggactatatatatagagggatgttatgccttcgcaacgatacaaactgattaagtagaataccttgactaggatgctgatattattttttaggtgatattataatgtaatttctattcatagaaaagcatgggtactcagctagcttgctagtatcgtgtaaattgtacaactggacatgattgtttgattggtgctgtgcatgactgcatagctctattcatcgaaattaagaattcaacttgcatatctctcgccaactactggcccatgcttgcatgcaaatccatccatgaaaaccaagcaattatcacccatgcatcatgcacgcaactatctataccaagcaagcgtactatagttcagctataaatagcagatgacaccccaagcaaaaatcaacccaaagcgacacgagctagatagcagccaagaacacttattcactgagtaacactagctcattcgatcccagacaccaa

SEQ ID NO: 9210 - DNA, 1501 bp, Oryza sativa
ttccttcgaatccagcgtactgaccgaagtccggaatattgtcgttttccacttcatcttcttccatttcaaccccttgctctccatgagatgtccaacaaatatagcttggcatgaaccccgactcaaacaagtggaaatgaatagtcctggatgtagaatactccttctgattcttacacttattgcatggacaacaaataaaacccttatgcctgttagcttcggccactctcaaaaaataatgcacgccgtcaataaactctttggaccgccggtcagcgtacatccattgccaatccatctacatgaaatgaaaacaaatcgtacacaaataattattcgtacaataatgacagccatacaataatgataaaatcattacaaactctgtcaacagtcataaaataatgacatatcattattcatacaaaaattataaaatattacatcaaataattcttatttactatttctaaagttttaaactaatattaatttgttgtagttcttttaattttcattttagtttgttttctattatttaagattaactttcactattttttccttctcaactattttataaaacctttcaaataaactaaatttctatatattctttctttcccatacaaattttctctctcatcaacttacaacaaaattttggagacaaaaaagtgtacaaaacatagctccaaatgtaatatgacaaaaaaaacattagaggatgaagttgctaaccttttagccacctccgatttgtatataatcaccaaaataaattcactcgaaattttggcatgacctcttctcttttttgaagaaattttgaagcttgctcgggctggaggaggaagaaaaggggtgggactttagtcccggttggtgttatgaaccggggctaaagatcgccgggatctttagtcccggttggtaacaccaaccggtactaaagttatgatctttagtcccggttggtgttacaaactgggactaaagatcccggggggcctgacaagccctgatagcatttgaaccgggactaaagaggttggtgttaccaaccgggactaaagatcaaatatgcccgttaccctttttaaccgggactaaagatcatctttagtcccggtttttattgtaaccgggactattgtggaattcggccgaccgacgaaagatggtttctccaccactgatactatatggcctacctgtatatggcctacctgtatatcaaaactcaaaagtggactacattgcctaaatgtcgtggtcgtggtcgtgggtgttacggaatattatctcccagggagataaagatcctttcttgtgaaccaatctgaatcggagtagagataaggtctatctcatcctaagacccctatatatacaggggcagggtgtgacatatgaggttggcttgtactcagaagagatctataatgaagagagagctccaccctatatctgtgttcattgtctatttctgcaa

SEQ ID NO: 9211 - DNA, 1501 bp, Oryza sativa
gagggagggcctccaccgccggagtccgcgcccaccgtcccacgctgggcggcgccggactcggtgcctcctcgtcggccgcgccgcctgctcccactcggtgagagagagaaagagagaagagaggagaggaagagagagatgaagaagatagaaagagagagtgcgagaagggagaggtgaagtggaaaattttgaagtgttgagtgggaaaggagagaggaggggagaaaatatctatgaaaataggcgggtattttcgcatgcggaccacttaagaggtccacatgtgaaaatctatttttgcatgtgactccttaagagaatcgcatggggaaataagcttatttttttttgcatgcagtccctctagtaatctgtctatgaaaaatatatttttacatgcaggtctttaatgagccgtatgcaaaaaaatattgctcgatttttgtagacgcactagttatgacccacttgcatcctacgtcctcgtatagaaactttgttttttataagtgttggcacggtctcaaaaattaaactttaactgccaattgctctcaaaatatgattatccatagtgaaatcaataaagtacatccaaatatgaagtttacaatactatacttttatcactaattgctagtaaaagtttatgccatttgaattttaaaacgagtgtgcgacatataggacggagagagtattgtgttagaaaaaacccatattgcatcaaactggtagtacacacgttagatagtttagaccacaatgtaaggtatataatgttgtaaatagtgaagtctatattgttggaaattgccttagctataatttcatttataaaatttcaaagcagctataatattgaacataaaggtttagcaccatattgctcctttatatcattattgtggactacttttataattttatataaaaggtatgattttattgattaatgaaattctccattatctagaaaagttatataaaaggtgaagtctttttccataaataggaggcacgaggaaaatcatatggcttgtgacgaggcatgaaagtatcaacatgtatgtccatagattgcgcagcaactttatttttaccaattgtacaattttctatttttatacagtataattatgggttgtttcaataaaataaagtttctggacagcgtgtttgtgtgacactgttgcgctcttatatcaaatgatttgtgctgtaacgactttgcggtattgcctccagatatacaggacttgttgtcgacaatcccatgagaaattctcccaggatcaagtataatgttgttatcttcttcgatccctgccacttctctagaggattgttttgtaacattgaaatgttacactgtttaattagttatcgtaatctgaaatatctaaggacattatgtggctactatgattggttgatgcatgctggcttagtgattgatctttcttgtcgctagtcactttcaggtccggtctcc

SEQ ID NO: 9212 - DNA, 1501 bp, Oryza sativa
cttcatttggatttttcattagtttttcttccaatccatcatcaatttccttttgtttaacttcattgaatctatattctttttttaactctagtggatcataaattaaatggtacagtagatgccaccttaccccttggatttttaagttaatggcatattagatgtcacatataataatttcttttataaaatggctgttgtaatatgcaagcctctctccattggatcttcattttaatggtatattagatatcatctatacttttttagaaaaaaaaacttttgcaaatcataagcctctcgctttcatcgtcatgttatgaattattggagaaatcttggcacctctaatacccaaatcctagcttctcctttgagagggtcgtgaaggacaaaagagagagggagaagacaaaagatacatgtaggggcgtacacgtatctattccctctatttcaaattataagtcattttgattttagtcaaaatcaaactactctaaatttgatcaatcttgtggacaaatatagtaatatttacaattccaaattagtttcactaaatctataattaaatatattttcataatatatttgtcttgggttgaaaatattactactttttttctacaaacttagtgaaccttgaaacaatttaattttgaccaaagtcaaaacaatttataatctgaaaagttgtttctaagaaacaataccatctgttcctttttaactgccaaaaaagaccggcatatgtggactcgatccattaaagtcgtgcattcgttgtgagacttggtagcgaagccaagcaaaccgcaaagcactaatcagaagtaccttagacaaagatttgatcactgactcgatgaactctatcatattggtagctacatatggacatggagaccggacctgaaagtgactagcgacaagaaagatcaatcactaagccagcatgcatcaaccaatcatagtagccacataatgtccttagatatttcagattacgataactaattaaacagtgtaacatttcaatgttacaaaacaatcctctagagaagtggcagggatcgaagaagataacaacattatacttgatcctgggagaatttctcatgggattgtcgacaacaagtcctgtatatctggaggcaataccgcaaagtcgttacagcacaaatcatttgatataagagcgcaacagtgtcacacaaacacgctgtccagaaactttattttattgaaacaacccataattatactgtataaaaatagaaaattgtacaattggtaaaaataaagttgctgcgcaatctatggacatacatgttgatactttcatgcctcgtcacaagccatatgattttcctcgtgcctcctatttatggaaaaagacttcaccttttatataacttttctagataatggagaatttcattaatcaataaaatcataccttttatataaaattataaaagtagtccacaataat

SEQ ID NO: 9213 - DNA, 1501 bp, Oryza sativa
ggttatttcttctccctccaaccactcacctctctctctcaacctcctattcttctgtctccatcaccgactctgctcaagcttctcctcttcggtaacgcgcgaccgcggcctcgccgatgggcgcgagtcccttcctccgcctcggaccgccccatcgtcacccagcatccgctcccccttcttctctcgctcatcttcctttttccacgaagccgcggctttgcatcaccgccgtcctaccttgctcttctgactgatcagtcgctgccaccaccacagcaggagccaaagcccaaaagactgggaatgcaatctcggcagcagccatgctgcagcgtctccatcgcccactccatgaaatttctagctatctacctagccagacagagaaataaattccaaagaaaaagaaaaccaaacatatcaatcagagatgatgccaccaacattttactctgatcaatgtcgatccagatgatgcaccgttctccccaagattcaacgacctaggctagaatacattttgcaagcagaaatttgattggtgtggggagacaagatccgggatcaccattgtcggttgtggggagcgaagcggagctccccgcggccagaacggagccgcaatcgcgcatcatcgatctctcgccaaagtcggttctcctcccaccgagtccctttgtcaccacattctgggagctcggtaaactccgtttcacctccgcggccgcggccaatttcgagcaagacggaaatgcccaatttgatccgccgtcgggcgctctccatccaatcccctccacctggttgtcaccttgtcagtcaccttaggccggccgtcatcatcgaagctccatcccgccgctcccgccttcccgaacgaggacgccgccgcgtcgggaccgtcagcctcgcgcgcgcgtgcctcctctccactgctggtttccttgccgcacagaggacggcctcctcagcctccggcgaggccgcggccgctcggcgccgacgaggagcgtgagcagagtcggtgatggagagaaaagagaatatgagatatagagaggggagaggtcggaggaagaagaaatagcccttatatgtgggtcccactcaccacaccagctaaaaccgagatactgtacagtgtggaatctcgagtacaccggttttattggttgagggacgtgttatatctggtattgcagttaaggacgaaatccaaactccgcgtaaagatgagggacctaaaatgaacttattcccacgctctttccatcaattttctagggaataagttcatttccattcccttaactagtgattgaatctgattcgtatccgttaaccacaataccatatatcttgacccctcgattattaaaaccagtgtaatttgactcgatggttttgaaggacggtttcgctgacgcggtgcctatgtggtagtgttgacctgatccttgtcccacgtgactgttgatgtggtgcttgtggcagt

SEQ ID NO: 9214 - DNA, 1501 bp, Oryza sativa
acccatcccttttatctctgaaacttcccaacattatagtatagtgttgaacaatttacaggctcctctatattggaatactttagatgaaaagacaagaacaagggacgtgaactagatgacgcagctacttgaaattagttttgttgttgtgcgttgcaaacaaaaaaaagaaggcatactagtacttgttttcttgtgttcaaactgcagagacaacgtattgcgtactcctgaatcaccattatggcattatccctgaaactctgaaaggaaccaaaaatcctaatgagctaagcagaaacggtttttcttctgtgagatttaacacaaatgacttagcattatgaaataaacatgtagaatgtcaaacaactttttagctgaattacttctatataaataacaaattcttttggaactgattgctatgaaagagactagctcccattaaaaatttctgaaagtgactagtgcgaacgttgcagcctaaactatatcatactatattactgacattccgtgcactccaaactcttctttattagtgattgtttcaatgaatacaatcagcaaaattacaacctttttttctcatgaaaagatagaaacttgattgagagtactcttttcttagattgatgcctatattagaaattagccaagaacttcaattccaacaccacaccaaaatactacagtaaaattgatgctgtttttttgtatattgatgcctatattagatagttgccaagaactccgatttttaataccacagtaaaattgacagattacgaaggggaaaaaaagcagtgaacgttttcttttcatgaagctaagagcaaagcttgtaccgtgactgtactggtgaggcatacacggaactagtctactttatgggcaatctgccaatgcattggtcagaaaatctttttgtcaaaacgggtcagcctgacagcgagacgcgcctgctgattaacgtgacacaaataatggtttgaagtaaactttattttattgtttatcttcatatggagatctttcttgcttgctatgcatactaaccaagtgttcagacttcagatactgatgtgtattaactattaaggcaaatcttgactggtaactgacatttgggcaccaccaaccattttatttttctgggagtcccacttgtcagtgacacatatccgcggtttgatgctgaatttctgaggaacctggaggacagattgcaaatttgcaagtagagtagtctttgaacaccttatatccgtgcacaaaacggtggtcaatccaggaaaccgagcaaagagttggacacatgcatgttcacaccgagctggaggccataaatagtagagaccaagctgcatcttcttgttatcttcagttattcagaagttcagagcagtagaggaagaacaggataagatcatagctagagatttcagagagagaatctagagagagagagaagagatggctggaggagagcatg

SEQ ID NO: 9215 - DNA, 1501 bp, Oryza sativa
aatctgcaggccaatatcaggagcgtccatgaacccggccaggaccatcggaccggcgatcatcctcggccggtataccggtatctgggtgtacatcgccggcccggtttttggcgcagttgctggcgcgtgggcctacaatcttatccggttcaccgacaaaccgctaagagagatcaccatgactgcatccttcattagaagcacaaggaggaactaggtcccagaattgatcagttttattgtggtaaaatgtttcctttttttttctgtagctagtgatgttgatggaatgaatgggcagtaaaagtaattgacactgtgattgcatagattttacatgctttggttggcttgttgtagcttaaatggtgaaggattgggttacttgttgtaattatcattctgaagaaaaacattgacaccaaatggctgtgctagaattttgataagatttatttttatttgagcattatcgatcacaatcaaaagacctccaatacagcatggaccagcaaagcgataggtgcaaaaatccagtcaaatgatgcggcgtccaacaagcgggtactgaacaaaatatgcatttcttaatcatttggcctacggcttattaatctacctaaaattaatttataagtaaaactttttatacttgtgccattggcgatttaaatgccaatctagtgatttgatgcaattaaaaaaaatcaaattcaacttcaaaatttaaactaaaaaagggcgaaaaaagaaaagaagaaccaaatctgtccgatcaaaaaagagcgaaaaaaaagaaaaagaaaaacgaatccgattccgcggtaaaaaaagggcgaaaagaaataaaaaagaaatctgtctgattcctaaaaaacgggcgcaaaaaaaaccaggtgaaaaaaacgaccagccaataaaacgaatccgcgtggacgcggtaaaaaaaagagcaaaaaataaaataaaaaaaacaaatctgtcggattaaaaaaaagaattatgtgtgatgcggtaaaaaaatcggatcctattatatttgacacggggctatatatctatatcttctctatctctactacttaaaaaaatttaaaaagtttccgttgtccgtaataaccaaaaaagggcgaaaaaacaataaaacaaaaaaaagaaagtgtgattcaatttacttccgtcccccgtgaaaatcttatattatcttaatatctctctctctctctctctctctatatatatatatatatatatatatatatactacttaaaaaataaaagaaatttccgtcgtccgttgggaaaaaaaagcgataaaaacaaaagatcagaaaaaaaagtccgactcctccggtggaaaacagagagaaaaaacaaaaaacgaagagaaaaaaaaacttccatcgcaaaaaaaaaaatgtccgactctaaaaaaaatccaactcctcggtggagaaaaataaaggcgagaaaaaacaaaaaaagagaaaaaaaaact

SEQ ID NO: 9216 - DNA, 1501 bp, Oryza sativa
gataaaataagagtccacctcattttaaaaagagagtccatatatcatatgtaatctactccttaataattctgaattttggaattattaaactgtgaaaaagaactaattatagagctccaaactgagtaaaactcaatatctatcgattccagattttagaattattaatccatgaaacatgctaaactaaaactccaacacaaatacaattagataccttttaattccaaaatattaaataaattgtgaaaacaacggaagatacattagaatggattctgaatttagcattatattaatttaaatctaaaatgtgggagaattagaaaatggaacagttggtgatcatgtgaaatgggcatgctttgttcttgattatgtctaatgaactccgaccaagctcaggtgagatgtgagtattcagataggcttaggctgtgtttggtagttggaggtgggaactgggaactaatccctcgtgcacttagaacagaacgactcattagtgcatgattaattaagtattagtttttctttaaaaaatggattaatatgattttttaaagcaactttcctatagaaactttctaaaaattaaatcgtgtagcagtttgggaagcgaaagggttgagtttgggaaagttgagtgaagaacacagccttatatgagcctgtgatttgttggttattgggggaagagatctccaatatgcaaaatgtatccgtatctgcagaaatgcagagtttgttggatcagctctatggtctgcagggccttgtccaaaccttggtttggcaggaaatcactgcccatcctgtattcgtatctctataagaatgattactctgttactttttaactttggttcctggcaattctgattccttgtagtttttagggcatgtctggtttgttgtccaaacgagccttaccaaaatctagcgatgttaaaccttgggcatattttctgctaaagtataggctatataggctacaagtcacgaagtatggccaattccgttaatgttaccaaatttaggtatggcttgaaatggaaataaaccatatgcagcctcccttctctggagctgtttggcagtgctggctgcagtgcagctgcgctggagcaaccagccatcagctgccttaaagacagccatgcttgggcgagttagacggctacagcacaactgcagccgcagccgcagccaatgtttctaaaaagcccctctaccttttgctcacgtgctttatgatccacactccaggctaattgtttctaatacatggatgcctcttggtgtgaaatatgcatgatttttctacccaatatgctggggcattgtttctacttaatgttgtccgtagccgtaatactcctgcattttttaattatatctggtaatttattttttgctgcaaatgtattctattggtacaggacttgaaattctgtgtatgaagtagcatttactggagaaagctcaagggaaacta

SEQ ID NO: 9217 - DNA, 237 bp, Oryza sativa
ggagctgcatcaaacatgccctaagaaacttaacgccagctcggagcttcgcttcaaagacaagaccgagcggttcaagttccctgcatgagtgtataggcgcaaaggcaaaaacaccacccatcttgtagagaatgcaacacccagtgtgtgtgtgtgggggggggggtggggggggggcagtaaaggtggcgaccttgtacactctcgccatagtcatggtttagttgacgaaca

SEQ ID NO: 9218 - DNA, 1501 bp, Oryza sativa
tcgaatctgatcttttccgaccagcttaccactatttcagacatgatcaaccacaaatttacctgtacaaaactattccagggaaaataagttggaagtgatgcaggttagccaggcatgtggctagatcacaccttggcaaaggaaaggagtatgcaatggagtcatagctatgggtagagaatgacagaaataggccgacagatagtgaactaccaccacagtatatttcctcaacttttggaaaatggtgagaaggaacatagtactttctccgtttcacaatataagtcattctagtatttcccacattcgtattgatgttaatgaatctagatagatagatatgtctagatttattaatatcaatatgaatgtgaaaaatattagaatgacttatattgtgaaacggagagagtagatgacaatgcactcatcaatcagtccatgaaatgactacacaaaaattgtattatgccaaagctatcccaatccataaatgtttctaaatctctgaacctaaataattcaacacaaaaacctccagttcagaggaggatatagccagagaggcacagaggatagcaggtgcagggtcatcagggcatcaggcaagctgcaaaattctgtaaccaagttagtaccagcagagcaagaaaaagtttgcaatctcattagtaattacttacatggaaatggtaacttgccaccaggattctgttgaagtaaacttgatggatgtaatgcttgatgcgtcgacgcaaaagtaagaacctcccaaatcaattgagtcctcttttcacagggctctagtacagcaaactatgggtcaaagaagaccagaactagctgcacactgttcatcaacttgagaaaagtttgagccataaccattgattgggacaaaatataatccgaatgattcatctgatgggctacaaattagacctttctatgacttttagtctgaccagacaaaatatttccaccccttcttataacgaaaaacggtacacatgaatacataggtggataattgccatcatctgtgtcttgtctcggctccaaaacatgcttcgccccggggcggagcttcaccggaccagaccttgaaatatacctgacaccagaagaaatgttagaattgtcgacgtctatttttctcgtcttccaaacagtatctcttgacatgggtttacagaacttgggatctctgcaactcctctgattatctggttttgatcctttctaaaatttgtaccatcaggaggatgaactagtaagtttgcaggatagggattatgtttccaagttgaattggcacggtaaactgctgactgcttggcatgtggtatcaaggtaggcaagaatgttgtagcagacagtgagttttgatcagatcttgtgttgtattttcctccttgaggtgaaaatccagcaagcgcattttggccacagtgcaaatatgaaaagtccctcaacctatcttcgcattcgattc

SEQ ID NO: 9219 - DNA, 1501 bp, Oryza sativa
gccgggcgccgcttccgcctccagtcggtgcgccgcctccaccgccgggcgccgtctccagccggcacaccgccacctccaccgccgggtgccgcctctagccggcactccttcgcctccaccgcctggtgccacccccagccggccctacgccggctccaccgccgggcgccgcctccactaattgttgatttgctttgcttttgctgtttttacatatagttttgttgatttgctttgtttttgctgttagttcggtctatgaccgagaccgaaccgaactaaccgaagaccgatttgctcagtcctaagatttgttggagaccgatcggtcttgagattacaaagaccgaattttcaaaaagaccgagaaaccgaaccgaatttttcggttagaccgaatgtccacccctatgtggcgtgcgtgcatgtgttgtgaagaggcagaccaacactagctacgttgatgcttgatgcgggatgatatgttggattttcacaacttgctatacctaattttgatggcccatcactactatgaggaggacgaggaggagagaggctgggggggggggtgtcccaccctacccaatggatagatccgcctctcgttttaattgcacaatggaaaactaaattatgcaaataataaaatggaatactgaagtgtgtgcaagatcacaattttcactgttacgattaaacttgaattaagcttaggatagcttattagatagacatatgttgaaaatgtaagacgctacctcgccacggtccacgacggcagggtgcaagatgtccccaatgaatcagcttcgatggccgtggtgctagcaagatctatgtgaacggttgatttataactcagttaccgtccgacgttatctgccgctttagttcggcactagtcattaatggtgacgaacgcgaaatttgatcggcacaatgatcagctgctgatttgagaaatacaaggactactatgcacaactcgctagccactgtgcagatttttgccaaccatagatatatagaaatttagcaataggtgttatctttgtctttaggctggtatttaagtagttttattgtttttaattaagttatgattttgtaattcacagtcgttcaacctgtaaactctataataactggttatagctaggttcttacaagcgaagatggataagtctgttattaagaaaaggaccacgtaacacatatatgaatttaggaaagaaactgcgatcttcatttcaacatatagtaatttaggatgggtctaacaacatcctaagttgctacattttgaaacggagggataccaaaagaaaagatatatagctcatatatatttttttatataaacttctttaaaaaaatgtagtgcttattagactatagtgcttgaccacatttacaggtgtgctaagttctatactcggctgagttctattatctatatttttcatacgcacgtttcccaaactactaaacaatg

SEQ ID NO: 9220 - DNA, 1501 bp, Oryza sativa
gtcgtccctgccaccttcagcttcagaacggcagagccgatgatgtggaggcgacatggccaatggcagctacccttcactggacgcggctacttcgacccaaggctggatgcctgggttgggctttcaggtgacctcaacaccgttggccacatctgctcttgtgatgtggtgtctaccgacgacactgttgctagccgccccccagccctgaagatcagcaaggagaagctcttcagcatggtcccagctgagaggcacattggtgccactcttgtctacatgggtggtggtgaaagcaacttctgcctcctggagagtatccacatcgaagatgatatagtagctgatcagttgactgattccgatgagacgaatgaggtttcttctgttgatgaggtgaatgagatcgattttgatgattctaatgaggcgaatgacgaggattctgctgatgaggtgggtgaggaggatcagctagatccgaagtgctttctgcgattgacgaccttttcgctgcagtatgataggaatggagccctgacaactggtaacagccgccgggtttggtactacagcatgcctctacaagttactgaggcaatgcttaagtaccccgtggcattctggatgtaaaccgtggtatggattgtcaaaataatatttgcattatgtaaaccattccccgtgtgcatgatatgaatcctgtaattttcgcctccatggacagcaaaccttggggtagtctggggactgtagaaatttgagatagtgctgctttttgggtggtaatgtacggcggctactatgaaatttgctcagtttttctctctttcttttttaatggaactaaatcctcaatattttttattgccatttgagtatcagatgggcatcacaatcatttgtttgcatccattgtgtacattgtaggccatatatagttcagatttttagatttctgtatattattgtaggccatatgctctgcacttgtacattaagacgttggttcaagaaactacattcgcatacgaagtgcagaacttgtttttatttttagaaaattccttatatgtcactcagagttcacaagtttctttatatgttattggttgatttttttttcttcacgtatatgccatccatgttaagcaatgcgcagatgcaaggatgcatggtacgaaaagtgataatttggttactaaccaatccaattatatatacaaattttcatgagaaaataaataataaaaacaaaacttgtatgatcatattttcgatcaatatggcattggcatgtgggatacggttgttgttaatcaatacgattatgtttaaaagctttcatgatcagttaattagtaacacaaaaatttgttacaagttcatacccacctaaacaaaaaaactccaacaatatatataatgtttgttgatggcataaacccgtgtcggatccgtgccaaactgaaggcacttacggggaactcttaggcca

SEQ ID NO: 9221 - DNA, 1501 bp, Oryza sativa
aaaaaccaaaacggatactacacgatcctatccatatagtctaacagcatactgtatatggcttggcaagctaataattactctaagagacaatagtatgcatgcagagacagggtttgagttttgaaatgccagtagaatccaaggattatcaatatcgaagcataaatttttactaggttcaaacaactaataattcctgggagggtgggggggggggcagttttgcttgtgtttcacaaagttcacatcaggcaggccatgaagcgaatgaatacggaaaagaagaaacttcgatgggaaaaaaaatattccccccccccaaatcggggctctaatcgcggtcgggttgagggcgaggtgaatgaatcacgaaaacaagaaacagatcctgagcccgggagtgagctggcctgattgcgcgaggacggtggattgaacctacgcaggatctgacgaaaatagggaagctgagaaggaaagagagaagaacctcgaggctgtggcggtggagggagcgcgatggcggcggcgcccggcggagggtggccggggcgggcatggccttccttgcgagagagcgcagcgccacagccgccatagctgcgttccgacgtacggacggacgggagcaaggttgcgacggcgcctagctagctagggttttctctctctccttgagagccttgtgtttttctccgcctccccttgcctttcccccttccctctctctctctctaaaacgtatcgcatatctttaattttgccgctgccctaaataaacccggtccatacactctggtcccacccgttgctgggaccgactcggcctcctttacacttatacaatccgagaccgacatcggataggttgaccgttgcggggaggtatagggagtctcggcccacgcgcgaccacgttcggcccagcacatccatccgctcatccgcccgattttttttatttctactcataataagtattataatcatcaaattaaataattagtactccctctatcccataatcccataatataatatgtctccaaaactattgtttcttttcgcgaacgtttggtcttgtttaaatcccgtcccaaaaattttcaccctttcaaatcgaacgtttggacgcatgcataaaatattaaatgtggatgaaaaaaatcaattacatagtttacatgagcgagatgaatattttaagcataattgcaacatgatttgataatgtggtgctacaataaacatttgctaatgacggattaattaggcttaataaatttatctcgcagtttatatgcggattatgtaatttattttattattagactacgtctaatattttaaatttatgtccatatatccgatgtgacacctcagtaattttcaccctgatgtagacaccccctaaacaatgccttgattccaccctagctaaattttaaatttttcgccctagtacaagtataggtagcgcaaaagaaaaagaaagagg

SEQ ID NO: 9222 - DNA, 1501 bp, Oryza sativa
tctcccctccaattgttcctcctcctcgtttcccctctacctctcttcccagcctccaaggcagtgggctggcagtcgatagggaaatgggtagctgagctccatcatctcatcacaacttgaggccacaacagagcacacgagaaggagcaccctgttggggtcagtcggactcggtcccatcaccatggccacacggccacgctagatgccctgaggtgcaacaacacatgattttttgcagcgacggcattgatgggcaggttgaacccaaccggagcccgacgcatgtctgctagtcatggaacccaggcatggacgggagccccatggcgaacaccgcccgtagatcgtagatcgggtgggaacatgaatcccatctcagtctcggcgcacgcttgctctgtgttagacagccctgggagcacagccatgcgacaacactacgctcgccagcgcgtggaacgaccgaacgagtggagcccatggtgcggcgaggccgatgtcgacaagggccctaccacgatgtgcatggacaactgccgaagctctgccagggacaaactggcccacactggtggagaaaccatctttcgtcggtcggccgaattccacgatagtcccggttgcaacaaaaaccgggactaaagatgatctttagtcccggttaaaaagggtaacgggcatatttgatctttagtaccggttggtgttaccaaccgggactaaagatgatctttagttatctttagtcccggttcaaatgctgtcagggcttgttaggcccccccgggatctttagtcccgtttcgtgttaccaaccgggactaaagatcgtaactttagtcccggttggtattggtataccaaccgggactaaagatcccggtgatctttagtaccgattggtaacaccaaccgggactaaagtcccacccctttatatatgtcttcttcctcctccagcccgagcaagcttcaaaatttcttcaaaaaagaggggaggtcatgccaaaatttatagtgaatttactttggtgattatatacaaatcggaggtgcctaaaaggttagcaacttcatcctccaatgttttttttggtcatattacatttggagctatgttttgcacacttttttgtttaaaaaaatttgttgtaagttgataagagagaaaatttgtgtgggaaaagaaagaatatacagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgttgaaagagtttgtgattattttatcattattgtatgactgttattattgtacgaatgattatttgtgtacgatttttttttcatttcatgtaga

SEQ ID NO: 9223 - DNA, 857 bp, Oryza sativa
agctaacatgtttattatggaagtagctaacctgtgtatctacttagaaaattatgacatattattttttatacatgtattttgcgtaagtataatagccaaacaaaagatatagggatgaatgtgggtttttatgaaacatttgccataaagcccatgattctttgaaacaagttgcaaaagctagggtttgttttataaatgtcccaaaacctgtggttttatgaaatttactacaactttttttattggctgactaggcctctagaaccacctcagattaggccaacgactgtcggttaaacgttgctgaatgtttgggattatgaaaatcctgaggtgttacttgttagggtttggggtgagttttagataaagtggagagtacaagaggagtaaaatagaattatcccaatcgaaaatggaagtgcacacaaatttagtgggcatagctaactttgacgaccaaatcctgtttttcagctatacttcataggattattgtagtgaattatttattctacatctctacaaatatgttttctcaaaaaacttttcctattgaattaattaaacaaatccattgtcctaagctacataagtttatttatcaaaatatttaatatatatatatatatatatatatatatatatgcaacatatattatgcacaccaactaacaaatgtcaccaaaaatctataaaaaaaatcatacatgtactttcaatagtgttacatctaagggtaaaatgttaacatcaaattcattacattttagctgtaacaaaaaaaatctgacagttttaaagttataatgttgtcataattttatcttttttgttactctctatgtaga

SEQ ID NO: 9224 - DNA, 1501 bp, Oryza sativa
gggagcgtgaaagcgagctgaaggcagcccatcccgatctcttcgccagttcttccgaatctcggggtcgagattccgtttaaggggggtaggtttgtcacgtcccaaaacgactctaaaatatatcctttaaattatgcctagaataattaaaatccgtgtgtgaaagactccaaaaattaaaatgtgcaaagtaaaagtcaaataaggcttggaggatttttgcatatttcctaaaagcctaaaatgtgtaaataaattttagtggaattttcagagcaaaaataataattaagaagaaataaacaaagttaaaaaggttttataaaaagaaaaaccctaaaagtcccccttccctcccttgggccggcccgacccatctctcctctccccccctctctctctctcctctccccgcggcccactcggcctctccccgcgcacgcgccgctgacgggcgggcccgcccgccaccctcgctgacgggtggggcccacccgtcatccccgacctcccgccgctcccgccgcctcccgccgaccgcgccggcttggccgccctcgggcgcgccgagtggctgccgcgtggggcccggccgtcagccgcccgcgccctcgggtgcggctgacgcgtggggcccacggcgccggccggtgcgagcccgggtgcgcccggtccaccgtggaccgtgaggctgccgcgtgggccccactcccggggacccggtccgcgcgcccctccccctcggctgacgcaatacacccctttttaaattaaaatttaaatgaagaaattcgcaaatattcatttaaagagcatataaacttcaaatggtcataacttggccatttgaactcggaattggaccgttcaagtctctaatttttccttaagaagtgaagaacccatttttgtgctttgttccatcttgttatatggagtttattagagtaaaagccttttcttttccgttggttgtgtagacgctgcagcttcggaagatccgctcttcgtggaggctgaagccgacatttcggaaagcgagcaaggcaagtcacattatccttgaacatattggatcccatcttataaaattattttgatttaaattattgcattatcgttttacttaaattcccgcgttatcactgttttatttagccatgcctatttacctttgttatgaccttattattattgttattgatattattaccttgttcaccctagattaaacaaaaccccaactagtggacactctactcatggtaccactagtatgaatttaggtagatgcttcgccgcttaattaggtaacattaggtggttttacaactctagactttgggaatattcatatcacctggacactatggaatggttggattattgaggaattggattcacacctccccctctattcaaaaccctcaaaatggttttaggctgggctcagggtgcatggttttgatagtagcacctcggccatataaggaccggt

SEQ ID NO: 9225 - DNA, 1501 bp, Oryza sativa
atataaaatgttttgttgtaggtgtaaaatgtttgatgcataaacttgacaaaaggaagacatggttgttgaaataggaaatcttccatgtttctatagttaaattcactgtgtcgctttaggacaagcacattttcggcgtctactttaggctccgccatctttgtagtcttggtagcctagttttccctaattaattgtgcgttgtaaggtttagtcttattttctctttaaaatgtgacaccttcttctttatataaaatgtcggcaacagcctaaacgttcggaaaaaaaagtttgctagatagtccgaattttttatttatagtaattattgatccttaaataaaataaatagtaaatctcagattaaatttgtaaaaataggaaggacgttgttcccaatagcgtccagacttggacacacttctgaggagcgtccaaaggtggacgctgttccggacggcgtccaatctggttcacctcatcctcttgggttcggttgttcttcgacgttctccacaaccatttgcaggcgaaggtgcaccatcgccggctttcctctcctccctgcacggctagggcagaggagccaccaccgctgtccacctcgacgtctgggtggcccgcaccgacttccacctccacctgggaaggtactgagtccacctcggctccagcctccggggaggcggcccatcgctgtcctcctccacccttgagaccgtagccgcttgcctccatgcccaagaaaccaccatcgtcgttcccctccatgctgtcttccatcccttctcaagtacgccacaaggttgctgccaccgccttcagaggagatgcgagcctgttactcaactccgcagtgctcgtcggtggtagactggaagcccaaacgcctccattgcctctcaccgccctttgtgatgtgttctcttcaggtaattctttatttggagcttccattcctcagcagttcatggcctaccaaattaaagcaaaatgattagttcatttacttcagtacttggcaatacttgcatcaagttcagaaaaaaatctctggcttcacgaacaacaatattactgatgctaatgtccatcatgacatacccccaatgttgcattggtgatcgatcttcttgataaatttgaatgcaggttagaaaaaccggctactaattaataatgtcaattatgtgttatggatgccttggccagtcaatgtatcaaaactatccgaaaacaagacattggttcttattttgctttattttgtgtgctcaacgtctgtacttacaggctatactttcaaatattagtgaattccatgcataccactaccagttaattgtcatattctgtttatatgtattcttctgtacagcctgctagacgctaataggagtaaaaagatagagtaattgagtaaatgactgcatcacattgacaaaattgataacgtgtacagtctgtctgttagagaaagggatgaaggcaaagc

SEQ ID NO: 9226 - DNA, 1501 bp, Oryza sativa
cctggaaactatatttctttaaaataaatccccatccatttacttatcttttcctctactttcatatgcatatgttcttgttttcattgttcttcgtaatgcatgagaaatgattcattaaaaaaacgagataataagaagaatatatagtatgatacttgcaaacctaacttttaggtgtaaaataaaagaaaatcggcatgacctttttctatattatagacttcgaagcaattcaatattatgatacattcatatcataatagttcaacaacaacaattcaacagcctcacattttaaaagcattatgatgtccacgtgaagctgaaatgagagagagggatagagaaagatgagaggaccaaggagatattttctccacttatggaccttaatgtgacggataaacaatgcaacctaaggcccattacattatttcctttttctattttcttccatacttttggttttgcccacaaatttggatttatcttactcttttttcaaaaatttcttcaccatctgccactacaaatcaagaactacatccatgaatttttttgatcttttttgtttttttcggaattttaaatttagataaaattcaccaaacactaccactggtaacccctacggtaccccacgattaccggcggcaagggaaaccctgggtgagaaggtatatatatttttcagcaagacataaaaccacgaacattagaccttttgttcaatattttaagctataacatacataaatggagaccacatatcgtactacaaaaatcaacaaacaaataatcaacggtgatccgacgatgaaacatttctttttaaaaatctctgtgcgaatataatgctgctacaccatctaattaaggggcagatgcagatgcagatgcagtagtagtggtgcgcacggcggcgaaggcctccagcttgtgggcgtgcttcatgacctccggcgtcatgttctccggcaagtagcagaacacggcgtactcgccgtagtcgaatggcctgtacatggccgggtggtcgccgtcgaccgcctcgtcgagcgggcggacggcggcgccgtccaccgggagggagaagaggatggcggagtagcgggcctcgtcgccggacaccaccacccggtgcagagggttgtacacttgcccgtttgtcagtgcctgcgtgcatagcagtaatattagtattactaaactgaatgcatatatgcccgtaaatgagattccctgctttatacaacattacccatactagacatattactcttgcaaaactgaaggagaaaggctgggagactatcaaattcaggactttgcatggagacaaacttagagactggaatgggattaaacagatgtggaggcttttgaatctgcaagaaggaataaaagatagaatgtggtggaacttggaaaagaatggctattttactgtcaaatccttttataaagctcttaaaagggagcaagtggcattcccata

SEQ ID NO: 9227 - DNA, 1501 bp, Oryza sativa
cattattctttttttccattcttctgctcgggttacggagaaaggagaacaaagggaaaaaaaggaagaaaaaaagaaaaaggaaaaaaatttaaattggtctcatttgtcagtcaaaatgatgccatgtcatgtccgtgtggtataccacatcaacgccacgtaggatccggaagggattgtgatgatttgggacctaaatgacacactatgacaaattctgggacttgaatatatatttcgagagtttagggacctaaatgatatatccctacaagtttaagaaccgtcggtccactttactcttatttttatttttagtttgcaaatatgtactgtagtttaaacgatgaaacgctcagtgccacagcttactgctggtccggtcctcgcctgctgagtgctggctgctgcagctccaaggcaacaatggtgagtgggaggtccatcacctccggcgccgccgcgccgtgccacctgcgaccgacggaccggcacaccatggccgcgtgccgctcgcggcagcgaccacctctgccccccaaaacaagggcaaagggcccggcgcgccgctccggtaagctccatcgtcaaccgtctccgcgaggcacgcatcgtcatcccctctcctctcctcttctccgccgaggatctgctgtctcgggctcttttttttagggtttagggtacagtgctcgatcctgtaataattctgaaaaaaggcagtgcttttcgtgtctctgaatgccacatcacaatgcccaaatgccacggttgcaccgattttattccgtttctcactgtccaaatgccgcatcacgatcgcgccatgattattttttttttagccctcctcaccagctaacttttattcagataaaagggaatgattttttacagggatgggttattgggggaactacaatacaacatcactggtgaaactgaaaacaaccaagagacaggctaactaaaacatgttcagaaacatcatcaagctaaaccggatttttattcagacagaagggatttgttttctgatttgagattgcagccacatcaacatcaaagataggagatatttcagagcacacaatcttttcgttgaagactgggccacatgatgttggcaagagcaaccacactgttagttagggagaaagtgagcaattaatttaaatatataaattgcccctctgaatcttctagccgattttgtaaataaacgcacttctgtaaaaaaaaaaagatttctaacacctgggtgggtagattgaattgcaggcagaacaagtccaagtttgcaaatccaggagagaccaggattagtgaaaagccaaccaattgatgcttgtcttgacttgacctggcaataaggttaggtagccaaggagtccaatactggagggttgatcggtccgtgttctcttccacacaaatcttcttaatcatcttctttcctagctgttgatattgttcttcctgttgagaaattgacagg

SEQ ID NO: 9228 - DNA, 1501 bp, Oryza sativa
gatgcaatccttcataaaagattctataaatacatgcctacagaaatccatcaataaatgatattttggaaatgaaaggatgggtgtaaagcacaccatcgcaatcacctagtccattaagggattgaggaagttgtatgtatattttatttccttcacccttctctagtttgatatactataacttgtttcagggtagttcatatgtgaaagttggtcaatgctacatggtcataggggagaaaaggaaagcaattccttactttcagaaaggttctgttctatttccttcatgaaacccttcctctttggtagcaaacttgagattgcttaagaagttaagatatacataaaaagataatgctggtgaaaatccgtcacagcaatgttttgttggagctttgaaagtagtattacatggagaggatcttatgccctgtctcttcttttctgaatcaatttgctttctgatattctcataatattccataattgttctgctttgcattccctacaccagattctatgcattgttctcaaaatcgttagaatatggtattacaaaagagagaataaattctattgtcaggggtggtgactgttatttgaatggactttatggagattgagtttcttaaatcatagacaagagtcacgagacattctaggattctgagaaatgcagacatgacatggccatacagaaaagacaaatcagaacaaatgaaaaaaaaattgtattacaacaagcctaagacaaaacagaacaaatataaaaaaaatattgtaacaccctagcaattacaacaagcctaagatgctggtaatataatcaggagcaaaaaacatgctaacaagtaaaacaacctaaacaaagataaatagactaagttttacatctcaagtgttcatttagcctattaactcaataaatacattatggtttattaaaatgacaacttaacatttaaagattaaatgtgaacatgacgtgcagaagtgtgttgctactcccatcccctcaagcaagcatgccacatcaagtacctagaaggattgctcagcaagcaaactgctttaacagtttatttaagctacaagttcattaggtgattatttaaatacgagagtgcaacctcattaaaaaaattaagttaaacttttacataaactttataacttcattggtgaaagtaaagccacatctgcataacttctcaagaagcaactcttctcaaagataaccccgattgtataacatctagcaaaactgcaataggtgttttcctatggaagccactctacataacttattgcaattctcctatggaagttatacaattggagttatatttgagatgtgtttgcttctcacaatgttgctttattttcactcatgaagttatgaagtttgtttatttgcaagttttaacttgttttttcagttttcatttggattttatacgaaaaagaaaaaaaaggaaaaaaaaaggagtcttta

SEQ ID NO: 9229 - DNA, 1501 bp, Oryza sativa
attttactaatgaaaacaccaccggtgttaaattaacagctcatctcctttatggatattccatgaaaaaaaactgcaggacgaaggtatcaattatcaatagttgcagtcctcttttcattttgaatgtttatatatattgtatgtagcattcccaatttcacaatagctagtcaaaccatatttatagaaaaatggagtagtattttcaacaaaaaagaaatatgttactaaaataagtaattttaacatccaacttttgctaccttaaggtaccataaatttttgatacatcgaatcattttctagtgtaaaatttaatacctcaagatgcttagtacctaatgttaccaaaattttatgtgtaaaatgtgatatatacggcctggaagtacaaaatgctgaatggtaaaattgctctattaataaaatatattcactattagatttaataaaactaatttggtatttactgtatttttctataaactcaatcaaacataaaaaatttgactttaaaataaatcaaacggagggcgtagaagtttacaaccaggggacagtatatgtccatgatagactaatgcacatacccaaattaatgtcgtccactttgcagttctgataataattagtgcctgctagctagtaattcatactttctcatcttcatgcacatttgttcatccacccagctacttctagtgataaacattttctacatatatttgtatctatatatatcacaaaggcgaggcaatgcaacatgaaacttcttatccctcttaattacattctttttgaaagaagccccctctttcaaataaaattgcatgatccaaatatcttaaaatgggagagcaactagtcgtggctagggcagcacgtaggaaatggaggcaccaggaagtcgagctagcgtctctgtgcgcatttcggtcaagtgtttcttgatcttagggagagaatatcacataaccaccgagtggagaattattcaagcggctagccactgcggacatgtaggaaataaagacacgaggaagtcgagatagtttatctgcgcaaaatgttcttaggataattttatcatcttaatttaatgtaattgactgagtttaataaaagcttctattatcttaaaaaatctgctcaatctccatgtgcttgttcatcatgatggtcaaggaacatatagctaatacctagctagagaacagaaaccgcaagaaataaaagaagacaagcgtctgggctatgcttctacgatcgagtccctagggtgggtggccaggaagtgagtgaaatcagtgctttgccacactgacatagtcgaaccatgttacgtcgagaccgtgactggtaccactgaaatatggcactcctccctacctgcggagcttgacaaagccatcaattgggtcaaaacagaaagaaatgagcaagtggacagatagtcacagactcacaacctcacttcatgttatgttgcttatcaagt

SEQ ID NO: 9230 - DNA, 1501 bp, Oryza sativa
tttcaatttaaggaggttaccgtggtatttatattaccgtaccccgcggtaagcccggtaaccgtggtaaccgcgcggttacagtcggtaagtcgaaccctgccactacccactgttctatatgcacacacctgtaagcaagtccacttaataaacacaaagtgacggatgtcagaagcaaatttccaacctcactataaaatagtattaaaagggtacttgtgtgcttgcaatattgtaggtataagtattgatccctggtgtgtgaagtcatgtatgaaatattttgttatatgccattttcgaagatggcattcagatgtgcaagtgcacaaacaaactatagttgtggtatattaacctgtcaagctattagctaaacttgaggggagggacctaatgtttttctttgaaccaagtgatgggacctaacctttacagcctgtttggcaacaattgggaggaggaatgagagttcagttaaccagtaaaatactctctgtgtatcttacactggttttgggccaaaataaaaagaaaagaaaagaaaagcttccaagcaggtcctagtatgtttccgacattttctagcttatgtgagctagaaagtagacatgttcaaacgttattctccttgtgatctgaaacttaaagactctgtgtactcaatcaagtaggattataggaagctacttagtttgcttcaccttgaggtcttgtgaaaatgttgttcatcattttctttttgttcacatacatgatggatgtccactattactgttttcgcattttggattgagttagcaattattctgaatattttgcaaaaaactcaacatgaatagaattccccttacatggtgagtgattaaacagctagatgatggtgggagcaacggtttcagcttcagcgggggtgatgaactctctgcttgggaagctctccaccttgctggacaaagagtatacaaagcacaaaaatgtggaaaaggatgtgatgttcctgcaaagggagctacccagcatggaggctgtgctgcagaaacatgcaatgcaggacgagcttgatgttcaattgaaggcctgggtgagtgagttgagagagctggcatatgacattgaggactccattgatgctttcatggtgcgcattgagcactatagtgatgagtctgctggaattaaggggtttatgagtaagaaaatccacaagctcaagaagctccgttgtcaccataaattttcggcggtgtttcttgaactaaaagagcgtgtcgttgaagcaaacgagcggcgaagaagatatgaggttgatgggtccacatctggaaccacaaccagtgattgcttgttgattcccggttgccagcactctattctggtttagatgagcttgtaggaatcaagggtccaagggattgtataatcaagttgctaacttatgaagctgatagtggcccatcaagacagcaactcaaagtagtgtccattgtgggatgtg

SEQ ID NO: 9231 - DNA, 1501 bp, Oryza sativa
aaatactgcataattcaaatcagaacaattcggaactctcctaaaagcaaccaactaaatactgtattttagttcagacagcggatgcaattggcttcagttttgtctcacagtggtgaaagagattatctgcatgttaagtatagggaaaatatcttcgttcctgaatatagcaaattacggcctcatggagaataagcgaaacggtatatttacaaacaaaaataatttatgaataaaacttttatatacgtattcttagcgatctaaaagcaaaggctgaaaaataaacttcgataaaaaaaaccctaaaatcaacttcaaatttaaagttgaaaattcaaattttagttgataaatataagtataagcgaaaagataaggccattagtactgatgggatgtagtatatatactagtacttattattttaaaaaaatatgtgactgatggtgtgtttgcgagtgaccagcataattgtagtgtaagttttaattaaattgtaaaagtaggatttgactgttttctgttcttttgcaaaatgtggagccatgatacagctagtcccaaaatatttatcgctgaatcttaaaatatgcatgcataatttccatgttattctattcatattgtttgtttcaatagtcacactataaattttgtataatacacatcatatatgagaattaggaagtaattacttacctactaggaaggagataagagagtagataacaatcacaaagagaaagatcaagcaaaatgactgaaatcaagaaaaaaatgatgcgccatatttttagctaaaccgattaatttttctatactttagagcttattaaacttaggaccgagcctatcaacattcacagggaaattattgaacgtgaaaaaaaaacatgtgaacagaaatactagagctacctgcaaaaggaactaaactcattgccttaaaaaaaagcaataaacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatccccttgacagcacagaggcaacagcaaaacacactctcatcagtgtcaggtctccacaccacacccaagtacaggtacacacaagacaatcctcccactgaactgaatcccatccactcctttatcatcatcaccatttccctccttcccttttcctcccctcatttccatttccagttgcagcaagagctgcctcctagctctcttcctgccatccatggcaaatg

SEQ ID NO: 9232 - DNA, 1501 bp, Oryza sativa
accatctttcaaatggagcagagcgaggcagagagttttgattagactacacgtacgtagttctaaaaaaaaaacgtacagtacgtagcttaggccctatttgatagctccaactctctaaacataagtctatatttgtgtgagagagactaaaataagtccctcctatctcaacatcacctaagctttaggagttaggtttgaagtgtagttgtgaaacagtcaaaatctagttctatatatttagtttattttataatagcgctccatttaaattctattttagttagaactgaaactgtttagctgagggagttagagcagtccttacttccataactcggtacgcagatggttacgtaacttgcgtattactagctactcttacgcaagagcgtacgcctgtgtcctactggggtggctcggtagctcctcttaggcaaaccactgacatatgattaattaaattttaactattataaacttaaaagtagtatctgatattttaaagcaaattttttataagaaggtttccacacataacttataacttagtagtttgcaaaacatgctaacagaaaacgaggtagccaccactagaaaaacgattttttttcaacatcatgattttattttttcagacggactatcaaatcaacgtttacaaaaatagctaaagatacagtaaaactagtcccgcctgtgttgggctaggctgaaaaggtcaccagacaactaaacaagagaaagttgcacacacaggtgcgaggcaaccaaacacaccctatagcgttcatagtgggcactatagcagtagcgagcccctaccgctaccgctacgacgacgtagtggattgtacatagcatgttggaacttaatgggccgttatagcgtctgtaatttaatttagcggccgctatagcgtgagcctattttatataaccaccaacacataacaaatgatgagtttgttagttgttttgtcttccaaaacattttcttgtgagtcataacgtctaataagtagaatatcatgtttgtttcttaatttagtttaagttggcacgagatatgaattctccaagtgctactaaacctctacttatcctcataggttataggtgtatcgatctatcactaatttgtttatgatttctttgttaatgctttataaattcattattcatgatacataagtatatatatacctaaatacgtgtgacaattaaatgatgttattggaacttagcgtctgatatagcacctgctatccgtgtaggatcgagatgtcgactagaggggggatgaataacacctaatcaaaactaacctaagttgctaggcttggtgatggtgaactctaactaagcaactaagttatgttttgcaaacctagggtgatagtggctcaattatatctctaggaatgcaaatcacactcctatgtcaatgtttagcaatcctagggtgatatgatctcaagtatgtctctagaaatat

SEQ ID NO: 9233 - DNA, 341 bp, Oryza sativa
aaactcattgccttaaaaaaaagcaataaacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatcccctt

SEQ ID NO: 9234 - DNA, 313 bp, Oryza sativa
aacaaacatgaggccagcaaggctctactagagttcaagcatcaaaccaagcacaacaaaacaaggtataaaactatataacagtagcacagaaaaaaaaaatctatggacaaggcctacccagtacccacctcaccctgccctgccatccccccttgtgatgtgtgaatgtctctatcttacttgtgatagccagtatcctcacctcacccacagcccaccaatcacagcactcctttgtattctctctcctacatgcactcccctctacaaaaccacaaccagcatttttttcttttttcacaatcccctt

SEQ ID NO: 9235 - DNA, 528 bp, Oryza sativa
acgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaa

SEQ ID NO: 9236 - DNA, 1501 bp, Oryza sativa
atatatatatatatatatatatatatatatatatataaaccatgcatatatatgtttcaatacatatatatgcatacatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctcca

SEQ ID NO: 9237 - DNA, 1501 bp, Oryza sativa
acggccaagacaccgttaccgatatgcgtggtttgagaccgttgggtttctgcccaatcacggagaccggtcccacctgtcaccaggctttatgagtggcgtcatgcccgaccgcttcccttgagaaggatgatcgccctgacataacgccgggggctactgtcggtgatatgggaccgggagtattgcgcccggaggcttgaggcagattgaatcgcccacgtggcctggcaccctcggggacgtcgggcccgagggtgaggtgtccgccctcctcctgatttccccgagggggggtcgggttgcccctgccccggccccgagggccgaggtgccccgaccccttgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcagatcaacggttaggtggcgactggcggtctgacgcacgcctcgccccgttccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcggacggcaaccataccaatctccgtccataaagagaagaaaagtccagtttggaaaggaaagggtacatgtggtatccccttaagatataaaaggaggaccatgcccacaaagagaggggactggattttcccgggagaggagagggctggttgatattttgtaacttgctcttacacagatccaccaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcaagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtaga

SEQ ID NO: 9238 - DNA, 1501 bp, Oryza sativa
taaatcaataaaactctacataccacagcacagtaccacacaacataatcaatttaatattttaaaattagattcgatgtggatctaaaataaaatttcatcgaaaaaaagacgagagaaaaaaaatctgaccacaacaatagaagattctctcttttttctccttgcctatctctaaaataaatcttcatcaaaaattcaggtagttagaaagtttgttactaaggccccgtttggcacaactttagctcccaactccaacttacctggagcgggagctgtgccaaacgattcagattcacctttttttggagtggagttggcagagctactcctagaaaatgaactacgggggtggagctgggtttttgctgctccacagctccactccaccccaaaagacccactaccctctaatattttagtgtatttacacgaaaatgccactcaactaccctttcaccccttctttcctcccgttctctctcctcccccaatcttcctcccaatcccgagctagtgcggcggcatcggcgggctgcggcagcgttgacggcgacgggcagcgacagcggcgggcggcggcggctgcgggatgacgacgggcggcacgcacgcgcggccggaggctggcggcggggggctgcggcagcggcggggagcggctgttgggggacgaggacgggcggcgcggcggcgaggccagcaggtggcggcggcccatcttcttccccatcctccgacgacggccacaaccggttgtggcggcgtctgcgttggcagcatacgggggcagcaggctgcggcgcatcggcggcggcaggcggtggcggcggctgcgggcggtgttgcggtggccgcgacaggcggtggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgcgcagcggcttgggaggcggcggagatgcgtgggcttctcggcggcggtggctcgtgggctgactggctacggcggcaacgtcaaggcgacgcctagaaggtgttcgatgaaatggcgacaaaggatgtagaaatatggagctgagtaatctagccaaacacttttttacctacctcagctcctagaggagctagctctcactggagttggagtttggagttgggagttggagtcaggagctctaccaaacggggcctaatattttgagattcgcaaaaagataaagaagaaaaaaacctttatatatactgcctcctgtatctctcgcgagtacaaaaatactgtagcttcggaagaagaagaagaagaaaggggtttcccttccgtacaccagcagcagcatcagcagctgctcctccccgcccaaaaaaatccaatctttccccatggcggagcccggggaggatgcggcagcggcagcggcggcggcgtcga

SEQ ID NO: 9239 - DNA, 1501 bp, Oryza sativa
tttaaccaaggatatgtcgtcatatcatgttagattcaagcccactagttgccactttatgaagttattgataacacaaagacaaagtaagatagaaggagttgcatggttgttaatgttaaacacacaaccaaacggatataacaactaatgcacaacacactttatagttaagttagcccaaagaaaataatggttaacgtcatatgaaaaacatttttttcttggataaaatcaaatgaacaataccaaataaacaaaaagcattagtataatggttcttgcacaaaatgtgatccagccaataacactagttttaaggagcatgattggcatttattttttccttgaaagaattgtcgtatgctttacttatttagatggttcatccataataatagttcatgccaaacatgcttttttttctttgcaaaccagaagatgtttacaacaacatttagcctgagtttttgttttgagctttaccaactcaacttcctcgttgttcgcacacatgcttcccaaactggtaaatggtgcgtgttttgccaaaaaaaaagaattatacaaaagtttctttaaaatatcacattaatcaatttttcaaaaaaaaaccctaatacctaattaatacacacgctaatggactgttccgttttgcatgtttgaagggagagttcccaactccaactaaaacccatccttaagtcttgtgcttttcttccttttcaactaaatttgtttgtcagttatgcaatacgacacattcaagaaaagaagttatgaaatatgacaaaaataccattctttacataacaatgcactgccttacaaaaaacagacaaacaaagagacttgtctatggtgatagttaaagtgtgtgcgcacaacatgaacatctgtacttgtaaagtgatttacctgtttcctaagtgaaatttcctctatcagtcttatcccggtggtagtcattccaccttgagttgtagctcatggcaaaccttagtagcccttccaacacaaacacaaacttaaaaagaacactttgattcaaaagagaaaagataacacaattagatgaatcaacagggcaaatgttacctgcttgttcagggagagatgcccatttccaggttccttcttcattctcctggatgaagcatgtgaacttccctctaaggcccatttcaatgttttaataccactttccatctccttgattttttgtgggaggtcaaactaagtttgtactttgcttaggaaatgtgggttgtgtgtgtgtttgtgtgtttactcacgcatacacacagggacaaattaagagatcgagagaaagatagagtcagagtcagagtcagagagagagagatatgttttcctcccatatatcttcattcatgtctagatttaaggtttgtgttattagaatatcatcaacaataggtatggaatgttaagagagtcttgcatttgaggtaaaagggacgaatatcgaccttct

SEQ ID NO: 9240 - DNA, 1501 bp, Oryza sativa
ccaaccgaatgtctaacctaagtgttttgttggaccgtcggcccacgcgtggcccatgaagtgtgcgcggcccagcagtgatgcggcccgacaatggaggctagcccgacatgggatcgatctgagctgttcgtttttatggacggctcagatcgtttctgaatccatcaaaaccgccggggcaaaaaaaatccataaccctaattcatttttcccctccctccctccaccgcaggccacctctctctcctaccggtggtgcccctcctctctccccaccggcaacactgctcctcccaccgcgtgctgcccctcccgcactccccaccggcaacgccgctcctcccaccgcgagctgcccctcccctctccccatcgacgatgttgatgttggatagggtgagctccttgaggtgtgggaaattgggcatgcaatcagtctccatgggaaactgaagtgtgtcacacgttgaacaaatcctaagaacacatagagtatgcgctagacagaatacagacagcggaaccacagattttgagcgtcaatattaaaatagaacagttcaaactcctggagtttgcagagctgaggggatccaagcaagtaatcgacgatgaagaagtggttgtagtccaatgtccagctgagggagaattgacgaacacggcccctgtgggcttgaagcacggtgtcgatggtggtcacgtccttccccatcgtgctgctatcgaccatggcctcaagattgagaggcgccgattgctagagcagttgccaccgccgcgaaagcatctgtgtgcgggcagcatccttgctgaggaggatgctgatgaggatatcatccgggaggcggcttatcaagtcttctcctcctctgggcgccagttgtgggttgctggattcctcatccagcatcctcttcttggcccttgtcaccacacccatctgtttaccacctccttcttgtgatccaacaaaaaaaattgggcacccaaatcttgaatccttctgcggagtttggatcaggcatagaacctaaccaagaaccacttgtttaattttgttgaagtgattgcagacactagactgtaaacccctgcaggttcggaaatgcaagaatgccaactggggcaaattaaacaaatttctgcggtagtagatttagagtggaaaaaaaggtctctcgatccatatagacatgtgaaattcgagatggtttggagcaaaccctaacgagaaaattgcttgccttttgcagcggtgccctatcaccgatcgacgagtggccgagtctgggagttcacccaacacacgaccttcgccgcaggacgaccaccgccgctcctccgccgccgccgccgctgccgccgccgatgaggggagagaaaagcgacagcttcgggaatgaaatcgtgcgtgcggcggtggggattccagtggtcagcccactggcccagaagatcacggatagatggaaacgtagaaaaatgtaacttaccg

SEQ ID NO: 9241 - DNA, 687 bp, Oryza sativa
attcctgcagccccgttactcgatgcaatgaactgatcatggacacatcacacatataaaatgaacgaggcatatattgggtaagtgagagaacaacgattaacatatgacgattacatgtggtttatgctaccgtatatatataataattcttcctatatatacccatgttgttttgttagagtaaggttacatagctccattataccatatattgtttttgaccacatgcatgcttcaagatttgaagcatgcatgtggtcaatagcaatttcattaggattaaaaatcgttcagaaaccgtgctacttttacagaaatgataattgatcgctcagaaatttatgccaccgtttctatccaaactcgtgacatgtcaaactttgatatttttttcgaaacacagtacgcacgtaggcgcttatatatattgtgtttcgaacacacacatgcactccctatctatatctatatgagtacatctgaagaatggatcgtcatatcttgaggttcacaaaattaccacaggcatctcgccaagtttagaacttgaacatagataggcagtttccaccaccatgaaccttaagcatgcagttgagctacactaacggagtgagctggattaagccatgaaaatagttaaaagtcaagacgccaaactataaaatcttggaatcttaaaaa

SEQ ID NO: 9242 - DNA, 1501 bp, Oryza sativa
ggccctcgtgggctcgaagcgtgtcatggatggcggccacatccttccccattgtctcgccattgacctaagcctcaagattgagaggcacggagcaccagagcgggcggcgggcgccaccgtcatgagaggacctgggtgctggtgccatccttggtaggaaggagagtgatgatgcccctgaggacatcgtctgggaggcggcttatcaggtcttctcctagcctcgggtcaccggattcctcctccagcctcctcaacctcctcagttcctccaccctcctcatctttctcagttccgggtcgcaggattcctcctttaacctcctcttcgtggccctcgtcacaacaaccatccgtcggtcgcctctctgccagtcgtagaaaaatctgccgccgtcggtcgcctctttgcgacccataatagcaaaattccgtggaatctgcatcaagtttggatggcaatggaatgcaaaaattaattaatgctagtccaatggagaaacgaaatttttgctgcattacaacaagaaaaatagataatgttcacgaaacttctgctgcattacattacgagaaaaagagataatgttctctcgatcaggattaattataaaggaattcgaaattgattaattataaaggaattcgaaattgatgattagaaagagcaacatgcaaagatagatgggggcggcgcgaaccctaaccagaaaaccgtttccgctttgctagggccggtcttgacatttggaaggcactagacgaactcgacactataggcccttaaggggtgatgctattttttttacttctaatatatatactctataacctaacttttagagtggaaaaatcgaaaaatcatataatcatacaagcgagaaaatcctaagtccataagtaataagtcgctaacctaaatttcttcgaaaaattgaagaaataacacaagaacaaacaagaagtctttaacctcagtttgccctcctcctgtagccccgggcgtcggcgtccactgtcaggagaggtccaggagagacgccgagatcgtgagagaggcgagtccggcgatccggcgtacgtcgatcggccgtgcggcgtacgtcgttggcgcggccgcgcgcgcgacgcgtgactggcggtggccgggagtcagcgagtcgctcgtggtcgcggagggccagaggcggagtacgtcgtgatttgcggaaagaaaaaaaaaacaaacaaagaaaacgaagacgccaaagaagtcgcaattataaacagggagcacctttgcatctttcgaaaaatttttataatcgtatcacacatatttttaatctttagattaaaatctgatagacacagtaaaagacaaaaagcaactaagaaacaccataatgagcactaaattaccatatcttcaagaaaaaaaaaccaaatccaatacaaatttgaaaacttacatgcgaagatttaaaaattacacggtaacttacaaaagttataatgt

SEQ ID NO: 9243 - DNA, 1501 bp, Oryza sativa
attgtatctttgtttatcttgcccactttttgagtgtctaggctggatgaaccattgaacccagcccaaatatgagatataatgaacctaactagcttagttaggttagtacattgcctcatcaatgcccgcaagtttcgccgagtaagctccaattttgtcatattttgtacgctctatttatatatagacacatataaacatatcaatatagaaatattaaaggtaccacctataaatttaatactagagctttttggtgagaagccagcggtacacatatatacaattcccgcccatggtctcgttacacagtttgaagttgattttgagtctcgctcagagttgcatccttttaaaatgatgcttcaattgttgcttagttcaaccatatggtagtaacttttctttttattttgtgaaagcaatgtttttattccgggttcatacacaccgtacgtgtggacgtagcaaataaaccacgtgcaatgtctgctttgaccttggagttgtagtactgcgcatgcacacaggtcgaggagaaagcaatggtttttggactgattcactggtcattgcatggcttgtgtgtaaccgttctccattctccacatcacatttttgactcggttttggattaatgtcctcatattttattatggtcatccaaatcctccagattcatcacccccattttctgcagccttatccccaataatattcaatccccaattaaaatacaacttgtttttttcaatgtttttaataaaaacataaatttacttaaatttcaagcctaatactattttaaacttcacttccaaataagctaaacacggaaggagtttaatacctaataaaaattgtgatttttttaacttcttagtattatacttagaatctgtttttcaaaatttaattccaagagctggatttggagtttaactagctccacttctattctggatggagccgaaattatttagctggacttgaactttagaataagtggaattgaagctagtacgaaacagaccattaatcttgaattattttgtttggatcattgtattactcccttcgtttcaaaaataaatcaacctcgtattaaaatgtgaatacaatgaatatggatatatatctagatttgttgtgtattagtaagagatgatttattttgagacgttgagggtacaatggtactattattactccagccaataggggagaagaagtcaatccagaacctagacaaaaacctgtctctcttctcatctttttcttcttctctacggcgagcgcctccgcttgtttgtgtctataaagttgtggactttctcgccgccattgtcacgtctcacgtgcgcgccaccaccaccccatgcagacccagcagcagtagcggcacggctctcctctctcgtctcgtgcaccacgccgccgcgcgcgctcgctttgcttcgagagtaatcgatggccgtggaggagtcgccgccgccgc

SEQ ID NO: 9244 - DNA, 1501 bp, Oryza sativa
aaagttcaaatgaacagggtgagacagagccttgagctgatctggtccctctccattgacagcagacagcaaacgtaagaggttgttgaatcgaaaaaagcttagctgtgtgagatatttgctgatgcaatgttactctgtcgtccacgcttcagagttctgagttcaacaagtcacatgataaaaaggacaggcacaacagaaaggaaaagggatagctacaaaacccatatgctgaatttgaactgcagatttaaacatggaatatacaaacaattcgattatcaccattaaatgttcttattacgattctttggttgggtgatagctaaaatacatcatggcagcttgtggaatgctttccacttgccaggatcaggacatatggataattggataagtttgagaagtctcatctcttcagaaactgcatcccaatatagttatgtttgatgttcagaaatcagaatgctactctttaattaaattcgacaagaaactcattatgttcagaactagtcggcaagagaacacctgcagcaatcactgtcaattagactttcagaagacgagtaacggtcaagtattttgttctttctgcaatctgaacatctttggctgcaataaatcattgcagcatgtagtaaattaactgatggtagtacaaacaacacaaatctgaaatcactggtgacaaacgaactgtaggtgccattgatttcattttgcatcagcaagagcatgagagtttatgcccggtccttcgagaacatacacagcaaccaacaagtactactgtactagcaatatataatttggtcttgaatggcacatgattcttctagtgataagctcgaatatagtttttattgacagcaatgtggaaacactgtcgaaaaagttggccggtgttggatgcaaagatggattcttgtaaatgcaaaatctgacctcttttttcttgccattgaaatgtacatggagggatcaagttccatgaactagagccatcagaaaataaagtttggcactacttctcccacttggactttgcccttttggtcagaatccctactctcttttagcttcatgaggaattctcttgggagtcctaactttcaatttaggcacaataaacacagatatgcattgcaagtttgcaatcacttgtttaagctttaaggagaatatttggcaatgataagatatttattgttattttattgtattattattattattattattattattattattattattattattattattattattattattattattattattatcatgccctgttccttttttcttttcaatgtctcattcaagaatcatataccatttggaccatgctaatgatgtcggtatatatagcccagtgatcatcggtacccagaccatcgaaacaaaacattcttcagttgatcttgagattaagtcactcctccatcccatctcaagaactgatcaaggaaaggaaaaaaaa

SEQ ID NO: 9245 - DNA, 1501 bp, Oryza sativa
aattcattttaggcgttccttttcaaattttttaaggctgtgtttagttccttctaaaattagaagtttgggttgaaattggtacgatgtaactgaaaatttgcgtgtgtatgtcaggttgatgtgatggaaaaagttggaagtttggatctaaacacagcctaagtttcggctttttaaccaaatatcaatatactaaacgcctaccgtaaaactactttttcgtaacatcgtttttattctatggcttataactcgaagcctatcaatgtgactagtactattttattacttaatgaaacgtctatacattatatatatcaaaatgttataaaaccgtaaaaaagccatgatatcaaactgacaaaataatactctatccatcctaaaatataaggaattttatgtggatgtgacgtatcttatactttgggtgagaggaagaggtactaataccactattatattgtactccctccatactcgtaaaagaaatcgtttaggacagcgacacggtttccaaaacacaactttgacttcttatttctataaaagtatttattgaaaagtgatatatgtatacttttataaaattatttttcaagacaaatctatatatataatttttatattttcaaactcaacaacttaaaagttatttatgatttatattcctaagatttgatttaagcattgtcctaaactactttctttataagtatggagtaatatgtattggtaacagtacagtatatacagcagtagtagtagaatatactgtactgtagggggaggtttgggccggcagaggaatgggccagtcgcacatgccgtctgcgtgcgcttcccgcgacctagaatatcgcccactcgctcaaccgcatatcccttcctaataacctctccgatccgtaaacctcgcccatgcgccacgtcccccctagtgtcctacctcccggaccacccggtcttggtagaccacgtccacctccccaactaaaatatcctccctaacccaaccaccccacggtaacccacgtacttaacgcgagttaccccccgcaaagatccaaccgcctctcgcaccgcccgcctgtccacccacgcctactgacgaacccggcccacctctccgggccccaccatgtcgtcaccacgcaggccaaaatcggggagagcgtgtcgtggtcccacctgtcattggcttcgtgggtgggagcgggtcacgtgcatctcgacatgactcgaggaggtaaccatggttatggtaaccccaccgccttgacacccgtggttaggggtgggggcgcgcgatgccgccacgtgtgacgatcggacggctgcggagggcatcggggttgggcgacccgcctatttaaccgcgggggcctcgtcttcctcaggccacgcagcgatctgaagtgaaacagcaaaaaaaatcaaacaaaaagaaaaaatattccccatctgtgaaattcgcaaaaccctagcgcggcggcga

SEQ ID NO: 9246 - DNA, 1501 bp, Oryza sativa
tcgctgctccgatgaagcctcctcccaccctccgccgctcgaagccacgacgtccaccattcccgacgaaacctccatacctccaccccaccaccccactccggccgccaaagcaaccaccaccaccattgcccatccgccgcggagggcaacgagtcggcggcggggccgtcgccgtcgccggcggaggtatcgagagaggcgggagccaggaagggcgcgtggggggcacgatgaagaggcgctcctcggggcggggtggctgggggagcggcacgggtggcgcgatgaggcggtggggcgggacgaacagcgcggcgggaggaggggtggtggtggtggtggtggccggcttcggcgaggggaggaggaaccggaagaatccatcgtcggcgagatgccgccgccgccgcaagggctcgccgccgaccatggcgcgcggtggttcgcgacgcggggcgaggaaggcgtgagtgaagtggagtggagaagaaggcggattcctttttggctttttcaacgaagtggtcaacaagtcaacgcttttttttaaggtactccatccatctctaaatgtttaacccgttgacttttttaaacatggttgaccgtttattttattaaaaaaatttaagcaattattaattcttttcctacattcattgttaaatatatttttatgtatacatatagttttacatattttacaaaagttttgaataagacaaacggtcaaacatgtttaaaagaagtcaatggcatcaaacatttagggaaggaggtagtaatagttaactattttgttagggtgtgtttagttggggaaaagaaaatttttgggtgtcacatcggacgtttgaccggatgtcggaaggggttttcggacacgaatgaaataactaatttcagaactcgccgggaaaccgtgagacgaatcttttgagtctaattaagccgtcattagcacatgtgggttaccgtagcacttatggctaatcacggactaattaggctcaaaagattcgtctccctatttctcccataactgtgcaattagtttttctttttatttatatttaatactccatgcatgtgtgcaaagattcgatgtgatgtttttgggaaaaactttttgagaactaaacgggcccttactctcttactagtggtgctaaattatttgccattagacccacgtatcatagacaatgaataactaataattaattgctacatcttaaaagtggcatggagttaaatgtcccttttttagaggtggactgaattgtaaaattgtattttcatttgaacccagggtgcaatctacaaaaagtttactagggttttctttgcttctctcgcatccccttctgaagtgatcggcggcggcggcggcggagcaggtgagcaaggtcagtcgcttgctgattggtgattccggagcagtagattgattcgtactagctttcttcttcctcgggcagggcagggggaggtctcg

SEQ ID NO: 9247 - DNA, 1501 bp, Oryza sativa
taaaaatgaaataagattttggctcccattcgctgcagggaaaagatagagataagatcactctgcgcacatggtcgcatcgcaccttggaaaatgaattcagggtattctcccccacacaaaaggcttgtgaattttaacgtcaaatgctctgtccgtttcaagaaaaggaagtagtaataaactatttaattcatgctactaaactagtcatatgatttgatttgcagtgaactccacatttcatacccttttgtctcgaaatcgaaattatgccaagaagttaatcaaacaaacgatggagacgaagcatgtagcaaaaacataaaccaaaccgcgaaatcaaagccaaccgaaataagatagacagacagaacagcggtcaagcccatcctgaaatcgagacgcaaccacgacatcaaagaaaccgcaagaaacagggcagaattgcagggcagttgatgaagaagaagaagaagaagaagaagaagaagaagaagaagaacacaatccacaaccaaaaccagcagatgaatcccccttcccttcctccaatccatccatccatccatacaaacagaccactccgaagcactaacctccagtcatatgcctatgcaccgatccatctctccctccctctctccaagcttcttgatcagcagcaacagagagagataaagagaaagagaaagagaaagagaagatgcgagatggagatggagaaaaaggcgaggaggcgagcgagcgagggagagaagggatgagtaaatgcgaggtggaatggaagagcagcaactgcaggagacgtcgcgctttttgttggccgctttggcgtgggcagaaacggaaaccttgcatctgcatgcgctgcgctgcggctgccactgcacttgcatctgcggctcactgccccacatgtactaccacttcctgtatagaccaaccaaacaccaatacagcaaaggtgaaaccaaggtggatggtggtggtgattggtgcagggtgatctgctcctgcttctatggcaatccctatctcccacttaaaaaatatccccaatctctctttctaactgggtatttagagcaaaatattgttattgtgggttatctattattctagttcttattgttgcctgactattagctctctttgagaggtttttttaataagtagctatagcttcttttaagtaaaggctggaatttatattccattattaaacaagctaaataatttttagaaaaaaccttaataaataattaaaaataaatggtctaatcagtaatgcaatagaacaaagttttagcttttattgcagtcaaggcctaattatctattatataaaaaaatactgaaattttggtatggttggttgcttgattttatctctgctgcatccacagttttaattaatctaaccttattttttaaaaaaaacttaatagatttattagtttattaaaacgagtggtctaagtaatacaatagaatacaa

SEQ ID NO: 9248 - DNA, 1501 bp, Oryza sativa
agaagtggctatagtggcttataggattactaagggaaaggggaaactagaaaaatgggttcacctcgtcgaggcaagcacggtggcgcgagggtttggtccgtaatgcaccggtgagggagatcgagtggtggcggcaatggccggacatggccggagagagagagaagagaactcgaggagctctgctatggggaaggaaacggggcctcttcggctatatataggcgaggaaaggcggtggttagaggcggtttcggagaggaggaagagaaggagagcacgacgccggttgggtggagaagaagaactcgacgccggctctaactctgattggtcgatcatgtcggtttggtgcagtggctggcgtcagcgatgtgaggtggcggctgacgtcagcggctgatgcttagcggtgaaggcaagacgacggcggcagcaaagcgctgtgggcggcggcggcggcgcgtacacgcgcgccacacgcggccacggtgctcggtggtggcggcgcccacagggagagacgagttggctcagctaactgggccggcctgggccgagtaagaaagaaggagaattcggcccaaaaacaaaaggaaggaatctaattttcatataggtttgaataatttgattcaaaggaattttggatggctaagttttacaagggatttcaatttggagaatatttgaataggaaggtttgaaaggaaattatatttggatataatttccagaagagatattttctggtttatttgagtgcaacatctttaaaggtgaagtttgagggaatttgaattttggatgaggaaaataaattggaattttctaagcacaagagcaatcattaaaatattgttaatcttgtgctggataggaaatcaagccatagggattaaattggtggctagatcaaaaggaggaacttgaatatttggtaataagaataggtttgaaatcaaaggatgggttgacaattaattccaataagattggaattgcttcgatttaggttcaaaggtagtgttggaggatttcttggaccatatttcacaaaagtaaaaaggattttcaaactaaatttgaattaaggaaattttggtcgaaagaagctttaaaatgcaaaatcaaatcaaagagaatacctcgatctaaaaagatcaattttagaataaaagcacgaaagattttaatactagacatggattttatgcatgttagttttaggaggtccctctaattgtaatttcttaggtttaggaagttattaaaaacataagaatcagcatgatgcatatttagaaaatagcaaattttcagtatgttacagctgcagagcctcggtcagaccggacaccggtcagaccggccactgtacctcggtcagaccggcctcggagaaatttttctgaaaattctcaaattgattttgcacgtggatatatgcctattggatcttctggtcgtgtgtctcagtactggattcctaagtttt

SEQ ID NO: 9249 - DNA, 1347 bp, Oryza sativa
atacattgtactagaatgtgtcccatcccatcctaggttgggttttttttgggacggagggagtatctatctatatctgtaaacgctcaagcgaccagaacactttaatctcttggatgaccgaagggaagttatgccagagccagaagtagccatgtgtggccaatgctttgatgttcttcttcgccaagaagaagtaagtcgagacacttgctcttcaactccgagcagccgcacatcttggcatagcccagtgtcctcgccaccgtctccaccgacaagctctcctcgagttttcgggcgcacatgagcttcagcctgtcgagcttatactcgtgcgccgccgcgagcagccggtggagcgtgtcggtgttggtgtcgctgctgtcaggcgacgacgagtgggctcccgctggcaggaagtcgccggtgtacatgaagtgcagcaaagcttcgaacatcgctggcttgatgtcgttcagggtgatgctgcaggctgctgcctccgccgtggagctaaggagcagagccttgaagaccggcgagcacacggcaagcagggcccggtgcgcatggaacgtctcgccaccgacgaagaagaacacgtcggagccgttcaagtggtccacccggcacatgtgtatcgcggccgctccatcccccaaccctcgcgcgcgccgccggcaccgtgccgacgaggccatccgtactccccaacccccacctcctccgctactcctcttcttcatctccagcgaaatttccccaccccacctctcctccctcgtcttcggcggctcgcacggctgcccccccccccggctcctacgctctccaacgagaagcattcccagcctccgacgctgtcccgtcactatcctcatctcccgatctcccaccccagccttcggcgtccccacccagccatgtgtgatggatctcgtctccaatttcatcgagcacaaggtggaatacctagaaatccagaagctcgctgtcggatagagactgccaaagctaacaatctcagcgggggagcacaatgcatgtcttctgtggtggctgtctccgcgtcaacaagacaatggcgagtacctctctctcgcggtggcgatgctgaatgagaccgacgccaacacccacctcatctttgagatcttcttcatgggcaaggatggtttaccagccgtgcaacattcccagaggagtctgctggtaagcaaggcatcccagggcttccgctttgatgcctggtggcgcttcgtcaagctgagtgaacttgactctcgctatgtggttacattcatatgtggcctcatcattctgcgcaaccacaacgaacctatt

SEQ ID NO: 9250 - DNA, 1501 bp, Oryza sativa
tagaatctcacatcccacattgtagttacataagcagaagtgttgtttcaatggtaccatttcaccatctaacataaagaactagagcatttttatacaagcaggtgttactgacaaatcatacaaaactaggtacgatgcttcctgaaaacactccctaaacaagacaactaaccagagaaagttatctatcaaaaagagctaccatgtgatgtcaaggttgttaaggagcatatttatctccttttaacaccgatggggagtcaatgtaaccctccctccgtggctacaatcttcctacagttgttgtcctccaagaagtattcaaagcatttcttctttaatgcaatgcaattgtacgtatcagcgcaccagagtggctgcaaatgattcatccgtcatcctttcccatagattctgggtgcaaatgagcttcaatatatccagagcaaacctatctgctgctgccaacaaactttcgaagaattcacttgtcgtctctcatagcagcaaggcgtcgatgtatatgaaatgcaatagtgctctgaacgtcgccagctccaggtcatccagcatgacgcacgggatggaactctttgccattccacaaaaaaaaaaaactctgcatggaacatcggggaacgcgcggcgagcacagcccggtgcgcatgaaacatctcgctgccaacagagaaggagatgtccgagccattggcgctgcccaccatgatgccgagttggttccccaggttggaaggtggcactgcaataggttcgttgtggttgcgcagaatgatgaggccacatatgaatgtaaccacatagcgagagtcaagttcactcagcttgacgaagcgccaccaggcatcaaagcggaagccctgggatgccttgcttaccagcagactcctctgggaatgttgcacggctggtaaaccatccttgcccatgaagaagatctcaaagatgaggtgggtgttggcgtcggtctcattcagcatcgccaccgcgagagagaggtactcgccattgtcttgttgacgcggagacagccaccacagaagacatgcattgtgctcccccgctgagattgttagctttggcagtctctatccgacagcgagcttctggatttctaggtattccaccttgtgctcgatgaaattggagacgagatccatcacacatggctgggtggggacgccgaaggctggggtgggagatcgggagatgaggatagtgacgggacagcgtcggaggctgggaatgcttctcgttggagagcgtaggagccgggggggggggcagccgtgcgagccgccgaagacgagggaggagaggtggggtggggaaatttcgctggagatgaagaagaggagtagcggaggaggtgggggttggggagtacggatggcctcgtcggcacggtgccggcggcgcgcgcgagggttgggggatggagcggccgcgatacacatgtgccgggtggaccacttgaacg

SEQ ID NO: 9251 - DNA, 1501 bp, Oryza sativa
tgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtctcacacttaataaatcgacctaatacactgtagtttaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaggccgcggccagccgggcacgggggaggagctcgccgggaggccacggctagtcgcgtgtgttggaggagctcgccgggaggctgcggccggctgggcgcgaaggagaagctcactgggatgagaagggcgccgccgcgcggccgaattggcctccgcgcgtgcggctgcgagaaagagagaggagggaggaagaagataagaaaaaatggggctgacgagtgggccccaccatttgttttattttagcatttgtcacttacacgtgggacccacttctatttttaatccctttgatgacctggctgccacatcagcacatttgaatcaagtcaacctgccacatcagcctaaaccactcaaaaccactcaagaagtcgatttgcaccggttttcgaagatgggggaggtgttatatccggttttgcgtttgagggatgtttttcgaccaagggcaatagatgagggaggaaaaatagacttattcctagttctaatgggcgatcgatcgccctaccgatctggtagcgatcggtagccccccccctcctccccctccctccctccacctggttttcatttttggcaccgcattactttcctattttagtaaatttatacacctcaagtttacacatctaaagtttagagaccaaaaatttataagtcaaaagtttatatatccgattcaaatttgaatttgaattcaaattttttttttatatatagtatttctatacatctaaagtttatacacctaaaatttatagacctaaagtttatatacccgattcaaatttgaagtc

SEQ ID NO: 9252 - DNA, 1501 bp, Oryza sativa
tcctatcacctgcatatagaacttccgagcaggtcatatttttctccaagcggttttcattcccgcggacgggctggcgaactcatcaaactcgttggttccatcctcttctccttcattgtcacgaggccgctgccgttttcccgtggatgggcgggagtgcccgccaccgttgccaagaatgcgaggaggaataggaatacaaaagagaaaggaataaatggggaggaagggataaaatgtgtccacgaggaaatcaatacacagtacatggtttccaactcctgtacgagcgtgcacgtacataattggacacaactcagttacagctgaagattactgttctacttttacaggagcaatgcatgcataaaaagcaagcacgaatccccatactcagaaggtgagaccagatcctttcagcttctccgcaataacggcatcaagcttctgcgccatctcttgagtcaagttgttcttccagtctccaaccttcgccttcctaaaaaacgacgagttctccatcggtcgtccgccgatccgatcaaccaccccggagaagttcaccggcaggcggctcagcttctcgaagctgcacagcctcacaacctccacgacgacgccggtgccgacctcctcgtcagtgaacgggacgcggaggaactcggcgagtttcttgacgtggccggccgggtcggccatcatgtcgtcgtacttgaggaagagcaccgtgtaggcagtgatcccagatcggcccgtagagggaacagccatcgacgaacagctcgaaggcctcgtcgaggtcgaggaagaagccattgcctaccttgttcatgaagtgccatgtggagacgacgacgtccttgggctcccggcagaggtagacgatgcggcagccgagctcggcgacacgcggggggaggagctggtgcggcaggtgggtggagagaagcctcggtgacgggagcgcgtcgagggcagagagagggtggaggtggcggaatggcgtctcgatgaacggcacgaggtcctgcgggtgggtcgtgagcagcgggtggtcgccggcgccggcgacggggtggcgggagcggttggcgatgtcgaaggagagcgccttgagccaggtggtgccgcactttgggtaggtggcgaggagcacgtcgtcggggcgcggcgcgaactgggcgcgcaccagcgacacgctcgtcgcggcctgcggcgtcatccagcagccgtggtagaggacgaacgccgtccaccatccttccctagtcggaagcgacgcgaggacgatgtcggctccctcgtctccggtagcggtaggggcgacgacgacgttgctctcggcgtcgagttgacccaattgagccatggctgcttacacgtacgctttgctcgatcgactgcttacacaactgcacaagcatgggagcatcatgtgtctatataccaatcagagcatgtacaatagcaggctataagccagctataaacatatttt

SEQ ID NO: 9253 - DNA, 1373 bp, Oryza sativa
cgaaagagctggaaaagggggcaatcaaaatggcttagactatgggtacgtactgcatgcagtactgtatacatagctggtcctgcagtatatgagatgccgtcctatgataacaaatactctctctttcccaaaatataaacatttttaaaatagtgacaagttaaaccttttaaattttgactataaatagcaaaagaaatttaaaagattaatcgtataaatttaatgttactatatttatcattaaacaaattatcataatatacaactctttatttaaaatattttactttagtagatattgttggttaaagtagtatttcggagaatatgtcgagacaaaaaaaaatacttatattttgggtagagggagtaagttttttttttagggtatgttgattggttattatgctcttaaaaaacatagcattgaccatcgaatacttacaagtaggtttctgcttctgtaaactttcttttaaaggaataaacattactctgctcctatatgaatcttaaagcacatgtcgggtttaggtagagtaactaacctggattaaactaaaacaatcaaactatcaaaggaagattcccctaatgcagtcttcaatatattcatgtgcaattgttttcttaaaaaccacatcattcttgcataaccgaagtcaaagtggtcagtaaataatagcagctcctaataggacatgcattttgtttatgttcgtatacgtagtaagcctgttccaattattaatagaccactgccctgtttatgctattgtaacaagcaaatggtaagtatccaattggtgaaattttggaaaagatagttttctttagtttctagcttctatgcttattaatttctaaattctacacctactaaatcttaaaatgtggtgcgagaattttttttaaaaaccgaagccagcttaagttggaattatattaaggaggagagaaagtattaaccttaacaatatcaccaagaaatgtgaaagaaatcagaggaggcgaggaaaaaaaacacaaattagaactacacactaaacaaaaacttaagcggatattctcgcgatgtcttttgctctacacatgctacatagcttaatttcgtcttatattttggtaagtagctgcgacatggttttttcttgacttggtgcaagaatttggacgtttcagaagtgttgtatattcttaaatttgttgcggctatttttttaataaaaaacagtagaataggctagctcctaattattgcagctaccaaaagctcttcaaccagattctgtgacggtgcccattaaattaaacttaactaaattaagaagaagcaggcatagacgggatcgaattacagggatgca

SEQ ID NO: 9254 - DNA, 1501 bp, Oryza sativa
tgggcctgtttgaggagctttaaattctgagaagtagttgtttgttagtcagcttctgagaatctggaaaagctcttaaacccagcttctctagcttatggcttcttagtttatttttcaaaatctgtaactatatattctcagaagctgtgaactgtttggggcagcatctagcagaagccgcttttgagaaaagctacagctgagacatgctccctcaaacagggctatatatcgatggaagaaagggtcacgggcacaaaatatagggtgataggcacgcaccaccgaatggatggacggacgcgtgcgtgcgagcgagaggcggtcgcccgtccatcggtttctccgagtttgttaatagcagccgatcgacgagacgacgacgcgccaaaggcccaaaccgcatgtgacccctggggcacacacatgacacaaggacgcgtgcttggtacggtgaattggtgatcatcgcgtcgtctcgtcatcaactaacaaaaaacctggcatcacgtgactgtgcgaagcaactttttgggaggatcacattagttctttttttctttcttgaaagaaaagagggggtcatatgattgaagaactggagcattcgttaatttcgaaagtgtgtagaagaacgcatatacatgaaataatcgatcgtgtacgtggctgcactgaatgtctgcagttaatttgctgagcccacggtcaaattaactcgcgaacacgcatgcgtgcgtgcacaatgtgcagcttatgcgcgcattcatggtgcttgtgcatatttctgggcgagaggaagcaacggtaatcagtgtacgcgtgtggttcatgatgagccatgcacgcacgcacgcattcatagtcacagtcccacgccgtcggccgcgcgcgcgtgccggcggttgtcggtggcgggtggggaagggaagggaaggcaacgtgactgacgaccaaatcaccgaacgatgagtctttttttttcgcgaacgtaaaaggattacatgtcaatatattagcaccgaaaaatgagtcaccaaccaaacaattggggaggatcgtacggtcattgccgttgttgcctcacacatgtggagggaggggaagtcgcagccaccatcacccggaaacactaatgcgcgatcaatcgctaccgcgatggggtaacgatcaccacccctccccccctccctccctccacgttttcttttttggcaccgcattacttttctattttagtaaatttacacacctaaagtttatacgcctaaagtttatatacccaaaatttataaatcaaaagtttatatatccgattcaaatttaaatttgaattcaaatattttttatagtatttctatacatctaaagtttatacacctaaagttgtagacccaaagtttataaatcaaaagtttatatacccgacttcaaatttgaatcgggtatataaactttaggtctataaattttaggtgtataaactttagatgtatag

SEQ ID NO: 9255 - DNA, 1501 bp, Oryza sativa
aaaacgagaaaagaaagagagaagaggaaaatgtgacattgacatgtggggtccatatgctgagtcagccggttggaccgggtcaaagcgccacgtcaacaaaaccgtccttcaaaaccactgagggagtcaaattataatggttttaatagttgagggagtcatcctaccctgttttctaattaaagggtactccctccatttcacaatgtaaatcattctaccatttcccatattcgtattgatgttaataaatctatataaatacacatgtctagattcattaacatcaatataaatgtgggaaatactagaatgacttacattgtgaaacagatgaagtacgaattagattcggcatactttaagggagttaaagtggacttttcctttccgctttctccgatggaggatctatcgcgacgcgaattcttcgcccatctcttcgtgccacacgtcgaaaaattgaaggaccaacgtttgaaccaatcagcaggcgctagaagcccgaattaaatttgaaaatatactttgattcgtttatttctcaaaaatattcggaatgcaaatttattagcagaaatataccgtcgatctcacacaattatttcacgaaagtgacgtgggagtgatgttgtgaacagtctcgcgtgaggagagcgcgagaccgcacggtatcgcatgatcatagcacgagaccgctcggtctcgcacgacgaaatcgaggacgtacacggcggcggcgtcagaccacgcggtctcgcgcggccaaaccgcgagaccgagcagtctcgctcagcgatagcgactgcctctgccgattgaataaggttaattagtgattaattaatcgctaattggaataattaatcactaattattgttaattaatcattaattatggtaattaatgactaattaagcagctccgttggacatgacattcggtctcgctgatttcttatgcgagactgttcggtctcgctgcttcatcacgcgataccgtgcggtctcgtgctcctactgtgtgacactggtatattttcgctaaaaagtatacatcacgaatatttctgcgaaaaaaccaaatcaatagtatatttttaaatttaattcctagaagccccaactttagatttttagatttatgcacacgatgcacgagtgcaattactatattacgttcaatcgagaataagcgaaactgtagcaccagatatgattctgttataccttcatggatagtacgtgcttaggctgaatgcttgtgttgagagctcactactagtttcaaattatctatagtcaatgtaatagccaattcatacgatagttgcttactatactattaatatatggtccacatatcatacacccattgcgtcttggagtccgtgctacagctggctacagatctgtagcccgctacttttctatatcttcttttatctctttaaaatatgtttatagctggcttatagcctgctattgtacatgctct

SEQ ID NO: 9256 - DNA, 1501 bp, Oryza sativa
ttaaccctgtttaaatctgatgaaaatagatattaagtgatgccacacaaacgagaaaaccattagcacagggttagttaagttttattttttttaacttaaaaatatgttcatttgatattttaaagcaatttatatgtagaaagtttttacacggaatacaacgttagcatttcgaaagtcatgctaacgaaaaccaagttaaaatccatatcttaatcaagttagaatatttaaactacatatgcaaagtctgtatcttagtgcatcagcacgtaccaactggactagcctcgcatttataatttttattttttaaaaaatcaacgtactttataatttgtgctatttaatccctgcattttccatacatgaaataccatacaaaaatataattaccgctatctccgactatagtcgtttgagaagggtcctaaccatttgctcccatgtataatttagccgctataacttcatttaacccgctatagttgtttgggaaggtcaactactaaatatcttatctcgttatttaaaacaccgattataagtaggagtgacaatgatacacctagggcctgttcattttgatgctattttaaaccttatcaaattttggtaaagttgccaaaaaagttgctacatttattttgtagctaatttttgacaactatataagaaatcatactaaaattttgacatagtgtagatgtcgggcatgaaagtgaacaggcccctagcgtagatgtcgggtgggatggtttcaggaaaagaaacatgatgagtagagctacgctcatttggcatatgcaaattattctttcgtgccgtccttttacaattttatacgtgtcttattacctgtaaccttttgtcagagaagagaacacgattgtttacagtcacaaatgcattgtgaagcttttgcaagtcttcagaaatttaatttggttgacttacatagttaaataggagtacctaacatggccagcttaattcatctcacaaataattttggctcaaagccttttacgccttcaaactacagaaacgtattttactaacctcatggcacccaactatgggcccacttgtcatagatagaacccatccgaaatttctagaccgcgcgcagacccgccacccaaaaacccggggcccacctgccatccacccaacacgagcccactccccgctcgaattcccgcacccccgccacatcctcacaaaagaaacacacctccccctcaccaccacgccacgtcaccgatccgcgcaacccccaccttcccccactccccgccgtccatctcccatccaacgggcggaaaaccagcagcacgcggatcgtgccccccatcgcttcccctaaacccacgcctctataaagccccgcccccacacgccttctcctccccacctcatcaccaccgccgccaaccactcctcaccaagtcaaagtttcttcctcgcgaccggcggcgagcggcggcggcggcga

SEQ ID NO: 9257 - DNA, 1501 bp, Oryza sativa
atacaaattaaaaaaaatgaaaatcttagagccctaaaaccacacaaatacacaatttttggtagcgcaatcacatatgaaaaaaatgaatgaaattatgtaagaaaaatggcatgataatcttaacagattccccaaatactacccaaatactattttttttcctatgtgatagcgctgccaaaaaaactctgtactaatattacttttattcagtttttttatttctctcaaatcagtccaatggttaaaaatttgtaagatattagtagaagttttctatcaaatgaggagtagacagtcacagtcccaattaattaacgttgcctgcacaaaccaaacacgacatatcacaccgcctcatttttacggcttagtgagggagatgacgattcatcctttgagaacaaaatcactcgtaatcttacatatcatgtaaataatatttttttaacaaataataataaacagtaatataagaaatatcactccacgaatatgcgaggtaaaattctgagttctataagttataacaaaatgaacaaaactaaaccacgggaagttaaattttaagttgcatgctgtggagtgtggagtgccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggatatactttatatttatctaccttatcattttatttccaaacgttttaataaccacttaggtgacataaaaataaaaatgaggggatttcacttttcactcgttgagagcgaagctagccatcggccccaccaaaaaaaaaaatccacaatacgcgcggcggcttctttcctctttcgctccccacacccttcttttgtcgcgctgatccccagacgccggcggctactgcgtttgcgatgcccgccgccgccgccgccgccgcgccgcccaatcccaacgttctgcagctagccccacgcc

SEQ ID NO: 9258 - DNA, 1501 bp, Oryza sativa
gaactccagattttgtacgtcttggcgagatcgaatctcttaagttaaaaaccacgtcccgttttcttgaacgagtgactgacacgtccttgacgtagcaacacctccgtgaagacgtcgttttttatgactctgctttggggtgatgttctaggtccggcgacgatcacacatagcggtggtctgttttagtggcagattattaaaattttgatagtttgggcaaatctatataattcaattatcatttgtgtgagtatttgctttaaaaatttatgtaagtacgtttgctgctgtgttgttgtttcatacgcactattggtggctaagaaaagtactcccttgttcccaaattgatcatcatataaatttatacaccaaaatcaagaataatttaaaccacgtcaatcaaaacaccatgcacacattctaccacaatggatacatcgattaaaacaccatgccaattacaccttagcatgcacacattctcacatgctgcattaattatattctaatgaaatcagtgtccatgcggtcatatcatgatcaatttgagaaattttgggcgtgtttggctgtcgtgtacagcgttgccctgcagcctgcacccagtcctcttgctgcagcaacaagctataacgtggctgtgaaacagcgctgtacaatatagccgaacaggccctttgtattctattatgtgaagatcaatttagaaagtagggagtaattagtaaggtaattaggcattaatttattggtgaatcgttgcatgcgcttggtggagcccagctcattgctagctcatggtagtcgggccttagctttggtgttaggccccgttcttaatgacatgttttatgtgattggtacgtgatttctagatgtgcactgcggtatacaagccaacatccacagtcttctttagatgatgatagtatttcttgtacagtaactttttttctcccactcttaacaatgttttggacgacattttctttggtcatcccaaaaaagcagcgaaaaagacagcaacatctttatgggcttatggcccatcactacggcctggcccagcatagctcacgatggaacgagcggccggcctgggccatctgctgttcatggcccaactagagcccacgaaacgacggcccaagaaaatctcctctccacgaccacgacactgacaggtggaccacgctactagggtttaaggcaagcgctgccgcgttgacaagtcaacgtggccccgagagagagggggaaaggggaaggcccggggcctcgctacgtggtccatttccggtccagtctcccacaacgccggaatcgaaccttcttcttcctcttcttcttcttcttctctcctcggcctcggcgcggttcggcttcgtcgtcttccccttcccctccttcgcgggcggccgatccgtccgtcggaatgccggaaatgggcgcgcgtgggggcgaggcgggggcggcgagggtggccaatggt

SEQ ID NO: 9259 - DNA, 1501 bp, Oryza sativa
agaatatgtataagattatgacttgtgtatcaaggaacggcctatagtccttgtctattaagatctatctattatctatctatctatctattatattattaaaacagctttgaaaagaggcaccatgttcgctgtgggagctagaaattcccacattaatcggagaaaaagaaaaaaaacaaaaggagagtccaagtagaagcacaatttaagaatagcagaaattcggaattaaaaataggcaacattgaaagaagtttccacataagaacccaatacgagatgaatcaaaattcgaaataaaaataaaataaaatctaaaattagaaaaggaaaggagagtccaagtagaaatacaatttaaaaatagctgaaattcggaattaaaaaaagcaatattgaaagaagtttctatataaaaacccaatacgagattaatcaaaattaaaaataaaaataaaataaaatccaaaattgaaaaaagaaaatgagagtccaagtagaaatacaatttaaaaataggtaaaattcggaattaaaaataaggaattttaaaagaagagtccatataagaacccaatacgagattaattaaaattcagaataaaaataaataaatccaaaattagcaaaagaaaataaaagaagagttcaagtaggaatacaatttaaaattacctgaaattcggaattaaaaataagcaatattaaaataagaatccataaaagaaaacaatacgagattaattaaaatttagaataaaaattaaaataatatccaaaattagaaaaattaaaagagagttcaagtaggaatacatttttgaaacaacttaaattgaaaataaaaaataaaaacattaaaagaacacaatacggtattgacttttttaaaaaaaaaattctaaaaatagaagaaagaaaaataagatttcaattaggaatacaatttataaataactaaaatttgtgataaaaataaagattatcgaaagaaaagaccatctaaaacacatgatgagataaattaagaaactggcctataaaggagtagggtggaggcggttgatacgatatataaaaaccgttaatacaccaaacagaatcctaatgacgattaaaaggacggacgtcaggcaggccgtgaagcaaacttgtaaggcggttgccgggacatctagaaagtaaaaaaaaatctccgttgataatcatattcgatttttaaaatctcaacggcaataaaaaggtgaaccagcgggcggggtgtataagagtatagtttcagagccgccgacggttgatgggacttctagaaaataagaaatgaattccaataataagagtaggcgacgaacgggctgtagaggggtatagtggcatcgtttgatgggacttctaaaaattataaaaaatgaaactacaagtctaatttttaaaggttcagaacttctaaaaagtaaaaaaaaaacaatgataatcatgttcgattttaaaatctcaa

SEQ ID NO: 9260 - DNA, 1501 bp, Oryza sativa
tctccgttcttcctcctcgctccatctcctccccctagctttcggtagtagctagagtagcctccccgtagttagccggcgccgccccgaccattgccgtcgctcgccgtgtgttcgccgccgtcgccgctcgagctccgtagcacccgctcgttgctggcctcgctcggcgtagttccgcccaatccgacgctagcgtcgagttcccgaagccgcatagatgctctcaccgccgggaatcgacctctcgtgacctcgtcgccgtttccctcttctcccgccgccggttgccgccgccgcaatccgccgccatcgagcaacctccggcgaatccgagccgttggctcgtctccccttgtcacgtgcaaccgcccggtgtgcacgcttttgcccgtatcgccgtggttcgctccgccgctcgccgccgccgcccgccgtccattcgcggccggatcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccacggaccgcgcgcgtgcaccgcgtcctttccccgcccgcgcgcatgagccacgtactccctccgcacggtgagccgagccgctgacaagcgggtcccacccgggaccgcgcgtggtgagcccggtccaccggactctctctcctccctcccccgcgcgcgcgcttgggccgtcttgggccggccggcccgttaagctcggccgagctgctccatttaccttgggccgcgccctagccgcccgaggaaaagtctgatttccatccctcttttcttttcttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgttccgtttcgcgtgtagttccggagcccgaagacccgcagtgcgaggatttcgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgctataccatgtccccttataaccacccagttgcgcctcgatacttgtgcactctgtgcaagtatcgacggtcgccttcaaacttaaaatctgagtaacaacttgggtaaaactggagttttacaaaagacttggaaaacccgacacctgggtcggtgcttgcgaac

SEQ ID NO: 9261 - DNA, 1501 bp, Oryza sativa
gagctttgttcttggaattatgtgtcaccccaccagcaacttctgcgataattgaaattttgtccatcacactagtgttacggtgaagtttactcctggatagtgttactcttggacttgttagcatcttaaagattacactagggtaaagttttgctccatccttctgtccaggaaaaacacaatgtttaatacaagagagagaaatatgcacaaaatatatgagagagaaatatgcacaaaatatctgcacatgcacttactgagcaatacttgcaagttgtctgaattgttgtcccatcagtcttctttaattaagaaaaaaagaagaatgtgttaaggaaataaatgataaggttttcactaattcatcatcaatatacaaagaaagcaaaaaaaaaaaaggtctactgccttctgcaataaaagcttatgacgatagctaaataaactaggccaataagttaacagtaactctgtgctcacgttaaggcagttgatataatactcaggatttccgtccccattgtataagtcctaaaccccaagttttatatgcaattctcatattactgtagttattaaaccagcccaaacatggaacaattgggccttggtgggggaagggggtgatacagttgaccacaagtaaaaagtaactaaactccttaggtgaaaacttgtaagaagttggacactggcgaaagaaacccataactgggcatcaagtaaattgcttggatgagctcttgagagcctctcattgactgaagatgctttgtcactagagaattaggaatttgatatttataggttttgtgaaaaaaagaataaattgcttgttcaggatgaaactacatcaatctggtgactacaaacctttgtgtccccattttgcttcagagtgagacagcctggacatatctgattcagcaactggacaacttcctcaataaaacatggattatgcacggttgctgccagcttaataacaccgaaatgacctaacaattactcctaccagttagcaaatggagaaaaaagacgtgttatatgatgctgcataattaatatttacttaccatcacagtcacgtacgctttgcgatccacaggttgcacactgtggtgcaccatttggtaatcccaacttggcattagtcacatcacacatttcaataatactcgcactacttaacttttcctgaaataacacaaattcgatggttatttctaatgacagtaagttaaatctacagccagtgtgaaagattaccatgtctgaactggtcatgaggctgaatttgacggccttcagatcagcttcaggcattttcacctcaagacttggctcctccatcctgaacaataaacacgactagaaaacattaacatacatacaagtaccctgttaaagccccacattccacttatctttgcaaaaagtatgcatgcattggaatagcatatatccactacaaaattgcaggtccaatgacagc

SEQ ID NO: 9262 - DNA, 1501 bp, Oryza sativa
ttgaatttcgaccaaatctaccatttaaccttcgaaattccaatcgaaacttaattccgagccgtatcgaaacatcaaaatttcgtgaaatttgactggttttcatcggaattgtgaaccctgccaatgagactgaacccatgagcgactctcacgtctctctttgagaaatttaggattgtgccattctaaaaaaggatttatccaaataccatctctcaaacacgctttaataatatgctaaaacggtgtccgaacagccaaaatgaatattcttatattcctatccaaatatcgcaggttttaattcctcaaatcgaaaaaatagaaatagaatccgtttggtttcccaaaacaccagtgatcatatccagttcgtgactctagctgtgattgtgaaccgtagttacctttttcaccaccgcccaaataggagcatatcacggctcacggcggcatcgacgatcctcagccgtcggatgtgtttcggcttttgcacagatccccatatgccgcgggggccgaaaaaagtgtcgcgatagtcgcgccctccaactccaactccgccgctctctccgcttccgttcccctctcctccttcctccgttcccctcaccggccgggagcgccgccccgcgccgccgcgcctctgatcacgccgccgccgacgccgagaccccctctccgctcggtccacccgtcctcttcgggagggcggcgccgcgaacgaatctccagccccacctccggctccgggcattgttggaaaaacccaggtaaacccctgttcactcgtaagtaacgaagcgtaggcagggagagcaaagcgagcagccatggctggcggcgtccgggaggggagggagattgagatggcgccacgccgggcgacgattttgctggggcggatagggtgatcgtgttcgtaggcggcggcgcggccacgcgcgcgtctaggcggggaggctcggccatgagcggtgagcggccggcaggctgggtgccgggaatcgccgatcgcgggcggcgctgctccatttgctggctaggctgggccggtgggcagttgagagtcattcaatgcccactacttagtactctattttcgtcatgcaatcgccagcgtgctctatttggtttgtgtttgtttgttttaggactcaaatcgagcttgttttccttcccatgcacatgcagggtgaacgcttcgagggctggagcagctgctgttgcgtggcactgattttcgtcatcttgcgttgctgaggccgttttagttgcccaggcttcctaaaattcctgcctcctctgccactggctgaaggttgttagttgttaccaatctttttttatggacagctgtcattggacctgcaattttgtagtggatatatgctattccaatgcatgcatactttttgcaaagataagtggaatgtggggctttaacagggtacttgtatgtatgttaatgttttctagtcgtgtttattgttcagga

SEQ ID NO: 9263 - DNA, 1501 bp, Oryza sativa
acaaaaagataaaacaagcaatttgattaaaatcacatacaaaattttaaaaaaataattaaaactataaaaaatataacaagattccatgtagaaagagaaaattctctatatgccactataaattgcctcagtcccttatatgtcactgaaaattgttgggtcccttatatgtcactgagttcaactttttatccccttcgtgccactacgtgagctagctgttggtttgctgctaattaaggtaataaaagacaatgttgcccttcaaatctctcatgcgttctttcgtttcctctccggttatttctgccttgatgggcatccattttacctttggtttctgtatgattcggcaacaatatgtatgcccgacatggatcctatcaatactttttcatctcaaaattttgagctatcctgtacgagaataaaaaaaaagattagttttcaactacttacattgtagtcaaccgcccagcccatcgttgcttgcttgctgcaattcatttcatggaagcttgctggaaaatgctgaagaagggtagggtgggtacttggataaaaacttgaccagccaatggatgatttctccaacagagctcacggcagtggcccaagagggatggaaaaactttttggatggcatataaggagattgatgttttctattggcatataagaaaccaagcgaattttcagtgccatataggtaattctctcaatataaaataacaagagtccatataaaaccataagttataaatatttgaaatttggaataataaaacaagtattcaaagaagagtccaaatacaacacgatacgagattaggtataatttataattcctaaaaagacaattttgaataaaacaataatttgatttgaatacaaattcgaaataagaatcactcaatcactaaattcaaaatacaataaatattttttaaaagaattttttatctttattgattcaaatgcataatgaattgtatatatatgaagcaattaaagagggggctagcaggataataaaaaaatacatttattaccaagtttgtcgagatttgttcacaagaaagagatataatgaacgctccattaaaaatagaaaaatatcttattttaatttcaatttgtcatggttatggataccacatacctaatagtagttgactaaatctcggcaggacccaccacatactatgtcctatacggaagcaaccttcggatataggaggagttccggataagaaaagacaaccagagttatacatggaaacgacaaggactactcggattgtatccatattggttttcctagttctacttggataaggggacacctatgggtataaatacaagaccccccatacacccaccagaagccacaacatacaagccaacatacgccaagacaagctgccggatatcgacatcagagatacgcctggatcgaccctacccggtaccttcagaggccagccgtagggatcta

SEQ ID NO: 9264 - DNA, 1501 bp, Oryza sativa; identical to SEQ ID NO: 1162

SEQ ID NO: 9265 - DNA, 1501 bp, Oryza sativa
gtaaactgaattagtttgagctccactttgcttgttgccttgatgctgctatatgggtatagctaggtgttgttgctgccgctcaagtggtcttagcaatacattagggatttatggtgtcataataattggctaattgtatttgatttctacttttattatgtgtaagctcaacgcctttctcctactccattttaacacaatttcgcagcagggtcacattaaaatttaaaagtgaccatggataaacaatggtgtcaattagaagtagacgattataacagacataactctaataatatatgatctactaattcaatatatttctaaaattattattcagttatccaccattcgtattgtttgctcaacgtttctaaaaacatattttctaaaaaaactttcctctatgaaccacttgttctaacatttttcttcatgtgaaaacaagatgagagcgcacatccaaaaaaaattatcaagtttttagtttatgcacgacaatatgatgtctatgaagttagagatatttttgggtccgtagaaaatgagctagtttcacttagtctttaagttccgagaaatgacgtgtttggctacaatgctagcatgatcctagcttgacttggcaagactaatcgtttggtatcgccataaaatcctagctcccagaagcgaactagcccaaatgggccagaaaaaggctagctcatcagggagagccaaatctgctcgcttccgacgacaaactaatcgcgcgaaaaattgatgatacacacaaaacgatttctcctaaacctaccaacaatcggcccatatcccatatctcatcgtactcttcctcaattcttgactaaactctcaggttagccaatagtaataaataaaacatgaagttgtttctcgaataatgaactataactcttttttagataattctttttgcacattatctctgttgtttaacgaaaacactcgtatatatagtcttacgttacttgcggaaaaattacaagccactaattttaactaaagagagcaaacgaaccaaatgcagagatacaagtaagcaatgagttgatttgcctttgccgagttaggctagttaggaaaagaaactaaaagtgcaccatagttactgctagagatgctacggcagggacgaaaattcaaaacaaaggcaaaaggcaaaaacagtttaaaactcgaactacggaaatagattccgaatttatccttgttttcctctttgagggaaagagttcattcagtacactgattcactcactcccgagtcccgacctccctcgcacgtgcttccctgcgtcgaccccgtcccgacccgtccccctcactcgccgccgccgccgccgccgccgacgccgacgccgaggacgacgacgacgatgccgcggaaggcctcgtcgacctcaggtacgcacctccaaccctcgccgaactccaattcccctaagcaagcgctaattccccgaaccctaac

SEQ ID NO: 9266 - DNA, 1501 bp, Oryza sativa
cccttgacttaacagaagtacataggacaaaaattaacgataagaagtagtcacaggctgctaagaacaaaagctatagttactggaaattcctaaatatgtaccgtccaaaagcaatgtcatagactactgcaatcttctatgatggtcttcatgtagatcacatggaggagacgaagaacaactagatctaaagcagaggagaaacctggaattgtgaatcttggataccaacattgtttaggacgagagctatcgagctaggtttttgatacgatgagaatacgggatgtggaaggaaatttagaagttgctgggtctgtggaatcataggcatatggtggaaattaaatttggagtgccagtggaatttgggtgggcagattgagagtaagctagcgaaaatttcaagcctccgttaaatagcttaagctcgggttggtagagctcgcaagctttgagataagctcaaacgactcgatttagatctttgactagttgagcctgtgacgagttgagctctagcagcttgtgagtttcacgtttttttttctaacggtcctaacctagaaatgtcatgagtatcatgtcgtcgctaagttttacggaggtactaattacagggtatcataaagtgttgacgcgaaatatcaataataagtatcataaagttttacggtggtactaattggaagtatcatgatggtatatataagtgttgacgcgaaaaatcaacaataagtatcatcaaatattttagcagcaccatcttaaatacaagtaagtctatagtttatgctacgtgtatcaacgatgtttgatcgaggcttaaaatctcatattcttccacatggtatgagtacatgacatgcctgatagatatgcaacatagaattcatacatgttatagataaccgtcacacaatattacccacttagaatacatgagcacaaatatgatcaaaatcgacacacataacaccttatattgacttctcgtgtcttggcacatgtggcatgtgtggtgtgtgagaggctcagaaagagagtgcaacgtgggggagacttgtgtggaagcatgcgacacttgttacaggagttgcatagtatttcctttttaaaaaatattgttcaaaatggagtgtattttgaatattataggacaatgtccaaaacaacacactgacgagtgggccttccgccccataatcccctattttgaaaacgattcaaaaaaacctttagaaaatcatacgcccccatttttaagggaaagtttataacgaatcacccttcttccggaaaagcatctgttggcggtctcttcgcggcggcgctccagttctcccactcctcggaggccgcccaaaatttccgtcccctcgccttctccccccaaattctcgcgctccccgaccaccgcctcctcgcctccgcccttggctccgcctcctccaaaaccctagcccaccagccgccgcagaagcagccgccgccccga

SEQ ID NO: 9267 - DNA, 1501 bp, Oryza sativa
gcagtacagggtacagcaggattagcggtggcacactgcggccagatttgtgatgggaggcagcgcaatgcggcttgcacggtaggcatccccatggattctacaagctcaccctcgtcttgaagggccggaagaatgtgttgttgatcaagtgcccgttgtgtaaggatgtaaggataagtttattttggagtgtggagcaatagcaattgctaatcggaaccgcattttctatacatgcaaggagaagaatgagaggggagaacgatttgatttttttttttttggattttggtgttactatatatagctataagaagatatatgcgatgtgttgtgatgtggaggggactgagagcaaaagtgttgcctacgtggcatgcggtcaaacgcagtcaaaggatgtttggaccggggtggtacattaaaccaagttcatggatctaaacatgcagttttcaagttcacggatctaagtgacaccaccacacaagtttagggaccggccatgtattttacgcaaaaaaagttatttaaagagacgtctttcccaccaaatctcgttttataaatctcttgccggtgaaatatgtgcgttgagtgttccggaccagaacgttgctagagcgacataatttttggccatctcacaccacagtaccaccactactgctggggttaatctctcccctgcaccgttgtggtttgtctgttttctcgtacaagcagtcaagcagatgcaggcagcacgcatgcattggcattggccgccctatacggcagcaccggcggttgggtcagcacactgtagccgggtcaaaacccccagtaagccacgccaccaacgcctgtatccccagctgctgctgctgcgccacatgctctccatgcattgcaaaaccccaaaccccagctgctgctgcaatcctgcaacggcaacttcctctgctcctttctgcagaggagaggagaggagatccatcgcttcatcagcaagtgagcaaatgattatgggtctttgttttgttttcttgccgttgattagtagctgtttaatttagtacttacggggtttggattggagctcaagcagcaagtaccagctcacaggtaggtaggtttgtggtcaccaagccagaacagacagacacttgattactttgagctaacccctccctctccccagccctgttgacaggcaaatgatgtgatgtttttttaaggtaagacaatgatgtgatgttaatcgcggaactgaagcaaccgtaagccacaaccagcggtcccaaattcgctcatggccaagaagggtcagggaccagctgccagtaccatgcagcaatttctaacatctcacacactcattccgaaaggacaaaaattagtgagaaaagatagttacttctacagctctactatcaccaacttctaaacatcagcatggcaaagcaggagtataatagtaataagaggattaggagaatgactaggagaaatttta

SEQ ID NO: 9268 - DNA, 1501 bp, Oryza sativa
cccacttcctccacatcatcccctctctactctttagcctacccttctcctcctcccctcttccctttctccttccccatatgcggtaggtggcacacggctgaggtggtgagcggcggaggagaggccttcggtggacctggggtagcaagcgcactagtcgatggtgaactcgacaacgctatctagggctacgccgccgcggagggaagggagcagcgagagatggccttgagagccatggatccacgtcgggtggacaccccacgccctcgtccatcgtcattgccacggtggccgcgtcggcaggcacgacatggaagacgacgtccctggcaccgcgtcccgccttccacccctgctccatccgagtcatcgctggcatcgtcctccacggcttcggcacccccaactccattgcttctccaccactgcgccgtcctctccggatctcggtcaccgcatctcccgcggtggtgggtcgatgttgctccagggggacccgccaccaccgccgctcaagccaatctgctcatgccggcctcgtccccttcgtcgcgccgcactctgcctgggatgttgggtgccttttcgttgtccctcgtcattgctagacccaaccgccgccaccatcgaccagggggaccacccccaccgcctgactgctccgcccgtggcccacggccgctttgcttcgccacgatacccgcccgcccctctgctccgccccagagctctgccagcgaccgcgtttccggtatcgcgagcttactcctcgtcgtcgacgccgtctcctcgctcgcagcggcgtccacgatgttgtctctacagtgatgacaacgaggaaagggggagagaaaaagaatggagaaaagatgggtggccatgggtcccactgtatttttaactaaacactcgatgacatgtgggtcccaccttttgatttaattttaattttgatattttgctatcaccgtcacataggacgaagaccaagtcaaatcagccacgtagatgccacatcagccgaaaccgccatccgaactggcttaggaccttatttgcactagttttgagttttgatagttgagggactgttgtatccggtattgcagtttaggatgaaaatcagattccatgtcaagctaagggacctaaattgaacttagtcctttgctaaatgaaaaactttgggccaaactaactatagcccactcattgctttagctgaacggaaggcccatgcacaaatattaaagtagatccaatacgctatgagatgcctagcactatgcatgccgatcggacggtgtaaaaaatttgactgaaatcagccacaaattcagtcgatagatttttcgtggacacgtactagtgggcagctagtgtagctagtgggcactgggcagcggccaattacgtttcgttagtcgttaaaacagttaacacctttcaggcttcattcagacttcagctcagtcattcaggcattgagaggcac

SEQ ID NO: 9269 - DNA, 1501 bp, Oryza sativa
ggaatagtagaactcagtggtaccgatgagatcgtagtcgagttgattcgactagatcacccggcgacttggctcctatagtcttcggcttcgtaggttgtggacgttgtgtaggctatgagattcgaccccttaggtccccccggggggtcccttttatatcgcaggtcaggcggtctttaagtaggactcggagacatcggaccctgcacgatatattaacgacccagtcctatacgggtaagaacctttccattggcagacttcgtgatggacttccttagcatattcagagaacgtccgtatatgcaccgatataccgcattgccgtatagcacacatccaagggtagagggtataccttatccgtaaccctgacagtagcccccgacttctacttaaatgaactcatgtaaccaatcgcgacttctgatgtcgaaattgttgtcgttctcaactggtcgatctcggtgtgaggaccgtagagacaaagagtgttcgacaacaccatgcgaagtccaacggttatgagtgaatttaaattgaagtccaataaaccgcctgtaacgccccgcctctcccaggccgggcccgcttacatctggcagctttcataggtcatagactgccctcacagaccaacacaagtcttttctgcacactttgtccccactcgtgcgcactcaggatcccggtcggtcacccatcccaaattgctcacactttgtcctcactcgtgcgcacccaggatcccggtcggtcacccatcccaaattgctccaagccaaacacgcttaatcctggagttctttagagattggcttccggaaaagaagttgcatatgagtattctagtaatcctattaagtcctaggccgggatgttacatcctcacccccttaaaagagatcgacgcccccgtcgatcaactccccaggccaggaacgtcctctctggcaacgtccgtgtgtccagtgacagcgtatatgccatgctgtgtgactactcctggtccacaccagccatgcgcaccatgcctgcgcaactgtgacacatgtgtccgtgaaaccgcaagagtcggctctgataccactttttaacgccccacctctcccaggccgggcccgcttacatctggcagctttcataagtcatagactgccctcacagaccaacacaagtcttttctacacattttgtcctcactcgtgcgcacccaggatcccggtcagtcacccatcccaaattgctccaaaccaagcacgcttaaccctggagttctttagagattggcttccggaaaagaagttgcaacttgttgatatgagtattctagtaatcctattaagccctaggccgggatgtcacaccgcctcgcgcaacggacccagaaatctccggcggccatctctcttctttccttggaattcgcaccatcggtagtgcgcctatttaagggcgttttggaaatacattttggagtccggcggttgtgagaaat

SEQ ID NO: 9270 - DNA, 1501 bp, Oryza sativa
ctcaacactcgaaccgtcgtctgcgccatcgacggcggcggcgccgcgctcaaattcgtcgacatctcctcccgctgctgctgcggcagcctgggcaagcacaccacctgcgaccgttcgagccgcgccttcgtcatcagaacctggacactgaggatcgacggcgacggcgacgacgacatggcgtggaccatggacgccatgatcgacgccgccgagcttggtccctcgacgcctactccgccctcccacggagctttccactacaccccatagtgagcatggatgatccaaatctcgtctgcctcattgtggacgaagaacgcaaacggggtgcacattacgtcgccgaagaggtggtatggaagatcatgatggatacaaggagcaaggcactagtgtcggtttggcgcggcgacggtcggtgccattggcgacagccacatggatacacttgtattcctgtcaaaatccctgactgctttgctacctatgtgagttatagcaaagccacgacaatgttgccagcgatggtcgacaagataccaattgcaacaccaactgcaaccggaactggcactaatttgtcgcaatctttgccatccgagtcatctccccaaagtctgtatgtgttaatggcttctcctggggagatcttggtagcacttgaagagatacctgggttggattgtgatgatttgctaacagcttatagcattctttgtcgtgacaatggccgtctattcaaagcccttatggggctcccaatgagtatgaggaagaaattgttgctgatagaaattaaggcttatctaaactgtcatgtctgctctacatgtacaacatgatcatgatatattggaatgtcttttgtaaattacttttgttggtactaagtatacattgtgtgattaactattggattgtgttgattctggtggattgtttttcttatttttaattcttttacacttggaagaatggtgccaatattatggttcatagcttagatgtccaatattatggttgatagcttgttgacgatccttaaatgttaagtgtgccatccattcctgcagaaaaaaaactaaaatgaaacactgggcatagtggtagagtttattactaactatttccacaggtgttagtgaaatatttgtatgcaggtaattctgtatgaaaactcacctgccatgtgaagaaacattgtatcacaatcacccgctatgcgaagaaacacatatctggccaatcagacgtgaccacacggatttaagggctcataaatcagagtaaaactgatataattaggcttatccaccatgcattgtcataagaacccacatgtcagcctcacagaaaaggtcggtgtcttgaggcggtggaagtggttgggccgaacaaccaacacggccccccgcccccaccttccacatggagagttctcattggctcccaatgatggttatgggtggtaaccgccattcacaaccgtcattaa

SEQ ID NO: 9271 - DNA, 188 bp, Oryza sativa
ccggccggtgtcgtcgtctacctcctgccggcccgcgtggcagccacgtaggcgccacgtcggcgccagctcggccaagaccgggtcgagccgaccccggtcagcccctccccatgcgcgcgttccaccgcgagccgtgaggctgcgcgtgggcccgccgcatccgcgtccaccgcgaaccacgcgca

SEQ ID NO: 9272 - DNA, 1501 bp, Oryza sativa
gttagagataatgacggtagtagttaggattttctttttttcgtgagattttttaactaacaaattgaaaatgaaatttatatctgtagtcaaatttttcaaaattttaaacccaaatttgaaaactttcaactcgaaaattgaattttttaagtcaaaatttgaaaactttcaacttttcatcttaaatttgaaaaactttcaacttagatttaaaaactttcaactcagattttgaaaacttttaacccagatttgaaaaatttcaactcaagattcgaaaactttcaagttcaaatttgaaaacttttaacttgagatttaaaaatttttaactcgacattaaaaactttcaactcgagatttgaaaactttcaagtccaaatttaacaatttttaagttcaaattaaaaaattactagtaaactaatcactagtaaaaataggaaactaatcactactaaaactaattacaattttttctcctacccatacggcatcaaactgcgagaaaaaaaaaaagaaaacgacgataggttagcgaaaaaaattgcgcgcgcgccctacgtgggccatgtggaccgggagtgcgcgctgccggcgcgcgaacaaattaggattctggcggaggaggcggagccgggcgccgcggtaatggacgcgaaggtggaggcaagcgctgtggcaaccgtcaacgagcttcttggcggtgacagataggctaataggcatcggaggagcgggaggacctctggatcgaagccgaagccatggaaggccgcaccgagaacgactccgccacctacgccgactctggcaagtggcaaactggcaacccctgcctcgacttcttcttccatgtcgcagtcatccatggagctcgcggtcagagcagccgccgcggcctcctgctcctccggcaccgcacctcgctccatcttccacgagcccgcgcctcgctccgcctccacctccgcggtctccgcttccctactcgccgggtggctgccgcggccgcggcaatcgccgtcgagccgatgagttttatgctctagcagtagtgttggcccctttgcctgacaagtgttctgcgttatgcggatctggcaaatttggcaaccattttttcttgcatgctgaggcgctttcttgcctatgcttaaaaaatactttgcatgtgtaaatggttagctgcttatttattagaaagcgcttagagaaatcactccctctctttcactcacagttttagtggctaatatgaagaactctgaatatttcggatgataaacagttaactgaatgcagaatgcagagcaacaaacagagtgccaaaaacagagtttttttttggctgcgaactaattgcagcattttctgtgttcttcttctttttatttctctccatctaggttctaggaggttgttacatgcacaattttattggatcaaactactgaccgcaccatcccacgttccgattctggctccatctctctac

SEQ ID NO: 9273 - DNA, 1228 bp, Oryza sativa
aggcgcagagcatgaggaacccgttccggcgcgcggacgcgtcctgctccccggtgagcgcgcgctcgacgacctcgggcgcgtcggggaggagctggtcgccgtgcgggaggcggtagatggcggagatcgcggagagcgcgtgcctgcggatgaagtggtggcggtggtcgaggttggcgaggatggacgggatgagcggctcgagcagctcgggctcgttgaggcggcagaggaagcgcagcgtgaccccgcggatgtactcgttggggtgctggaggttgttgcggaggttctggcagatgaggatcatctccgggagtaccttgccggaggcgacgtcgcgcttgtcgacgatctcgaggtagaggaggaggagcttctggatggtgtggtcctcggaggggaggacgtagcggacgacggtgatgaagaggtgggggagggtctcgccgttgaggagcagcatgatggcgcgcttcatggcgtcgaccttggcggcgacgtcgctgccctcgaggtcggccttgatctcgttggccatggagggggagcccttgtcgaagtggaccaggagggtgcatggcttctccatggccgccgacgccgccgctgcacggccgccggtggggggtggatctgggggagtggtcggtggatctgggctctgtgcggggatcggatctgggggggagaagcctctctatgcctatgcggcacggggaagacgaagacgaagaagagaaaaaaagagtgggctgttcggtgcggtgcgggggggcacccaccggtagacgcgctctctctcttcttgggccgaatgaaaaaggccgatatattttggcccattaaaacaaacggccttctgcagcctggtctttcggactattacgccatacgaacaacgggccggatgcaatcgggtaagggtaaggttgtcattatccagaggaataagttcatctaaggtcccttaacttgttaacgaatccaattttcatccttcaaagaatccaattttcgtccttcaaaaccagatacaacgggtccctcaactgtcaaaaccagtgcagatgagatcactcggtggtttggacagcggttttggctgacgtggctaatttgactttggtcttcatctaatgtggcattgacatgtcgattacgtggtaatttgattcgaaaaaataataaacctcatgggacccacatattagcttcaaaaaaa

SEQ ID NO: 9274 - DNA, 429 bp, Oryza sativa
tcaggttcaagccacccttgcccgccagcaggaacttgcgccccaccgatgccttgccgtcaaacacatgcaccttgaccccttgggccgacaacagctgcgccgccatcagccctgcagggcccgcccccacaatcgcgacatcgcagttcaaaaccggcagcacggcggcagctgacataggcatccttctttcttctcatcaccggcgcgcagcgccaaagggcaggcagcataacgccacgaggaagacctggggccgccccagccatccgcagattgcctgccgctatggctttcataggcgtttttagccagccatgctgcacgtccggacattcgtttctgtcacaattatcgacagcatttttctctgcgtacgcccgtgcgcaactgccccaacactcacaacaaggaacaactccatgg

SEQ ID NO: 9275 - DNA, 1501 bp, Oryza sativa
gattcgtgaacggcacaattctcaccacgtaattgatcagcttttttttttttgtgtgtgtgtgtgtcccaaatccatctcgcattttgctattcagaaaccgttgtctcaccgtagcgatacattttgtgcatctttcaggttaaccacagcactcaagcctcaatgcccaggtataaaattcgtgctcaattatgtctcagttcaccatttctgccttgaaaaaccgagactttatgcagctcttgcttttcgtgcaggtccgcatcagtatcctccgctgattccgccgccgacgtcgtccttcttcgagacgtacctcggcccttcgccgacgccgatggcatccgaaggaggcgtcatggccggcatggcgccgacgagcaccccggcggcgagctccggccctcctccggccggccggcacgtcgtcggcgacgttcttggggcgttcgctctctgcctcgtcggcaacctgctgtggtaacagagcggctctcgccgttgatgctacataattttgtacagaagctgtggccggctgtgtttttgtcgggcagcgtcgggttgtgcccaatttttgttgcgttcattcgatttgtctgccactcactcctgtggaatggcaaacacaattacagaagcgcagatctctccagcgcggctgtaatggtcctgaattcctgatgctattgagaatgtgagtaccgagtagtgtgctttttatcgacgctttttactgtaccttctactactgatatgctttttagggcacccacaatggttatttataaactctctacaggagattcatatcagcatatttttctacttggaagatattaaataaagagagagagcaaaactgtttactaacttagagatagtctatagagaaaaacgaggcaatacatgagagagctatagatacccatgtagacatactattgaggtgatttactattaatctagtctattgctgagatgtacatgttttatagagagcaccttactttactattacgggtgctcttatatgcgtttccccaacgctaatcatcaatcaataactctcctaaccccactgtttttctcatttttttaaattctttttaggctatcttatattgttttacacgtcgctgctaatccctcttgctccttgcgcgtaagggggcaaccgcccataagcggtgcgctggttgatcaaaatttggggaaatttttttaaaagtaatatgattttaatggaaaatcgcaaaactataggtcagttagtcgaaatcgcaagtttagcactctatcgaacaaccgtggttcgacaaggtacctatcgaacaaccacagttcgatagggtacctgtcgaactgcggtagttcaacaggtgattaaaaaaattaaaaaaagagaaaaaaccgtggttcgacaaggtacctatcgaacaaccacagttcgatagggtacctgtcgaactgcggtagttcaacaggtgattaaaaa

SEQ ID NO: 9276 - DNA, 1501 bp, Oryza sativa
ttaagtgtgaacaaatttataaaaaacttagcaatatctaaaacaccatattagtttcattaatttagtattgaatatattacgctaatatgtttgttttgtgttgataatgttactatcttttgctataaatttaattaaacttaaaatattttaactagaaaaatatttaaacgatttattatataaggggcgtttaactttttgccacttttaagtctataatatgtgaatccttatatatgtatgacatatggtccagtaatcttttaagagttataaatagttaaatatctcgttatatggatggaagaagcactgatactactcctatttggtgtgtaaaaccgacatttgttcgtgcgttcatttaacagccgtactacactaccagtacgacggtactacatgtcactacagaaaagtaagcggaatgttcttcctcttatctctcgctcgccagatctgcaccgcgcggcgcgcggcgcgtgacggatcatcgaagctgatgacgagtcaaaaaagctgtactcctacccccttgggcctcaaatcatcgagacgcgggaccatgcgatccgtcgaatcgaacgggagcaggcaatccgcccccccgagattggttgggtggttcgccgctcgcgcgcgcgcgctgggctgcgtccgctagttcctcctccattcctttgccatagaattctccgcgtcgagggggccggagacgtacggcgccccgcgcgcacgtggtgggacggcgacactgatctgagccgccgctgcgtggcgtacgtcggcattgcaacgtgtggcgccagtggcgatctcacgggcgcgcgcgggaggctattcaccgggcggcgcgcgtacgtagcccccacgtagtttttgccggtgcgggcaacgccgaatcgcccgatcgagcggtgaacaggtgttagagtgggacggcggcgcggtggattcgccgttttcgcgcgcgcaacacctgatgaacgcggcggaatagttaatctacgggacgtgactggctgctgcctggcagaatgggatgtctgttcggtcgggactcatcagtcgggacgggaccaacggtgattattaacatgatctatatctatctatctctcccaaatgattacgggaaacatgtgggagattattattggtgggggccaaataattccatgctgggccgatccacgagccaacacgcgtatcccacatgggctggtctccgtccggtcaatgcaacagccagcgagcactaatccctgacttcgattcgatcgttctgagatacagatcagcctagtggagcagagtggaacagagcagctagcttgccatgcgagtctataaattgcacctgcccggggtgttcggcatatcacacttgcactgagcactggacgcgtcacattcacaacagcatactatagtcagatatagttgtgattaattagtgagtagagtgtgatacctggactttgagagctagaaa

SEQ ID NO: 9277 - DNA, 1501 bp, Oryza sativa
  unsure (1)..(1501): unsure at all n locations
aactttgggtctataaactttaggtgtataaactttagatgtatagaaatactatatataaaaaatatttgaattccaattcaaatttgaatcggatatataaacttttgacttataaactttgggtctctaaactttagatgtgtaaacttgatgtgtacaaactttaggtgcataaatttactaaaatagaaaagtaatacggtgtcaaaaaagaaaaccaggtggagggaggggaggggggacgggctgatcgctaggggcgaccgatcgccccttagcaatctcagattgattctcagtatttaatgtttttcatgaaatcatctgtgtagtttcaaatggacttatatagagaaatcaggaatctcaaggataactatccgcgatataggaacaaggattccccaccgtggaaatggggcagcttggtgccgtcatccattcttgagctcctgaggatgtcaccaggtttcttatacaaattatattgtcagcggctcttaattatcaagtaattacaactaacagtataagctaaaacctaaatataaaaatttcaccgaacatcctttgcgtcggggagagactaccttaaatatccgcccctggtaactccatggtccttagcctagctcattggttgatcctccaataccgatatagacatantnnncanatntngaggaaaaagcagttacacaataattactactccctccgtcccagaataactaatctaaaaccggattggacatatttctctgtccagattcgtagtactaggatatgtcccatccagttataggttgctatattctgggatggagcgaagtatactatagctacactagtaacatttaatacaaaaatatttcaaatgttattaagcttattagtcaatatgatttttttttcgtcacgcaaaaggcttgcacaacaataaattataaagagcgaaaacttgttttacacaacgtgcatgagccacaacggttgtcgtgagagatggggaggagaaaaaaatataagaggaaaattagttagtaggatagtaatatactccagttgtgatctaaccctttcagtttctattgaaatagtgctgggtaacggatactccctccttccaaaactaagtgcatttagcagaggatgtaatatattctgcgactatgaatttgataagcactttgtccagattcgtagcattagaatatgtcaaaactaatttcgttttaaaaacataatatgcgataatatcatgctaatatcaagaattaatatctttttaaatgctacatatctgtattgataacgatactgatttgccaatttttggaagtgactgcatttcaaagactgaccaaatgcctacaaatagcaccagaggcttggctcacctactcacttcctcactagattcttaatacacaacccagctggtgaaagagaggaacttgagagttagctagcatggcggcagcattgtcgttcccga

SEQ ID NO: 9278 - DNA, 1501 bp, Oryza sativa
cgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatgcaccgggtggtggcgcagatcgacggcaacaggatgtccatcgcgtccttctacaaccctggcagcgacgccgtcatctccccggcgccggcgctggtgaaggaggaggaggccggcgagacgtatcccaagttcgtgttcgaggactacatgaagctgtacgtgcgccacaagttcgaggccaaggagccccggttcgaggcgttcaaggccatggagaacgagacccccaaccgcattgccatcgcttgatagcgtgtgtaccacagcgacccctaccgggtcggtgtcagtaaggtttagtcgtgttcgtagtgatcagtgcgtgcatggtcagctactcagctcgcgttttctacctgaataaattaagctccgtcgtcgtcgtctcgtcaccttggataattgtcagttggtgtggcgtgctgttgcacgtacggccatgtatctttgtcggctgtcctcgtgtggtacttgatagcttgtgcggcgtgctgtaccgtgtacggtttattatctactccagttctatatcgtggtgatttctgataattttcgtttttgtgttacatagcaaaagtgcccgtgcgttgcaacgggaagtgtatagaccagaaaatatgcaattatttaaaatataaatttgctgaaatatttggtatttttaagtaggtatatatataattaaatcaatttacaagtaaaacaagtgtgagaaataaaatgacatgattaaatttaattttattaaatactccatgattagttacgctctttagaattttattggaattttcagagcttaaattgctaattttaataatacaaacatcatttaacaattatttaattggaaaaagaatcaaaatccttccttttaggtttgggccgaatatggaaaagttcatctcgttccctcttgtctattctatgtggctggcctgtttccttcagcgttcaagtccattttgcatcctctgctacgcgcggtccatccggctacccaacaggccaacggtccaacgcgggagaagttggagccatccgatcgaatggacggtccagattaatcctaacctaaataaatagtgggcacccaaaattaatcaaaacactaaccctagattcattc

SEQ ID NO: 9279 - DNA, 1501 bp, Oryza sativa
ctagaacaagagcatcatagccgcgccgtccaagtgtaaagcacttcctatcccaaatacgacccacttcactgtaaccttcaacgagtaatctgacatattcaccatcgatgtcctctacattcacttctgctttgctttataacctcttaggctgcggccttattcggcatcgggggaaaaactctctcgttctccgcgcgcactcttctcaaactactaaacgatgtgtttttcgcaaaaaaaaataataaaagttgctttaaaatttttttattaatcctttttaaagtttaaaataattaacactcaaccaatcatacgctaatgacccaccttttttacgtattttctctttcccctcctcacaaacacaccctaagtaacattaatgaagtttgatgccgttgacggtcgttatcgatcagtctcgaccgtcgatactaccaaaataaaggagaactagtgatgcttgcaatgcataaatctgttagaataataatattccactagtattaggtttactaaccttttgcagagaatgatcataaagtagaggagaatcgacatcaactcagacgataaatcaatcggacaatgtcgagtaccagacttatgaatagatggaccaagaactcagaactgacacgatgaattgggccaaaattcacaagtctgcggagtggagcaatagaggaggtcaccagccgaaattgggctggattgggcttggtggttcggccgaaccaatcctggcgccgttggattcaagttttggcgtggacgtccaggattgcatcccaatgacggttggagggcacttcggacaatttctcttccacaaccgtcataactagctctatataaggagctcactctcttcacttcacacacacctcaagcaatagctctctcatttctctcaagtttagggtgtgtttggttgggcttttcaacctgcttttgcttttacaaaagctaaaagccaaccaaagggcccaaaagccacaagtgcttttgctccaaagctgcttttagtgtagtacaaatccaaaagcagtccctacccctgctttcactggcttttgaggggtaaaattacccacctataccattatggaaaaaaacgattcgcactttctttctttcccgttcccctttcgcgagaccgagcgcccggccatcggttcgacgcggcgctagggtttgccgccaccagcgcgcgccgcccgtgctcccgccgtcgcgcgccacatctcccggcaccggcctgctccggtccccgtctccctgtcgcccgcccccacgccacccgacgccgtcccaggccgcccgacggctgtctccccgtcgcctgcccgacgccaccccacgccggctgacaacggttaagacgtgggagagcatgcactacggaccgaatacttggcacatatgcatgcaaccaaccaattttggaccgtaaagccctcttggccttaggttataatggtacatgttt

SEQ ID NO: 9280 - DNA, 1501 bp, Oryza sativa
ttaaggtctctagtcgtggctgttctgcacgggctggatgatccgggttagtaatgtcgtgtgggtaaagtgtaccctctctgcagaggttattaaactgttcgaacagccgtgcccacggtcatgggcggatgtgaggtgattcctagcgtagttttgtttgactactgcttgtgaaatttgctgatgtggtttgggttcgatgtttggaaaacctgcggctgatgggatcagccaggcccgggtggccgtttaaaagccgttggccgggtgccaaccttgatcaattcaaaagactgataccttgcacatactccgaccggacaagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtgctcacccttgctctatataaataatcccccccagttgctgaagaagatgaagcggatcccgctgacgaggagttcttccaggagtaagccggctacgatgagttttagggtttcggcctagttcccaagtcgcgcctgtgatgtctggcccaagtcttggcttccgctttccttttgtaatgcagttgtgagctcgggatctgtccgcagcccaacatgactgtaatcctactctataataaagagacctctattgctgtgatattctgtcttcctgtgataccagcactgttacctgggactggtatcgattaacaggttaatttggagcgtcatgggctagttccgctcgggactagttcggaacgtgacagttttgcaatcctctgttttacacttacatttctatcagaatcctatgttttttctattcctctgtttttttattcctataattcaaagagacccttagtgcctgtttgtttcctcttcgcctttgcatggaggaatacttttaccacccttgcagacaacgtaccacagattccacacaatattgatcatctctctctctctctctctctctctctctctctctctctttctctttagttaattatattaggacctacctggattaattagtttgataaagtcgtaattgtaatacagcatgcatgcagctgctggtatatatatatcgcccccatagatcatattgataacgcacaacaaaacaaagatagaaacaaagtgctgttgaattaattgataaaagagtactagcacgcagtaacaatataacgacgtggaatagctcctgttctacgaagaccacactaacttgctctgaccatgactgccgtgtcctacacattaatccaagctataattacttgattcttaatttgcttacaattccttcaactactaattaagtatatcaatatattgccggcacaattcgcacatatactatatatctagtctaatggaattagtggagtatagaaatgcttgggaact

SEQ ID NO: 9281 - DNA, 1501 bp, Oryza sativa
ttcagccatctccatcttatcttcttctctcctctcctcccatccttctcttccttcttctctcaccctatctcctcctcccctctctcctccccctcctcccctcccttcccctccggcggggcggcgggatggaggccggccgcggcggccccgggcggggcgacgggatggaggccgccgccggcgacccgacgcggggcggcgagatggaggcggcggcgggctgcgtcgggggcggcggcggccggctgtgttgggcgcggggcgacaagatggggcggctggcgccggtcgagagggcagcggccggcgccgggcgggaggcggcggccggcgccggtcgggatggcggcggccggcgccggtcgggatggcggcagccgacgccgatcggaaggcggcgacaggagaattttttttttctcttctttgtgctatctgatgaatgctgaagatgttgtagatgcgaactttctttttcctttctttgttctctgtgatgaatgctctctgtgatgagatgttgtagatctgaacaagtgtaaacaatatggatgctttgttgtttgattttattcattcgatctatgattgatttaggctttgttgttgattttattcattcgatccacgagcgaaagctaaaaaacaataaaaaagggaaaagaccaacgggatgaaaggaaaagaaaaaaaaaccaaaactttttagtcccggttggtaacaacaaccgggaccatatttttagtcaccaaccgggactaaaaatcgattttagtcccggttatttgaaccgggactataaagggttaccaactgggacaacaaagtgtttctccaccagtgatcgttgagatcgaagtcgaccaaaaatcaacttttctataatattatagagtatagtgacatctagcttagcactctatcaaaaatcaacttaaaaaaggcgaatattagaaaggacctaatatcaaataattagaaggggtgatgctttaaacccaggtcgtctagcccaccaccttatggagctagtcgaaagaccccaggacgttttcgttaagcaccataaatatgaacgttgcaactccctgagaggacggttatccatatatttccatcaaactacacttttgttcatgcggcattaatataaaataaagtagaataaggctttaatcgaaagaaaatacgatgtacatacaatgcctacggcacatgaataaaagaaacattaaattatatgtccaatattttagattaatctatgaaaaattttacgttgtgtgcctaacatttttagtgtgaaagaggacacacgcggtgctgtgtggcgtccgtgcacacgcgtacatgtgtgtggggcttggggggtgcgggagatacgtgtgtgggaggggagggggggtatgtatagaaaattaataaggcgaatactttgacggttccatagaagtttattggttcaaaatttgattgtttttataagaaaaaggt

SEQ ID NO: 9282 - DNA, 1501 bp, Oryza sativa
ttttactgggacaccagaacaacatttttgcctgcaatcgttagtgtgtcagtagtatcgtgctgtaccaaaaagagagatatgtatacaagtacaactatatctgtatacctaattaaaacataagtaaggctttcgattttgtttgtgtctatctggtttttcgcctttgttttctaggccgaacaattttttcgccttttttttctaggccgattgatttttttttctgcgtgcacgcgataagtctatatctaattaaaaaataagtaaggccagattccattttgattttggtccatatgattttttgcctttttttcaggctgaacggttttttcctgcgcgcactaggtaagtctatacctaataattaaaaaaaaaagtaaggcttctgattttgtttttagtccatctgttttttttgccattttttttagaccgaacggttttttcctaccctcatgcattaagtccatatttttcaatctcctctagtccaattcgtacacctcagccgccatcggaccaaagtccgtctggtccattccgtttttttcgccgttttctttttttggtagaacggttttttatgcgcgcatgtggtaagtctggtttttttcaatttcctccggtatgatccgcacgccgcagccgctatcgggccaaatcctagcatcgttgccactacaatctacctccccgtacatttcctcctccaattgattgtaaaaatctattccccactcctccatcattattttacccatgatgtattatttcaattcgcccgtacatttcctcctccaattgattgcataaatatctattccccactcctccatcatcattttatccatgatttattatttcaattcggctttaattcgctgaatttaatctctatttaacagccgccgatgatgcccaatcggtgagcttgattcgctccgattttgggaaaatggaaagagtagattagtgatcaaaagtcctttatcaattttggaagatcgagaaaaattcagccggatttgggaggatcaactccggcatctcatgggcacaaaactaccaacaaaggttgaagacggtagtaggatgtgccaactggacctacagcttcacttgtgggttgggttgaaaagaggtagcatattgggctagtgctgaaaaggacgaaaataaaattttttttagtaaaagaaaaaaaattgagatcaccacaaaggcacaaactcaaagaataccaacatgtagtatgaggttgaagtgcatatgcatgtagtgaaatgctaaatagaggtagatgatcctggaattgaggtgaagccggcaattaagttagtttgttgcatgcagaagtattgcatggtggcagggacaatgaaatgaatctcatctccaacgacgatccatcaagcacgtacaggcaagggtcgaagatcgaaggatatgctgcggatgggcgcggcggtggcggaggcggagccgtcggggc

SEQ ID NO: 9283 - DNA, 1477 bp, Oryza sativa
tccattatattccccatatttgaatatacctttatgtataatactatatatgcggtattcctggtggctacaaattaaaacataggaggtataactaatccgtaacactgacattttgtgggtaggttgtaacactgacactttgtgggtaggttaggtaagtacgttttcttgatattaggagggagggattatttttttcaatagatataagctaatgttataaaacaatgtgttgactaatttaagtgaaaattaagggctattgcttttttatagaatttttagaatttttttattttattaaagcaccatgtgataatttaaaagcattttgggagcactacgtagcagcttgagagcgtttgaaagattgaacttttattatataatagatattttcctaaattacgtctctctctgcgcttcaaattaatttcttatcgttctatatctttaagttaacatttgtatctctggccattaatttttaaatattcatataagtataacatcataattttggattcactataagaataactttcataacatatatttctatgatcaagtagaactatatatcatcggtaatgtgtaggttgtccctatctgcatggctgcatcgatcactctcttcaccttacctccacctccatccacatcaccctctaacttttacgccagatttaagaaatggaatggatcattgcgtatatcacctgaagtagctcttactaggggcactggcctctatctatctgtcctaacgtagtacgatttaattttaaactactagtatatggcaaatgaagatatgatcaaatgcatgcagcttgttggcctactgcacatgctcgtacgcatgttgcatatattatgcagtttaattaattagaagaaagttgcagagattgatcattatatatgtgtgtgtatactactctataaattaatatatgcgcgcgggtgtgtgtgtgttttgattaataggctaattaatacgatcgatcgataatggaataatgagattcaccagcaaagtcaacaatgaaccggatggatgcatggcctttatgactaactaggaagaaagcacccgcagatacgtatacagggtttaggcctttataccctttatggctaacaatgaaccctaaaccctttattaactatttgtaaaaggaatactaaaataagttctatctcaccatatatataccaaagattactttatgaacaaagcaatctttatatttttctctcatatgggtagagttagagtatatgtgtgtatattcatatagtgagtgtgcgtatgtttatatgagtgcctacaattgccttttacattgttagtaaaagagatactttcaagacaattgacagattaggtggtggagcaatgtatgacatgaggtggcactacggcatggcctctgcaacagtcttgcaaggagtgcccatgacatgatca

SEQ ID NO: 9284 - DNA, 1501 bp, Oryza sativa
cttacatgattatattatgatgaaaaaatatttatgtttgtaaaataattttattacatatgcaacttacttttattatatatgtaagttacttttatcatatatataaattaattttagattttattaaattactagctatacattcataatgctctgagttgatacttttattattgcttttagtcaatttcataatttgtgttgattaaatttaatttccaaataaactcatgtttttatccctacaacagatttacttctaatgttgtaacaacttacttccttttttactaagttacttttatgatttataaaaattactttcaaactttatttaattaactttcataaatgtatttacttaaaaatcttctctacacttgtgaatttactccacatagtttcttacttgaactcagtcataatgtaattatttctaatgctatagagagttacttttgttgaatatctaagttacttctacaatttacataaattatttaaaattgataaaatgtttgaatgtattcaatatggatatcgttttgtcacatattttgagtagagtacagtgatgcaaatagatcttaaaaataatatgtgatttaaaagatataggtcattaaaaaggttaaaaaaagacatgcaccattgtaatttttttagctaaagggggattcatatatgcgatggagtggtcgctggttaggattatgttgacggtaaaatttggcatattccgttaaaagaaggaataagatatgagcgggatcaacgacatgatttcggttggacaaatagaaaatgaatcagctggtaggcatcggcggtgccatgttgactaagtgttgccgatagaagcaagtcgtgtttttgtcggactcagagaagagattgtagatatttctaaacaagaaatcgagtctaatatggataattgtatctgttaattaggataagagccaggttaagtttgagtcgtgtctgatatggatgagttttgtattatgggtataaatatatgcctagggtcttgtaaggaggataacaatagttcaatatactctcgacgcatcgccacccttttcatttttggttgtctcgatgagttcttgtttcgagtcgagctgcattggcttcgatctttggcaagatataagacttgtctattatcatatatcttagctaatctaagtggatgactctatttacctatatcggtgttgacgaaaaatacgcactcggctgatggtgccagatctgtgttggcgcgaactaagtcgacgaacacaacggcctaggagatctgcttaattagctctagtgcaggtctaaaatactgataagatgcgggtgtgctagtcagtttgatcctacaactgacaagatttataaagtgaaaatcaaagtgttgatcggccaataagtcgatactagccgatgtcgatagggttttcaacaatcgactgtatgtccagtgtagattctgacacttgag

SEQ ID NO: 9285 - DNA, 1501 bp, Oryza sativa
aagtttgattagtgtctgattaagacttgtgtattatctttaggaattgtgagtcatgtccgattgggactcatatcagcccgagattataaatatgtacacccagggtcttcgtaatctatctccatagaccgatgcaattactttcgacgcatcgccacccttttatcccagcgagttattagtttcgagcatggctgcattggttaagttcgatctccggcaaggaagttccatcaactttgcttgtatcagcctggcgagaactttctcgattaagtctaatattctatctaggttgatgcaagcattgcctatttgatatattgattctatcttcaattgcattactgtttagagttgtataatcttagttaggactttcttagttgggtctgatattctagctaagttggtagttctctaattgtactattattttagatagatttattatatccatcacgtttgtatagatctatcggctaagtaggtttttcttattatctttagtcttatactgtctcggtcaggcccaatctattagatttttgctaataagtttaattcttgtaagccggtaaggtttttatgcagcgttcattggagcgctacccgatgttatcattattttgggcttcaactatcagatgtatcagttagttagccgatatacactttaatttacttacattagatctccagccaatgtatgttttaaccatcagatgtacatctaccacattatattagttttagacgatttgttcacattatattatctcattgcatcttctgagttacatcggcttacactcaaacttgtataatctttagttaaatctatatttatcaacttctatcttatattgtctcagtttggtctgatctatcaagattgcttttgataaagaacggttgtttagttccagccgatgataacatagtttagttccagctggtgataacacaaatctcattgcttatctgattatctgaatttacattagacctatagccgattattcaaaaccctattgacattggttggcctcgcaacatcatatcagtttattggtcgattgactccttgatcttatacgatctatctatctatctatctatctatcttgctagttgcaggatcaaattaattgttatgccctacactggagataagcatatttccaaggccttcgtgtgtcacgaagaatttcacatcagcagggtgcaacccccaagggctatgctcagggcacatttgtcacctaccctccgagagtggccccctatgggttgttgttggtatttattctgaccacataatagtctgcaaacgcacagataccgttgtaaccttcacccaagggtattccaaggtatcgtattcacatggaacgtgtgtgtataatctaagaacaagattcttccaaggaaaacaactaaatggtaggtataggatagagaggactcccatgggttagttatcttaatgaagtta

SEQ ID NO: 9286 - DNA, 1501 bp, Oryza sativa
gggagctcaagagatggagaaacgcgataagaaggggagggggatttacccgctcgctaatgactagtaggaccgcatatgagaatatggttatatttttcaagtgtggttttcttgagtgaccgtattttcagaggtaggtttagactatatgaccttcttatcattactggacttttaatgggtcgtctataaatataaaactttgtacatgtaaaaagctgtggtgcggtcattgctcaaccgatcgaatttggtgcggtcattgctcaaccggtcaaaactacattagcgaaaagaggatcccaagatcccaccaggataagccatgtcatcatataaatataaataagaaccgttggatgcacgatttgaatgaagagaacagttggatcataagagagaaaaataagtaaaaaaaagtgtcagggttatggataccatatacctaatagtagttgactaaatctcggcaagacctaccacataccatgtcttaaacggaaactgacctcggatatggagggagttctggataaggaaagacaaccagagttctacatggaaacgacaaggactactcggattgtatccatattggtttccctagttctacttggacaagggaacacctatgagtataaatacaaggccccctaggaggagaggagacacagaacaatagatcaaggcggaagatcaacatacaagccaacatacgccaagacaatacgccagatatcgacttcagatattggcatggctagtcccctacggtgcctatgtctaccgtcaggagagatatagcactgtctctgatctcgccggatgtggattcgagcaagaaggctaccctattgtcgactacgagtcagtactacaaaccgccaagtcgacaacagttagataggctaccccaaatattgtactggtgtgattatgatgaataagagcagtaccagcttcggccaacaggatgtagggttattacctgacaattcaggggcccgaacctgtataaaaatcctcaacatacgccaagagaagacgccagatatcgacttcagagattggcatggctagtcacctacggtgcctatggctaccgtcaggagagatatagcattgtctctgatctcgccggatgcggattcgaggaagaaggctaccctgttgtcgactatgagtcagtactacagaccgccaagtcgacaacagttagataggctaccccaaatattgtactggtgtgattatgatgaataagagtagtaccggcttcggatgttgggttattacctgacaattcaggggcccgaacctgtataaaaatcctcatctccgtatcttttacctaagtctcgcgtacatcctagtgccaacgatcctcatattatgcaaataccggaatcgcgacatcatacgtcgacagtggcgcgccaggtagggccgtagggggatattggtgctttaggatttcgacgagatgggttcgagaaga

SEQ ID NO: 9287 - DNA, 1501 bp, Oryza sativa
ttgttcatgcacccgcaactccactacttgtattagaaaatcatattaatttatattttaagtttgaaataattaacttaattaatcatacactaatagtttatcttgttttatgtataattttaatccctctcaaatatacggtgaaaaattggattgtggtggtgtggcaatgatgtatagcaagaagaataaataagcaatcaagtgaactagctgggtggcccgcgcaattgcgcggctagcacctaaacaaaatcatttttttattatgattttacttaaaatttattaaatagctatctcattgtcttaagagtttgaaagaccaaatcttatcatccacgtgttcctaattatatatatagttttttaaaagtcacaccagttgctacctcttatgtcatttccttttttatttgcttgctcgctctaccactatttttgttcattctccttggaacctttaagaattagatcttatagtttttagagtttattgtcacgttgggtttcgtttttataatttctagacgtcccgtcaaacgttgccattatactcctctgtatcccgtccactgtctcttctctttattgttattaagattttaaaaattaaatataattatcatttgggttcatttttactttctagaagtcccgtcactgtcagcggctttgccattgtacttctctacggctcgcccgctgcctcccttctttattgacattgagattttaaaatcgaacatgattatcattattttttttacttttgaaagttccgaacatttaaaaattgaaccttgtagtttttagagtttattgtcttgtttggtttcattttttataatttttagaagtctcgtcaaacgatgccactatactcatgtgcggcccgtccgccgcctactcttttattgtcattgtggttttaaaaatagaacataactatcgttggaattcattttttttattttctagaagtcctgtcaaaccgtcggctctgcaactgtactcctatacaccccgtctactgcttctattttttattgtcattgagattttaaaaatcgactatgattatcaatggggtttattttttttactttttagaagtcccgacaatcgccttgctcgtttgcttcacagcctgttgtcgtccctccttttaattgtcattaggattctatttggtgttttattaacattttttatatgtcgtatcaaccgccatcactctacttctttataggcatgttacttaatttatctcgtcatatgttttagatggtattttctttcaatagtctttatttttatcacaaattttagttatttataaattgtattcctaatttaaatcttatttttctttttctaatttcatattttctttttcaaatttcaattaatatcgtattgtgttcttttaatatttttattttttattttcagtttcagttgtttcaaaattgtattcctacttgaactctctttt

SEQ ID NO: 9288 - DNA, 1501 bp, Oryza sativa
atatggagcgtgcatgcacacagctgtcgtttttgtgaagaaacacagcgttattggtgttgtagaggcaagcaggcaggcaggcaggcaaggggaggggcaggaagaagggaagaattgaagaggctgaggctgttggattggaaaccgtttccaattctccatcctctctatcttcctctcttccttctcctccggtccctctctctctcccccctccatctccatctcctctcttgtatgtatgtatgtatcttaattgttgcagctagctaagaacatcaatcaaattcaaatattacatacataagcctattgattgatttgcttgctgcagttagcctacttacgtgtatgcatgtcaaaacaagacgaaataacaacaggcatgcatgtatgtatgcttattttgccgtgctagacggcttttgattcgtcttctttgatgggcattcatccctttcagctccaacccctacaggtatatttgtatgcgttcatccaattcaactatcatcattccatcttttctttgccattatcttgttttggcgtcaacattatcacataaaactagacaaaaattcaatattaccacaaacagttgcctagccttttttttgtgctgaaacacatgcatggctttgaatttcaaattcaaagctcataattttatataaatttatattctaacatgtttacgaaacacagtaattcattatcgaaagcgcataccactgaggttatcagaattttacactacttcaatattactctactaaaaaaacaaattttcgtatatcccttaatgctctgcttgttttgcacaaaactttcttctagctttgggaatgatttctcaaattatatgtaggataattttcatgtcatcgtctggacatatataatttcatattgttcaaagacatgctctatgcttgactcttgttttgcaaatatcctgattgcagttgatgctatggttgggaataggatatggtttgggggccttttcaccagctcaggtagaaggcgccaaatcaatgctgagaagacctttgagctgagccctgttcaggtgaagttgtattaggattagcatacaccaagccacgttatctttcttttttcgataatggaaatagtcacattgcatttctgatggctcgttcttagtagtattcaactaaaccatcaaatgcagtaaatagtgataactctgcccagccaactttgcaagcgagactggatttggatggtctcttcttttataacagcattcatcaagacatagcatttctcacatctcaagtctgaactaattaattaaccttgttcaatgccactcatcactcatcaggagcaacgtttgcaaaagctgaaggaaagactaaatataccttatgatcaaactcggagagatcatcaggtgggaaattccagcaaatatatataaatatcagcaaggttaaatagaaatgtaccagtaatgtagatagta

SEQ ID NO: 9289 - DNA, 1501 bp, Oryza sativa
cttgtccagcaggatgtcaagcaggtccttgctgccgacgtctgtgtctgtcttcttccgcatcctagcctcctccttgtgcctgatcatctcctccagcagcgcgtcgaacctcttgtgcacgtcggccgcacggcgcccgaggccctgcaggtcccagccacggcacagggcgatgtagtcgtcggcgttgaaggcgcccaccagctccgccaccaccttcaccagctcctgcgcctcctccgtcacgctgctggggaccgtgctggcggccatgcggatgatggaggtgttggacatgcggatgagctcgcgggtcaggtccaccgcctccgcctccggctgcgacaacacgtggcgcagcagcgacaccagcccggctcggcgcacggggcgcagctgctccaccgtgcgcgggcccagcagctccgacatgcacagccgcttcatgaagcgccagtgcgggctgtagggcgcgaacgcgaaccccgccgactcgtacgcgaactgccgggccaccgccgtcagcggccgctccgatatcttcgcctcgtggctgcggatcagctccgccgccacctccgccgagctcgccacaacgcagtgcgtcgaccccagccggacgtgcatcagggggcccagcctcgccgccagctcgtggaaggtgcggtgcaccggcggccggagcaggtgaaggtgcccgatcaccggtaggctcgccggactcgggggaagccgccgccgcccaaaggcgttcacggcaacgtgcacaaccacaacgacgacgagagccagagccagggcgcccatcgtagtgcccattcccaacagcggcacctgcacttccatcaacgatgccatcctaccttactgatctgtttcaccgcacgcactattatagacatatatatatactccctccgttccctccgtcccaggatgataacctaccattggatctccgtactcataatgtctcgtccgattctaagattattgctatattttgaaacaggggaattagctaatgaagaggcatggatcgtgttttatcttcacgtaaattttttaagcatatttacctgctctctctagttacaaataagttttaccttagaattcgtgcagttaacttaattcattttgaccattataatatacaacaacttctaatttcgaaatatggacaagtacattcaagctaaaaatacttatattttaagaaaataattatttaaattttgggcatatgaaaatgacacattcaaatttgttatagcgaaagctttcgtagataatagtacacctatacaacttctatttttatttaagtataataattattccctccatatttaaatagatgtcgctactgtcttttggaatgaattaatcactatattaccaagaatgttttttcagacggcccaaattactaggtggagcatctgtctgtaaccaaatttctgtaaaatttgggactttcataggtagccccaca

SEQ ID NO: 9290 - DNA, 1501 bp, Oryza sativa
tgtgcgtgaaaatggtattttactattttttttattgtagaatttagaatctactgcgtaagatctcaatttgataattaaactatacagatagcaggcttaccagtaaaaatatcacacatagatagatatgactattttcataagcggtgctttttaagtgcatgaattgtgtaaatagtgagccctacgcacgaccgacgatgctcgaccaccgcccgaagcaaagtcaaagatatatcctctttgcatcctcttcatctccttccttcggagctctcccctctcagagtcctcgcaacaccgctgcctcctatttcccctctcaatcgcagcctccatgaaaccaagagtgtcgctgcctccatcacaatcgtacatcctatctgcgccaccctctccctcaccagtcagagctaggatgcaccaatgataggtggagtgactagcgtgacccaagatccggtgcgaggaggctgtcggcaaccacgcgagagtggtagagagggccgccgcacacctctcctcctcgagatgcgccacatatggatggcgaccagctggggagtagtgaggaggccggatcgggacagcggggtgacaacaatgactacaacgacggtggcttcactgatgaatttttgtgaatctgagttttgtggaaattattttgctggggagctagggtttgtggagaacttttttttgcaaaaatattttccaatctggtgcctttcgattttcacaggaggtctactaattgaaccgtgtatgataatcgattttcacatatataattgtgtggggctacctatgaaagtcccaaattttacagaaatttggttacagacagatgctccacctagtaatttgggccgtctgaaaaaacattcttggtaatatagtgattaattcattccaaaagacagtagcgacatctatttaaatatggagggaataattattatacttaaataaaaatagaagttgtataggtgtactattatctacgaaagctttcgctataacaaatttgaatgtgtcattttcatatgcccaaaatttaaataattattttcttaaaatataagtatttttagcttgaatgtacttgtccatatttcgaaattagaagttgttgtatattataatggtcaaaatgaattaagttaactgcacgaattctaaggtaaaacttatttgtaactagagagagcaggtaaatatgcttaaaaaatttacgtgaagataaaacacgatccatgcctcttcattagctaattcccctgtttcaaaatatagcaataatcttagaatcggacgagacattatgagtacggagatccaatggtaggttatcatcctgggacggagggaacggagggagtatatatatatgtctataatagtgcgtgcggtgaaacagatcagtaaggtaggatggcatcgttgatggaagtgcaggtgccgctgttgggaatgggcactacgatgggcgccc

SEQ ID NO: 9291 - DNA, 1501 bp, Oryza sativa
ggtcctaaatcaaagtcaacaaaacaggcataggatcacttccccaactgagacataacagatcaagttctagagatgatttcatcaacataatcattcaatcatcatatgtttcacaaacgaatctaatggtttcatttacaagtgaatctataaatagcatttgatatattggtggtcaaaactataaaagtttgattcgacggtttcaaaaacatcatatatttccattacacaacaaagagacacagatgtagcccaaagtctgttctgaattctatggctttgacatgatgctatgctgtagttctgtattaatcagattgaggccagtgcagattcatgagaagatttgcatactttcacatatctcatggtactacatgtaaaaataatgtcaattgcttgatagaataaaacatcaaatgcatcatacaggtacaggtacagatcttccttgtatggttagaaaaatattcacatcaacataaagaactggaaagcattggtaataagttatcagctataggtaagcatggaagacttatcgatcatccatggtatgcacttgcctcttactccaaccctagaaaagaaaagaggaagattaaagcaagacaaagaggggggaggaggtgccaaatatattatacaggtaacgtggatatcgtaagggaacacccaaagttaatgcatcatttttaagcacttgtcatggtgtacaatggcgacggagacttacaagataatgcacgtgataccgccactcatcctccttgttttcggacttttgaaccttgagaaatccagaagacaaaatctattggggaatgcaattaacaagcgaaagaaggctaggaaattcaagtatgggagcggagcaactatggaggccatttgcagagaagcaaaattaaatgaacgaaatccggaggggaggggaggggaggggactagaaccctaggttggattggagtggaatgggagataggggcggaccttggcctcgtagaggagggggccgtggtaggcgagcactctctcgccctccttgaaggacggcgatgtctcgtcgtgcttgtccttgccaccgccgcttctggtgttggtgttggtgttggagctcccccccatgccaaatcacccaatcttctttcttgtagccggcggcggcggacggcggacggcggacggcggtgggcaaagaggcgtgctaatggcggcgcggcggggcggagagagagactatgccggggcggttttgaacgttggaagccaagcagtaggggctctttgtggatcggaactgccgatttctgctttactaaaaagaaagtcgcaacgggaagaaaagatatttacatcgaaatatttggctatggttggatttaatctttagtaaattagtcatcattaataacactttttcaaaatttgttggaatttctagagtttaattgtcaattttgattatataaacatcattcatttcagtattta

SEQ ID NO: 9292 - DNA, 1501 bp, Oryza sativa
gcagcggagagcgggctaggcgcagcccctccctccagccattttcactgtgggcttccgcttccgagctcgaaggcgagcgccaccgcgaggaggggaggaggaagcgggggctagggtttggtgggttggggattgtcacgtcgcgggggacgggatggggtagctcctcctcgcaccgtcgccggcgccgcggccgctcgcgttccagtgccggtcgtcctccggtggctgctgccgccgacgaggccgcgtgcggagaggcgcggccatcgtcgcatcgaacttggcatcatcgtctggtgatgccggctcgtcccagtcggcagcggcggtgtacgtgctggcgcggcggggcttgctcctcggcgtctcggcgctgccgctcctccgcgctagggaagccgcggcggcggccgcggtggccacgcctagcagcggggatctcgcctctcctttgcaggagtttgttgaattccgttctcgttttgtgtttctcctagcctgtggatactagtatttctgtctgacattatattgtggagtaccatatatatgaaatctgtgtgcgatttgaagcatttgaggttgggcttcaaattttctgcaatgtccaattgtgtccaattatttacattgttccgtggatgtcaaatttactcctaacgtacaacgttgcattatatagacgttttagctttctggtgaactcttgttatttctaggtctacatgagaaatctcaactttctgttccggctaatgagggattgagggcaaaaacataattaatgaatagatatgggagagggtatatagtcctatttaacaccattaactcctccatccaaaacaggggcaaaagtatctttccgttcaaaaaaaagtgggggcaaaaacgaaaaccctaaaaagtagggacaaaatcaatattagagattaaagtgtgggcaaaaacgaaattgtcccaaattttttagtccctatcacatcggatgtttagatgctaatttggagtattaaacatagactaataaaaaaactaatttcataaatgagagctaatccactagacgaagtttttaagcctaattaatccataattatcaaaagtttactatagcatcacattatcaaatcatgacgtaattaggctgaaaaaattcatctcgcgaattagtccaagattatggaatgggttttgtaattagtctatatttaatactctaaattagtgtccaaatatccgatgtgacaagacttgaaataaccttactgaattgtttggtccagaggaagcggcccgtaagatccgacccaatagaggggagatgcgagcgcgcggggttccaagcacgccacaatattcggcgcccaccatggcacaaagtgcggccgccatgtacaccttagggcagaagcgaaagggaaggttaaatcggggcgtcgaatctacaggcggaagggaagggttgcatttcactaatctatggcgtttcact

SEQ ID NO: 9293 - DNA, 1501 bp, Oryza sativa
tcctaggagcctggtgcctctcctcaaagtactcctctagaccgggaaacaacaccctcttacaattgaacatgaagtcatcagttaatgatacaattatgatatgcaaattgagaaaaaatgtacaacaaagcaaaaacaacctgtgtactggacccaccacctccccccgtcctacggcattttttcggtcgatccttagatttgtctcgattcggacaccgagttttcttatggcctggttgatggcatatggaacatttgtttgtgtctgtcatgtgcttgtatctttgtagcctttatccatgtcatttttaaacgtttttgtccttcgtcttcctccagtgtcgttcttcaaggacaagtcaggaacaaagaactcacgtcataactcggccactgggatggatctaagtagggctcaaacctcggggagtatgtgtgctgcacaacctcattggaagcttcgaaacatatccgtggggacacctccatgtccaaaccttggagtctctagatggttatcatgtgtgagcatggcatgtggtggagttgaggaaattggcaagtaaatgtgttatctcttgcaaccacgacatagtgacatccaccccattgcacaccggccgtcttgactctgccttgtgtcagttacagctgcactgacctctacaaccgccttacaactgtcattacaattctataaatagaggagagcttctcatttcacaacacacacctcaaggagcaattctcactattccatattgtattatctatagtttagtagaaataaaaattaggagcttcggtcttattcatcccaatccaattcatccatcgtgtgagaaaataactcctcaaatgtgggtttggcacgaaacattaattgcctaacagtcatcccctcaaattggctttcactggtactttcatctaccacatagctactaaaatggagtcgtaccaatctatccatctacatcagttgaccgataaataagagtgcatgattctaaaatagtatgccagtctaaaaatagaaaaatgacattggtaccccaaaactacctacaatatttttgtaattttaatgcctaaccaacggtcacaatgtccttaggatctatacctatcaacatcaacatgaatcaatatgaatccccaaattcatccatagcaaaagagtacaaaacttacaaagccaatatgaatcctccataccaacatcaatatacaatgtggagattatgggtaccccatacccacacggcatggttatctgactagttataggggataacttatatctatggaatatgtaacagatcatgacttgggtattacgtttccttttatattatggagcggcctacagtcctgatttgataatattgtaaaatagatttaggaaaccgatactgtattggttaaggtttctatcttgtaatcctgccccccatactatataaggtgggcaggaggccctctagggggcatg

SEQ ID NO: 9294 - DNA, 1501 bp, Oryza sativa
gagcatctgtttttactcttcggcacaactgtttttgtcagagtcgacattattttttagaaattattcagattttttttaacaatatatacagcaatatggtaggtggtgatgaaaaatggtgaacagattaaaatgtttgatttaggatattatatatggttcacaaaacacaaggagagaatgctaggtaaaaaaaaaaacaaactagccctcatatgctattcctacatctccttttctcctgctatatttcaactttcatatgagaagaaaagaataatgctgcgacgactccatctatcctatggttgtgttaatttggaggggtcccttcacatgcaaaactgaacgacgaattaacgaattaacgcataattaattaaatattagctaaaataattaaaaatatgttaatatgattttttaatagcaatttttgtatagaaatgttttgccaaaaaaaacacgtatcgtttaatagtttgtgaaacgtgcgcgtggaaaacgagagagatgagtttgagaactttgaggtatggctgtgttcttcccttcctttcccaactaactttccttgttttccacagacatgttttataaacggttaaacggtgcgttatttgcaaaaaaaattctataagaaagttgctttaaaaatcatattaatcttttttaaaaaaaataaactgatacttaattaatcatgtgctaataagttgctcccaacacaagaaaatacaactatataggccttgtttagtagacctccaactcctaaatttagggccatttttgataccaattgtttggcaattcaaatagtagtttgattggtttggattagagccaaagcattggcaatgcccatacttgatttggtagcactctagaattttcttcactataaaaagcatattggtagcaaatggtagcaaaccaaacacatattatatgaactctaccctatcaaaaaattggtagtactaaaatttgcctatattttggcactacaattgaattggtaggatagagaaccaaatagactcttacttataagggttgagtctagagtgaagttgtgaagctgtctaaacctagctctacctctctagttcattttgcaagagagcttcacccagctccgcttccattttaagtgaaactcccatactattagtaagcaaccagcagcattctggtaagctcaccgcctctagcttgggccagaaaaaaaaaaagctaaccccaaaaaagaaaaaaaggggcagaatggtggtaaccttaccgcgcccgaaacccttgtcccccacccgacccgcccctccccgcacgcgcgcacctcccgcctcctcccttcctccgcctccgcgccctagaaccttccagaagcggcggccaaggcggcgtggaagctccaggtgcgcgccaccccgccctccggaaccttctggaagctctcggggaggggggaagaggtgggtgggtgggaggatgggga

SEQ ID NO: 9295 - DNA, 1501 bp, Oryza sativa
cgggacattacataagcataaccatcgagctaagcatacacattacagcagcattctccccaacgacgcagcaagaaagtctaacattttcctcgcaaaaccacaatcctaaggacgatgatacaagcatatccagtggatacaggcaaaccctagaaccgtaatccaagcacgagctcatcacaatcacaggggagttacgcccacaaatccagctaccgaaaccagtagaatcgaattcttcttactcctcatcagcaaagctcatcgtaatcgcccaaaaatcgtcagaagcgaatcgaacgaaactgagatggaaggggaagggtgggggaaggggggcggtcaccgtgacgggggcgtcgacgcgctggacgttgctctcctcgacgaggatctccatggccttgaggcagagcgccttgacctccgcctccgtcagcggctcgcaccgcttcagctgctcgatctgccggtccagatccgacgtccccatcctcccacccacccacctcttcccccctccccgagagcttccagaaggttccggagggcggggtggcgcgcacctggagcttccacgccgccttggccgccgcttctggaaggttctagggcgcggaggcggaggaagggaggaggcgggaggtgcgcgcgtgcggggaggggcgggtcgggtgggggacaagggtttcgggcgcggtaaggttaccaccattctgcccctttttttcttttttggggttagctttttttttttctggcccaagctagaggcggtgagcttaccagaatgctgctggttgcttactaatagtatgggagtttcacttaaaatggaagcggagctgggtgaagctctcttgcaaaatgaactagagaggtagagctaggtttagacagcttcacaacttcactctagactcaacccttataagtaagagtctatttggttctctatcctaccaattcaattgtagtgccaaaatataggcaaattttagtactaccaattttttgatagggtagagttcatataatatgtgtttggtttgctaccatttgctaccaatatgctttttatagtgaagaaaattctagagtgctaccaaatcaagtatgggcattgccaatgctttggctctaatccaaaccaatcaaactactatttgaattgccaaacaattggtatcaaaaatggccctaaatttaggagttggaggtctactaaacaaggcctatatagttgtattttcttgtgttgggagcaacttattagcacatgattaattaagtatcagtttattttttttaaaaaagattaatatgatttttaaagcaactttcttatagaattttttttgcaaataacgcaccgtttaaccgtttataaaacatgtctgtggaaaacaaggaaagttagttgggaaaggaagggaagaacacagccatacctcaaagttctcaaactcatctctctcgttttccacgcgcacgtttc

SEQ ID NO: 9296 - DNA, 1501 bp, Oryza sativa
ccttgacctcccgaggccgacggcggcgacggagcggcgcggcgcggcagtggaactagcggtggctagcggcggatggaggcggcaataggtggcggtgcgtggggagagcggtacggcgacggcgcgcggcaagtgagcagcggccgagattgctattgcggcggcgaagctagcggctgggattgcgtggtgtggcagcggctgtagaagtggcggtgtggcagcggctgtagaagtggcggcgcgtggttgatgagtggcggcggcggctgagcttgggtgtgacggcgccggtgcgatagaggtcacgggagagggaggtggaaaggggaaaaatggagaggaggacgcagggaagctatataggggtttgggagaggcggacacggccgggaaagggcccgatttggctggcgacgtggggaggtgggggagagagagagggggggattcaaattgaatcctgcccctcacgggcgcacgcacgagcgggagaagcgggttagtgggcgggcgacgtgggcgtggggcactggtgtggagtggtggcgtggaggagagcgggaacggtggtggcgtgggcggtttcagcggcggttgctgcccggctagaggtaggggacgacttgacaggtgggccccacctatcggcgtcccagagaggagggatggggcgtgggccggcccagccgagcgggcagcgtaggagccaagtgggccgatggcccaagaagaggaaaaaggaggaaaagaaaaaagaggaaaaagaaaaggattttcctgggattagaatattgcggataattgatttttattggttaaaactatttatagggctatgaaaattctactaaaaatcccgttaatgaaatgtgacaagtggaacccaagaaaaatcccacaatgccatttccaattattgattgcatttattaattaaggaattagctctaggttaatcaaattatttcttgaggcaatttattaaacaaatttttaaagcaagaaaaagggggaaaacttcagggcgtgacatcgcgccacgtgaggagtcgagggatggtgaggagggcggcgacgaggggaggggctttgtccgagatcggctccaatagcgcctgagccggaggagacgatgagcggccgccggctgatgtcctggagaacttgggagcgacaccgatttttctggctaaggaaacgagccttctgttcaaatgagccgtcctatttcagtgacttggaccgagtttgagcccgtttggccgcctcactgcgtgcgttcatccgatgcggtatgaacgacgcagctgcgccggatgtccctctgacgtagcgagtgctacgtccgaggatctggaggagatggaacacaccagccgtacgaaaaatagaaggaaagattccttcgctactgatttcatgggaaggcatgggaaaaattttatccacttcaagctcttttttattttgcttcacaaaagaccaaagcaatcaa

SEQ ID NO: 9297 - DNA, 1501 bp, Oryza sativa
gcgacgtatttttcactttgttcagaaaaaataggaactacatgaacaatctatttaaatccatggttgtggaagtgcagcaggttaggctcgtaaaaagtggttaactcaaataccaacactcttcagttatttgccctagagaaagaaaaataggttcatctatcttctgtagaatatagccatttatatgaactgaacgacataagaatttagagtcaattgcaagaaaaacaaatggtactgcatataccatcaacttcttagatcccagatcgattaggataaccgggctttaacagggaagcatatatgtgaaatcaaaatgttgatctgtcaatatacttgttcacaatgtgatgtgcatgtcacactgtgaaatcaaaatcattaatgcatgactacactgtggtgtgcatgtgaaattgagcaaaattgcagtattacatttggaacagggttaagcttttacaagaaaaagatttggtcaatccctcgaagaaaatatggttggcacagtaatcagggcatttttttttcttgatttgcaaaccggatgcaggcaattttaaacatcagattctacaacagtgcgaagattgacccacggagtatatatttgcactatttgtaaggggtaatcattatgaaagaaattacctataccaaacagaaatttagtagaatcagccaaaaatttccttgattgtgcagcaaacaatagcagttgacatggtgtcctgtcagcctgaatttttcttcgacaacctgaatttttgtcctatagattaaatcatttgaaatgaaaggttaagtcagtttgctagatagaagcaatcacatagaaaaattgacacaaaagaattatctgaggcgggccatttcttccccacaattttacagtgaaagattgacgataaatgttaacaagatgtgaagtatctcatccaatgacagcaatgaaacccaaaaaaaaaaaaatcgtaccacacgaatgagattaacatgtgaaatttagttgaaatgcaaaacaggctttggattagagttttgcatcacagatatccatgcacagtgaacaatgtttaataatgaacaatggggatttagtcaacaaaggggatttctaaagccattatgcatctctatgaataaacgataccctgccccgtatgcctcctcatgtacaggaacgggatcgagaagcactcttaccttgttcgcaggcaggatgacggcttgcagggttgaggagccctggatcagtggcggcgcgagggacccaagccggttcgccttccagggccggaccgggatggaaccacccaaccaccggccccaccggggctgcgggctgcggcgacgtggagcgtcgtgaagggcaggcccgacctcgcctcctccagccgtcacgcggaatctgccatcgatggagggcaggcccaacatcgcctcctccagccgtcgcgcggaatcacgcccctatggcggaaacagacgg

SEQ ID NO: 9298 - DNA, 1501 bp, Oryza sativa
agacaatgagggaaataataattgaaaaaagagcagataaggacatagaaaaaaaagagcagaggggacatgtcaagaatttttttattatgtaaacaattttaataagtaaatacctgtgtgcaacgggtaaactaaaattataacaaatataaaattattagatgattaggatttagttttttatgatatgagccattaaaaaaattccttatagaaataaaataagttgtaaaaaaaaggcccattagaccctatcagcctgctattacgcgtccagcacatgaagcgcgtgtggtgctgtggcccgatatggaggccggcccgatgcgggatcgatatgagccattcgttttgatggacagctcagattgattctaaatccatcaacactctaaccctaatcacaccttcacccgaccgtgagctccaccttccgctcggcccctccccgaccggtggcgcctctcctcctcccctcccctgtcccgaccagcggcgtcgctcctcctccgccgcacccctccccacccctcctggtggtgcctctccccctcccttcccctctcccgaccagtggtgccgctcctcctctgccgccccctctctgctactccctctccccctctcctcccctcttggtggcgcctcttagtatggcggcttcctgcgggtagatccggcagcaccaacggcgccggtcgcttcccgtggcccgaggcggtagagacggcttcccgcggtggatccgacggtgacgacggtgctgacgacttcccgcggtggatccgacagcgacgatggctacgtgcgtggcggcggcggcggctgcttcctgcatcgaatccgacggctacgaaggtggcggcggcttccggtgatgtttttattttttttcctcttttgcttgattgtcctattggattttgtatctatgtttgcaatgaattttcgctgaatcgcttgtgcatttggttgttgctgcggactctggatgattttctttttatcttgtactctcatctcggatgttgtggatgagggatttttttaggacactgacgaaaaattaatgtgttaacgtaacgaatctttaatggtacatgaatctcaacaaaacaacttcacctttactacttaaactagtaatcatgcacgtgcaatgcacattcttcttttatatattagcatgtaaaaaaaacaagtaatcaacttttaggtaatgtttggctaatgggaaagggaaatgatttaccacccatcaaaagatatctttaaatcctaaccgttcattctctctcttctatttaatcctaacccttcattcatttcccaatcccaatcccaccctctatttcccattatccaaacacacccttatgtcttgtgtttcatcaagatgactctagatcagaaaattaacaccagtgtaacatagttccaacagatggcaggctatgagccaagctatatgtttcaagagaaaagaatagaatatgac

SEQ ID NO: 9299 - DNA, 1501 bp, Oryza sativa
attcgtacatttcaaaggagcccgttacattcagtatgtgtgattggctgagcttggatttagtactagagggttttttttgtcactttcgttgtcagtttcttttttctaataatagctaagaaggcaaacaaatgatttaattaaaagtatttttaaaatttaaggggtcctttgaaacaaagaatggaaaaaaaaacatgattgaaatatcatgcctggttaaatactacatgaaataaaccgcatgaattgtttgtttggatgtctcacagaaaaaaacaattcttttttaaatatttacatattgatttatcagagcgagaaagaaagaaggtgcattggaattctcatagcatttgtaaacatgaggtaccaaaatatggagaaaatctgcctatcctttaaaattcattttaacccaatttccatcattcaaaggctctcattgtaaatattttcctatatttttcctacaaatttcttcccatccaaacgagtcataaaatccaaaattagcttcggtcggtacaaacaccagaattcagccaacaaaagaaaccaaaaccctttttttttgggtgcaaataatgccgagaactggctgcgacccaggacccagggcaaagtgatttggacccggaaggagcaggaataatccctgacgactacctgatgagtgataagactcaactgacgtgctgtgctgttctttccaaatccccatcgctttcttctcctccttttttcttcaattcctctcgctttactttgcactgttcgattcattcgtcacggcacaagaaaccattcttaatcactcgccctttcttcctccatcagtccatctcactttggttccttcaagaaacgaagcatcaagaaagaggagaggagaggaaaagcaagtgaggtttcagacttcagaggtgctctggaggagtttggtctcgatcatcatctctctgaagcctgagagagtttcagctccgattaccacttgaccatggtatgcaagcttgccctctgcagatatgctgattgagatgctgattctcctatggctatgtcgacttcttcagattaattttactttgttggtttggtgtctggttttcatccggtttcttgatgagattagtttctgaccaagtagctgaatttcgttagcaacatatcgttttgtaagctttgcgcatgaaaccttgttatctgaatattttaaataagttcaagaattgcttattagaacaacgtaaccgtgatcctaaacatgtacatacttcaggttgaaaaaaaaattagagttcattttcagtttgctcccagtggttgcttctctgaagtcaattaggataaggataaacagaagcagcagttactgtggagagaatcagagcaagagtctgaaccagcagaaataaccaaaaaatttcgctgaaaaactctgaactgaaataaccacgagacgcatgcaggcgagcaaatacagaggctacta

SEQ ID NO: 9300 - DNA, 1501 bp, Oryza sativa
aggtgtcgatttggtctattggtttttcttttttactttgcttaattctcgtttttttttttaaaaaaaagggttgttctgttggatctccagctggagccaaggatacatactagtagtaatttctgttggtttgttttagtgatttatcttggtttttttagatctggtatacatctcccgtggttcgattgggctgggtatttgttctttgaagattggtgttttcagtttttcttgcgtgctagtgatgattaaagaagttaaaaatggtgaatcctggattaatgtgctcgcgtgccgctgtgtgcgcgcgcggctggagattttttttttctctctgttcttctgtgagttcttctatggaaaatatattttttttcttctaacctctccttaatttgactcgtgtgcgtagttacttgcaggttgtcagaattactaggttttgaaattacgactggtactccaggctggtagagcggcaaggtatgaaaatgtataaattcatcattgctgggctgcggctctatattaaagagagatgggggattgcaggttttgcccctcccccccccaccccacccccccacaatagatggaattcagctctatgcctagttcgtttaatccctcccacaaggggattgagggagatttggaggggatttattccacacctattgttattgtggtgtggaattattccccctcaatcccctccattcattctctcttgggtttaaacgaacaaggctagcaaatccggatttttgtcagaattttgccttaaaggaatggtagatcctgattttttttccagaatcttgctggagcaatagacaattctgtttgtttgattgatctgtctaccacatctaccgtggtccaattgcttcttaatatgatttgtgaagactcgtgtttcaattttcaaggccgattgattcttttatttgatttctgaagacttccatttcgattctgtcgtgctggtgatgattaaagagctagcaatggtgaattcgatgaatttgttcgcgtgctgctgggtgcgcagcagtggtgatatgcatccttacgcagttcatatgaggcacgcataaatcgaaatcgattaaaaggccggaatgttattccattatctaaaaaaaaacaattgcttcttaatatgatttgtgaagacttgtgtttcaattttcaaggccgattgattctttaatttgatttctgaagacttccatttcgattctgtcgtgctggtgatgattaaagagctagcaatggtgaattcgatgaatttgttcgcgtgccgctgggtgcgcagcagtggtgatatgcattcttacgcagttcatctgaggcacgcataaatcgaaatcgattcaaaggctggaatgttattccattattaaaaaaaatcgaaatcgatttttttcctcatgtgcttgtgtttcttctttcctgctgccttcgatacaactccaaaattgctgtttta

SEQ ID NO: 9301 - DNA, 1501 bp, Oryza sativa
ggagaggggaggggggagaagtgtccaggtgggggaggtggggcccaccgcacgggcttttacgccgacgtggtggtacttttccacgtggcagccgcggggctttgtcggggggagaaatatctcggcgcggcgccccgatattttttttcgcgggggtgtgtggcaggtggggcccaccgggggtgggggtgggggtgcggaaaagatcagtgggcgggtgacgtcactagggaggggatggggtttgacaggtaagacacgctggccgagaatgggaggttgatggggggtttgccgatttggggattgaaagggtgatccgggtgggaatcttttcggggatattattgttttgatgcgcggatacatggaatggtatgcattatcgtatatatatacttccttcgtccttaaatataatagattttaaaaggacgtgacacatcttacatcctagcacaatgaatctagatagaatgtcggttcaaattcattatactagaatgtgtcacatccataaaaaaaatccctgtcgacgggggatacccgtagaccggatatagagggtattggggtacgctggtataaggatctacgtaatacgacatcgagtaatcaaaagacgagaattatactggttcaggccccttgacaggtaatagccctaatccagttgatatgggattatatggtggaaaacacatattacaaaggaaaagacggaactcgggagattcgacaaggttgtagtcgagatgatccgactagctctcgtcaacttggctccttgtaggctctgacttcgtaggctgtgttggttgtcggggctctgagattcgatgccttgtggtctccccggggggtcccttttataccgcagattggatgttatctgagtaggactccgatataccagacctgacacgatacgtaggtaacccaattcttgtccgagaaggtctctccttatctgttgtctttacgaagagtttccttaaatgccaaaggatttatccgtgtacacgtggatataccttgtcggtatgtggcgtgtatcgtggggtaaagggtatgcctgacccgtaaccctgacagtagcccccgacttctgctcaaaaatgaattcgtgtgaccgtttgcaactccgggcgtcgagaacgtgtcattcctggtgcgagaaccaaagagatgatgtgtagtcgagcgcaccgtttgaagtccaacggtcacgaatgaattttgaacggaagtccaaaaaaccgccatgcacaacggacttaaaaatctccggcggggatttctcctgtttcttggaattcgcaccgtcgggagtgcgtctatttaaagggatttagggcgtgagctttgaggtccgcctacttcattaggcatacactgctcctttgcattcctcgccttactcgccaccgcaaaaagcccttgcctcaccgattcatcgtccgttcccggcgatcttccggcgatctcccaacggcca

SEQ ID NO: 9302 - DNA, 1501 bp, Oryza sativa
ttaagtactaaccatactaagtctgctgaatatgtgcacttatgcaatttataagtactaactctgctacagagcttcacaaataagtgaatcacaagtttcaaagttcgattgttcgatcatgaaccattcctgaatgactggattcaaatcctaaataaaaaatgttcaaccatgaacaattcctagattcaacaattcaaataaactaaatcctaaatcctaaatcaaatgaaccatcctggattcaactatgacctaaatactaaaatcctaatccaaccaaattaccaaaatgtttctaaccttccacctttgtttgggtctgggcgtctagccgtctaagtctgaggcagctccagggactggaggtggactggtggagggtagaggtgcgggcggcggagtgcgggcactgcctggctcgccgcccgggcgccacagggcaggggcggcggcgcgtgggcaatggcggccttcgcggcggccggcctgggggcacggacgcgcggcgtgagattggcagccgctgctgcgccgcagctagctgggcgctgccgccgttgaggactcgggggtgggtaggaggcgatgcgccgtcgcgtcggggttggggagggggctaggtagccatgccatggaggagatcgggaaggagagctggagaggttagggttacatccattttgggctgatttgggttattgtgccaatgggccgagtagaggagggaggtgggatggtgctaagtcgggctttcttttaaggaacaagtctattttgcatacttttccacatacatatgaaatatatattacatatatgaatttttttgtccaaaatcttgggtattccactgaatacctatgaattatggtaggcccgcccctgcgtgtgagagcccaatagccaccaccggtagcgcaacacgcaacatagagatcacggataccacctcatccttctcgaagtggcttgtcgcagacaactcaaccgccagaagaaatgccttgagccttcaaagccaaggcgtaccacgcacagcggcacaggtgctggtgctcaccaaggggcgtgtgcccagtgcccacccctgttccggtaggaatgaagggagcagtcacacacagagagagagatagagtgggaggtggaggtggaggtcgatagatgggaggaggatggagcgcgagatacgaaagaagagaaaactggtaagaatggatggtgatcccatccttcgacaggatccgttggctagtctctccaaaaatcttgtggtagtgacttatctagggctaacacgtcagaatgttaggctccatttatactaaaagcattgttggtttacgaattgttgacaacaaacaatactatttccactatctcctctctcaatctttttaaatgcaacatttatcctttcaaataaaaaaaactgaaacttatagtgtataccacaggatattcgatgtttttctgaatggaaatatacgcctta

SEQ ID NO: 9303 - DNA, 1501 bp, Oryza sativa
atgctatggtgagcatatcctagaaagacacagtccacagtcttaggtccaagtttgcgcttcttcgttattggtacattgactttcaccaagcacccccatgtgcgcaagtaagaaagtgatggttttctcccaatccatatctcatatgctgttttgtccttatttctgttaggaactctatttaacacatgattcgaggtcaacaatgcgtcccccaccatgccttaggtagtcccacggtgtccaacatggcattcaccaagtcggtcagtgtgcggttcttcctttcagcaatcccattagactcgggagaatagggaggcgtcctctcatgtataatgacatgttcctcacagaataagtcaaactcgtttgagaaaaactctccaccacgatcagacctaagtctttttatctttctgtcaagttgattttcaacttctaccttataaattttaaaatagtctagagcctcatctttcgttttcaacaagtacacatagcaaaatctagtagcatcatcaatcaacgtcatgaaatatcgttttcaacccttcgtcaacaccccattcatttcacaaagatctgaatgtaggagttctagtggtgccaagtttctctcctcggtagccttgtgaggcttgcgaggttgcttcgattgcacataactatggcacttagaacctttgacaatggaaaacttaggaattaaacacatgctgaaaagccgagacatcaagccaaaattaatatgacataaacgtgagtgccaaacattagcctcatcatccacactgccacaaatatggttcacagacttattgcagaaatcagaaagggaaaagcggaacaggccaccgcactcataacctttaccaataaaatatccatgtttagacacgactactttattagactcaaaaacgaacttaaatccgtctctagtcagacgggagccactaacaagattcctgtcgatagaagggacatgctgtacgttcttcagctacacgatctttcccgaagtaaacttcagatctaccgtgccaacaccatgaacagaagcatgtgacccattccccattaggatggtggaaccccgtgtgacctgataagaagaaaacaatgagatgtcagcacaaacatgtacattggcccagtatcaacccaccaattagtagactgattaactgaaaaaacagtaggtaaattaccatacccgcttccatctccagtgttgccaatggtcacattagcagacttagaagtctgccctgcaggtgccttcatccccttgcgctgtggacacttcctagccatatgaccaggttgcccacacacaaagcaagtcctctcatcctagttaggattgttgttgttcttcttctgcttcttgaagttggtggtctattgagctttgtatttccccttgctcttgttctgggccttgtacacaacattggcactcgactgcccaccatcgcccttagacgcgacg

SEQ ID NO: 9304 - DNA, 1501 bp, Oryza sativa
cctttccttataaaccatatgcacatgattatgctttaactgcacatttggttggatgtagaggctggttttacccatttccctaaaaaaaaaactgatacacgcagccaacgcatcctctaccagccataaaatgtgttcggacattcccttgttcaaactccaagcacaatggctaatttccagcatttgtttaaaaaataagtttcaggcagattattgttataacacctattagctgcaaatcattttctaaaaaataggacatcaacatgatcaaggtatcagtggattcccaattaacatgtaactgattatatttctcccacgatttacaatacatgatatcaaaatccatattaacgttgaaaccagaaatcgtaataaaaccctacctttgctccctccacccttttcttccttttctcctcctcctcttatttccttttcctttttcctcttcttctgatcttctcttttgttccacttcttttccttttctctcctcctggtactagctgttggaattaatagatgggctaaggcccattcgaagattaattctttggaaaatcacataagcccaccttatgggatggcatgcatgtggagtttagtaccaccttacttattctaggagagggggacctccttaaaagggaggatgccctcctaaccacttgaagcatgtgtggtggagagaagagggggaacacgcgctcgcctcgcctcgccgggcagggcaagcggcgcgcttgcatgacgtacgcgtcgaatggtccgcaaaattgggttggcatcccctcacccttgcgcagatgcagcctccttttgcagttttgttttgttgttggaaacattccgaaaaatccggtgcgtgaaaacggcgtggagtccggataagttacgcgcgacttttccggttcggttacgcggagtggagatcgtgcgggcgccctgatcaagcaacctatctctatataaaccgagctgccgccttcacacaacacacgtgaaatcaatctagggtttgcctcctactctgtactgcgccgtcgctcgtagactactccatcccgctcgccggcgtgcactagcgatcgggagagcaggtctccgaaacctctgccttcgatgtcctgcaccgggagaaggcggcaataaggtttttgggaagcgcttcgcgcgactgctccctgttcgtccgcgacggctcgccttcctctccgctcgcgtgcttcgcgccttcgtcgatgctcgtaaccgcgagtagttcctgccgagcaaccggtctttccgccacctcggtacgtgttcgacatgttgtgcatatttgatctgttcatgttttactacttagtttacatgtgtagatctaatgatgcgttaatattagtatacatctgtaatgtcatgatttatttatggaatatattaaattattatatgcctatattctcaacaatccaaaaaccttattataggcgctgtgattttacta

SEQ ID NO: 9305 - DNA, 1173 bp, Oryza sativa
ttggagacttcgtgggctcacgccgtggggcgcaccgacctgcatgtcgatcccctgctgctgatgagataggacatacctgcccccacgccgcctgacacaaggtaggacgtgggtgcgctgctgcctgtcccgtccgtctgtcaccggtcgcagaccggtcaaggttgcctggcgcacgtctctcattgggcggcacatgaccagccacatcgcattaaatgcaatagggggcggttggggtgccgcccatgaatacgcctggcagcgcccgcgtctccgcccgctcaatccctcacgtggcggccgagcgagggcctcggggtgacgccgcctctcgggcccgaggggtacgacgagatcccccgagcctcctggggagacatgggcaccccttggctattcactatccgtgcatccgatcccccgatgggggatccgggccacgcggccacgtggtagaagggaaaggaccccttcccctcagcgtaggtatccccgggcctatattaccgacaccctaacttacaaaaccagtgcaaactaggtccctcagcaattttaactccggttttatcctatgtggcagctgactcagcgtgggacctatgtgggccccacgcatcagcctcttcttccctcccctctccacctctcttcctctctcctcccttctccaatctccacgggcggcgcgtgggggagcagctgcactggcggcagccagcggggcaggagctgggcggcggtgcacgagctccttgccggacgaacgctagaccggctccgccgcgcccgccgcgaggaggtggcgcgccttgtcggctcgctcagccggagtgccgccgatggcgtttacgcaaatgacctgagaatttgagatcattgccatccacatgttctccttcaagccctatcaacaagattgacacgattaagctctggatcgagatatgatcgatcgcgcagcaccgacgaactagccgctgatcatcgagtcaaatgctcacatctcataagctccaatccacgtggacgaatcaatccattaaacttatatacgcatgcacatcacgcatgaacaccacaagaggacatgaagcttcacctgcaaatctctctataaatacatggcaaaaccatcaacctagctagcacataacaacttacaca

SEQ ID NO: 9306 - DNA, 1501 bp, Oryza sativa
gacactctcaaagatagtagagtagtagacaatacaactcgcaataatagggtatctataattcacaactcactgtacacaatatttttacggataactgaaaattgcaggaaaatattataaaatctaaaaaacacataaaagttgtaaaagtatagaaaatgaggaaaatagtgaaaataaatttggcatgacgtgtgctacaatctagacactcccaatatagtagacgataaaattcacataatacaactaattttgatttattattattagattgaatttcactttacgctaacttttattaccgatgttttctctttggatcatccttttaaccaatatttttattttggattggttaatcttacgcactactaaaaggcattttccatatattccaaaacctttttttcgtgtggttgagccgtccatttgcccaaaagtgtatgtgaaaatcgctttccacatgggtggcgcaccagcatgccaaaatcagatttttgtgtgtggatggacgcaaaaataaaaattcaaaaaaaaactcgaaaaccctagctaggtcatcgttgcggtccatcaccgcttgtcattgtcgccatcaagagttcatagacaagtaggagataatgtacctataacagccgtcccttcagaactgcgtagcctagcccatccgacgggcggacccacttacacacaccacttcacttatactttcgtcatcgcttcgtgtaaaagggttaacccgggagtggcatggttagagggaagatgtcttataaattggttcaactcatgctaaactagtaaggtggtactaaacatgcgcacacaactcacaggagccacacaggccaaatcctaattgggctaggatgtcacagtacccaatatggctcaaatgattgagaagagagcaggatggttaaaagtgcaagaaaggtattattatcttttaaatagaaaggcaacgtcagttgtgatcgcactagctagtcaagaccaacagaactagatgaaccatatcctggcttgattcccatgttctacttggatagggacatagatgagtataaatacgaacacaaaaccacatatcgttttggatgagattaattgagtaggttataattaggatttcccacctgtgtgttgttctcggtgtgacttcaagcggtgcacataaacaagtagtgttattccccactctgttaatatacaaacacatgatattgtttggaacaattgcaaacaaactaagtttttaataacaattatatataatttgaatatttaagttctcattaaagggattagtacagaaatcgtgtgaatagtattatttttccaagcaaaactgcttgtaaactatggtcgaatggatttaaatcggacggcttatattcatcaacagatatggctatatatagaacacttcaaccctagcaagccacctctgacccactctggttctccaccgaaccgccgccacccccct

SEQ ID NO: 9307 - DNA, 1501 bp, Oryza sativa
cctcggagaagaaccagaggcagagcatctgcacgatcgcgtcccgcgtcgcccaccgcaggaacgcaaacccagtgagccgtctcaccctgaaagccataccagagaaatggaaccaccgccgcggccgcccctgcaagtgctgcccggcgacagacgcgaacacggtgcccagagctacggagtgaacggtgatgtagccgaggatcgcgagcacgtgcacggacgaaagcatcgcgaggaggttgatgatggccacggcgtcacgcctggtcaggtcgagcaaccggagctcactgccgccgtctcgccccgcggcgggcttcggcggcgaggtctcgttacggacaacgaaggtgaacgggatcgcggtggaagggaggcggtgggggagcgacaaggggtagggtttgggcgatgaggaggaggaggagggagtgaagagaaactcgtaataggaggcgttgcggcgtcgggagggggcggaggaggcgggatcgagggtcccgacgaggaagtcgtcgtcagagagggaagggggggacgaggaggaggaggtgaacggggagcggcggcgcgggaggtggcgcgggggcgggtgcggcggggcgtgcggcgcgggcggggagaggcgggagaggagggaccggagcgccgggtcgtggtcggcgaaggaggcgaggcggagcgtgccggcgacgagcgccaggcggaagaggacgaggaggagcgccgcgaggaggagcggcgggagggagcgcgggcggagggagtgcgccgccgcccgccgcaggatccgcccgcccgtccgcaggtccaggctcgggggaggaggcggcggtggcgtcggaggcgcggggtccgcggcggccggcatggcggtggcggcgcggatcggcggcggcggcgaggggtggcggtggcggtggcggtggcgagggcgaatggggaatcggggggaggagacgccggaggttggttgacgcgcgggtgacgaaggagaccgcagaggcgggcctgggccttggtctgggctgggcttggatttgggcttgtggagatgtggaatgagcttgaattatgtattgggcttggtttagaggacaatctgggccttcttccgaatttattcttggccctatttgtgaagttcttcgacatggagtaggattcttagtcagaatcgcacgttcgatgaaattactacgagattaggacgtaacatctaattggagagggctctcgattttgtcttaactagcgacgcctaaacacagagaaacgtggagaagtccatctaatacatggtactacatgcatgcatttttttaatatacatgtacgtccttttcctcttcaaacaagttttctctcaaattacttatccgattacaccattgtgttcgttacaattaaatcttcacaacaagatcttacatgattatattaagatgaaaaaatatttatattcgtaaattacttttattatatatgtaggaga

SEQ ID NO: 9308 - DNA, 1501 bp, Oryza sativa
gatggcattccctggcacatctgatgacaattgacaagtacctcattagtcctgataatgtctttgtactaatgagcgaactaaaacatctgaataaatagtaagaacctgttttatgtctcaggggatacagttttcacatgctcgatgtctaggtaattagaccacaatccatcaccttggcttttagcttcttcttcaccagctacatcggcaagctccattcccaaacctccaaacctttaaacagcgcaggtgctcttttaccgttcccacttcccactgaccgggctaattaatggtacgatggatcaggtagatgcagcaccagcaggggtgaaacggcttgggcattccgtcgaacacgtaggaggcgccgtgccggcggcgccaccagcaactctcaggtccagtccaggccaggccatgcaggaggacacaaggggataaaagaggaagcggtcgcccatggcagtagagtggcagagcaagggagagccccgcgcggccgcgcgcgcgcgcggcgacgagccggaacagtgacgacgccgcggcgaggcgacgagcgccggcagcggcggtttgaaatgcggtcacgtaccgttagatcaaagtactaacggcccagattgatagtaggcatcaagtggatattttcagatacaccctactaacattccatatttttgtctcagcccctcccccttggcttgtattttagcagaacagaagcaatcattctactgaaatttttttgtttttaaccaaaaatacagaaagaacctataaaagaaaatacaatctgacctgctccgagatagagaaaaaaattgaccgtgccttactcttaaagatcataatcggtactgaaacgtgacaaattagagcccatcggttgccaaaagaataagttaaaattaaaaattaattttgaagttgactttatgatatttttaacaaaatttatttttatcattaggttttaagtcgttatgtcggtgatatgggaccgggagtatcgtgaccagaggcttgaggcagacacaatcgcccacgtggcctggcaccttcggggacgtcgggcccgagggtgaggtgtccgccctcctcctgatttcctcgagggggggtcgggtgactcctgccccggccccgagggccgaggcgccccgaccccttgtggagttagcgccacatgaatgggttgggtgaacacggtaagcctcacctaaccacatttattgcggtctggtcgaacgtgtcacgctgcatgcagcgtagtgcagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacaggcaaga

SEQ ID NO: 9309 - DNA, 1501 bp, Oryza sativa
acttgtcgcggtagacgcggcggcggatgaactcggctgcgcggccgttgtcctccgcgatggaggcggagagggtgcggccgttgaggaccttgccgtgcatctcgggcggcggctgcggcggcgtcctcgcggcggacgaagaggacggaagccacgccccggctccgcggggagtcccggtccttgaggacggtgacgcgggcgacgcggccgaagcgggagaagagggtgtggaggtcggagttggtgagcgcgaagtcgaggttggacacgtacaccgtcgacttggacggcgcgaggccgcccgagccgccgccgccgccgggcttgccgccgtgcgaggagggccccgaggcgccgggagcggcggcggaggggagcgggtagcggtagaggaagctgtcgtcctcgccgtcggagtcggagcccggctgctgccgccggcgagacattctggcctgcggtttcttttcccctcgtttggatgccattgccattttaggccctacgtcctctgttgggccgaattgaatacacgatggctttgctgcgaaatgtaaatgggtcttgggccacaagtgctactagatgttagctttaatttcgggggaaatatttctttttgccactcgctgaaaccgtatttcttgtgcttggcagattctgaaccacagaatcagtgcttgtcgctatgccatcttgtattacaaacttggggcctcatcttttcgcttatgtttatacttatcagttaaaatttaaattttcaactttaaatttagagttgattttaaggtttttttttcatcgaagtttatttttcagcctttgcttttagatcgctaagaacacatatataaaatttttatttataaattatttttcgtttgcaaatatgtccgcaaggttgctgaggatacgttgaccatcaaaatttgcccctaaagaccataagggcaagtactataatggcccatatgttgcccctaagaatgccacattggattgagtgatgatgtggaggagagaagtgaggagagagatgatgagccacccctaaattaagaggcaacctccacacaaatttcaagaaggatgtaagagtattaaatatattggtatttgtgtactagaggtgatacattgtatgggttgtctcttagttcatgagtgaataaaatagataaatttagaggtggtagtcacatctatcatagcacttgccctaataccctaattttctcacaaagaattactcctacctatatatactctctaaaaagaataatttaataggtatgttttttatttttttgtcagagaaagtacagtagtagttctacacactagtattattttttgtgtatactttctctcacaaaaaaaaggataatatagtgtatatttcgaagactggaacagcgactaatgtgaacgggtaacagtgactcttctcattcccattcaacgcactgttaatttgcgtagaattttggtc

SEQ ID NO: 9310 - DNA, 1501 bp, Oryza sativa
atcaaaagtagattactggagtacttgataacacaattacacaagcagttacgtgtcatgactattgtttttctccattttgttctttccaattcaaaactcaagcaaacgccggtcaaacggggaaaacgacagtcgcacatatcagagagaatttatttcagtcaaataacaatctgcttatcctttttccaatccttccgctccaagttcccttgtgtggcttccactgcaagcctgaaacttcgggcctatttgacacagctctaactctagctccaccccttttgaagctagagctcagccaaacaatttcagctccatcaaaactgggagtggagttgggtggagctttctcacaaaatgtactggagttagttgggtggagctctctcacaaaatgtactggagttgtggagctgggtttaggcagcttcacaactccactccagactcaactcctgtagttatatttaggagttaaggctgtaccaaacaggcccttcaaacttccctcggatgaaaagagtctcaattgaaaacaaaaagaaattaaatacctaagaaactactagcactacggtgatatttttttcccccaactgaagatgaagacgaaggtaggacacgaaaaataaaacattacgcatgaataattgaattttaataattacaaacttaaaaattgagtttatctgatattttaaagcaatttctacgtagaaatttttatatgaaatgtactgattaacaggttagaataggtgcaaaaatcaagataatatatgtatctttacccgtaaagaccggagcatacctcttcagcttttcttaggtcccattcttctctcatgaatatggaagattttaccttagttttcgttagcacacctttcaaatactaaacgacgcgttttatggaaaactttctatatgaatattgctataaaatatcaggtatatctatttttcaaatttataataattaaaatttaattaattatgtgttaatagttttgcatgtctcgtatttaatcccgatctttataagattcgaacgcagccacgtcctgtagctgacaccaactcggcaacaccacatgtccacatgtcatagcagctaatgtttgaaatccgaacagtgagctccctttgtaaaaaaaaaaactcaacctattactagatctcatgttttctagtacaacatatctacatgtctagattcgttgtattataaaacatcacatctaatattaggttaagttttttttttgaagtatgcccacgaacagcagattatatgatttcctgttaaaaataaacagctcacatgactgagcaccaatacctaaaccaaagtccaatctgatcacggtcactaaattaaaatatttgttgttggtgtctcacgttttgtttttaaacgccgtgcagagtgcagacatcgacgacactgtgacacactgacacacacaaaaaacttcaagaatggatcaccgga

SEQ ID NO: 9311 - DNA, 695 bp, Oryza sativa
agatagagaccgggaaaactttttccaagctaattaagctcatgtagagttagctgctcgatctcctgcatattgcaagctagggttcaaagattgggggaggagtagacgagggttcacactgtgctatctttgactggaggacatatatatatgtgccactgggtcatgtccttttttctttcaaaggattgtacggtatggattaacagggcagcgtgccaatttttcaactcttataataagtcaattagttcgtttgtagtctcgaataattatcataaatcatgcatgattcatcaattcatacgtttagcaattagcatgtaggtatgaccaattatttcatcttaggaataattagaaatattcctccaataaaatggcttgtgtccctcaattcgaatctccttggtgagagggaggaattttagggtgcgagaggatatatagccgtgagagattttattacgatttttctgtacattagtctactaattaagattttttattaacagttttatgatttagctatatataagtgaaatatattctcacatctcaactgtctggcgtgcgtttggattgagctccaatggccctccagcctccacccatctgatggagggctgacacaacagatattttaaaaataaaaatataagggaatcaaatatattttaaattcttttaga

SEQ ID NO: 9312 - DNA, 979 bp, Oryza sativa
acttccgtcaattttcaaaatgaaaaattatttttgtaaaacttttaataaaaaaaattataaataaaaaaaattctccaataatctataggtacgtataaatatacgtatcgcaccattaactgctgatctacctctcatacacacaatgccttgaaacaaatactggagccaggggtggatctaatcattaggcaggcaaggtggatcgaccgacccagctacgatccgtgtcaccccatacccccaaggccctccctaccctcttataatagtcatgggccatcaaaattaggtataacaaggtgtgaacacccaacagattagtccatctcttcacaacacatgcacgccgcaaacgatgattgaaatgatcgaggtagttatgcgattgaaatataaatataatatgtgttgtgttgaattgtttttattgagtgcacatctcagttctccgcccgatctatgttttaaagctacgtccgccactgacatgagctgtagatggtaaatttgtagcttgtttttcttctctctccgctcttctagataatttgtagatcctgcttacatttattgtagtcgcttttatataaggttctgctagttgccttattaaaaacagtaaaaactaactgatcctatcatatttcttgtactaccaggtatatataaaattcatcttttaaaaacagaaccttacaactctaataagttataaatgagtgcgatcctctatgtacagtactgctctctaacatgtggactctacatactctcgagctcacgtgtcgatctgcaatactgcagaggctccacagaccctcgggcccacatgtcggtctgtaatactgcaaaggatctgaattgctctaaaatgtcgacttaaaggtaccctaaaatttccattcagcaaccatcgcggcatggccggctaaaatttcccttcagcataacagagtggatgaccatcgcggca

SEQ ID NO: 9313 - DNA, 905 bp, Oryza sativa
aagaagcaagcgacgccggcggcgtggatcccgaaccttctgcgcggcggtgagggtgtcggagagctgcgccagcgaggcggcgacggagtcgaggccacgcaccagcatcagcgagtcctccctgagccgcttcccccgctcggattccaccccgcactgcaaagatcgcgccacatcaagatccaactccccacgcaagaagaaaaaccaacaaacaaacgggggacagcaaaagcggctcaccgtggcggcggggggagcgacgaggcggcggtcctcgaggatggtgtcgacgcgggtgcggaggcggtcccagaagcggtcgtcggaggcggggctgagcagcggcgccgtcgcgtccatggcggaggagtagcgcaacggctagttttttctctcctcgcgtgatgtcttcgattggtttgttggtttgactggaattcggatggatggggaggcgatggaagggatcgcggtgggcaagtgatttttaaacgggggaacggcaacggtcgaatttaattggtcttcgagtttcgccggtattttctcacgggttccggcgcggcgtttttactagggaggtacgcgcctgggtggggccactctgtcaggggagtccgcgttgatggctacagacaggtgtgagtactagtattatagaggttgtccattttacggaaagaattaatttctcttctgctccatttattaggatcagtttaatttcttttagctcttgattctggattttatccccacataaaacaagtagcttaacgtgtgtgtatatatatatataaagtacgagttcattcttaatcctgcaatcccctttcagatccgttgttgcgtgggacccacctgtcatccctaagaaagtaaccacgcaccaagaaaaa

SEQ ID NO: 9314 - DNA, 1501 bp, Oryza sativa
aatccaaccaaataaaaaaattgaatactatatattgaccgaaagcacctaacctaacctattgtgcattcaaatatagaggcaaagtaaaaggatatacatttcattagagaatctgataatctatcaataccaacataaacattcagaataacatttatgtttatacctctaatttactcgcacatcccgacatcaggcatgatccgcctctgccccacctctcacctggaaggaaggtctatggcaatcagggtggagagcagctgaaaacggcagccatcgtgaggaagacagacgaattgatccgtggcatttaacatctaaaataatacagattgcatcaacggggaattttacccctttccctctacctcttgcgcctaattagcttcattagtactacatgattcggtgctaaccaccacagagcaagttgcgcatcagcctgcttgtctggaggctccaaatctgtcatacactggaatatatataaatagaaatttaaaaacataaaaaatgttccaccttatgtagcaaaagaacaaaagtgaatcacttggtaacaaaatcaattgtctactgcttcttcaggctccatttctcggagagaccactcaaaactcaacatgatgttttcggttatctggcgtttaaagattaatagtatgattatgtgaaccatgttaacgaattatgtttgagtgaatggatgcaaattaacagacaaattaacagagagagaaccacacctgagaggagaggtcggtgccggtgatgatggcggcggcggccacgacgccgttagtcagcatgggagaaggtgcaagcaacctgaggccacgacggctgtgcgcggcgaaggagaatcggcgacgacgactgaacggcggcggcgcggaggagatcctgaggcagcggggagaggggaggtgggcgatgcgagggagaggggagtgcggcgaggggaggtgggcgacgcgagggagaggggagaggggagtgcggcgggtgaggcgggcggcggaggtacgacgtggggagggcggcgcggcgcgacgtggggatggcggaggttagcggcgcgcttttttttctatttttcttggtgcgtggttactttcttagggatgacaggtgggtcccacgcaacaacggatctgaaaggggattgcaggattaagaatgaactcgtactttatatatatatatacacacacgttaagctacttgttttatgtggggataaaatccagaatcaagagctaaaagaaattaaactgatcctaataaatggagcagaagagaaattaattctttccgtaaaatggacaacctctataatactagtactcacacctgtctgtagccatcaacgcggactcccctgacagagtggccccacccaggcgcgtacctccctagtaaaaacgccgcgccggaacccgtgagaaaataccggcgaaactcgaagaccaattaaattcgaccgttgccgttc

SEQ ID NO: 9315 - DNA, 1501 bp, Oryza sativa
tccagcgccattgctaggattattatttttattaatgtcgttaagaaatacctatactcagctcgggacatgttcttgagatggaggtctgtcataaatcgattatcaaactaacttcatagcaatatataaaatcatatattctaagttttagatcttgttgagtgaagttgttcttccgcaacttggtcattatatatgtccatacatacctccccaatgtgtgccatacttagtttggcataagctgattataagccataatggcttatgaacgacaaaaaaattacgagtaaaactttttatatgtgtccttagctatttaaaaaccaatactgaattaactatgatgcaaaactcaaaatcaacactaaaattaagcttggcgatggcttatacgttgacaagccaacgacggcagtgtcttaaaattccaatgtgtatgttttttattgacctagaatagtgatgcatgtgtttttttagaagcagtagtaagaattttctgaatcatacaatttagatattgtagtttattcatctggcaatagtcagaacacataggtgcatttctggtcccaatgaaatcgaagaaaatgaactgcaaccaattatcacccttatatatgcctcaaacagttccgctgataagacaaattacaaatcttctgtaattattgattaagcacttggaatgagctgcacatcacaccattttgtgttaacgagactcagtacttcaattcagcccaatttgtggaagtggagggctattcgcacaaaagttgcagtaacaaagcccatcagtactgaagcactcgcctttgctttggtacttatctgagcatatcgctttgcaggttgcatcaacgcaaggttttggtacttctgtgattggtgcagcatgacactcttcagtagctgaaaccttccctgatatgtctggacatgtagatggaaaatatacgggtttagtatgtgttggaggtatgaaattctcttacataacaaattaaatagatatcgtaaagacaatgtaagcacggaagtttgcttccttatgtctgagaagtactcaaatacctaaacatagcaccaggagggaaattgcaatcagtgcaaggtgattggtcttcatctttttccttacaaacatcaaatactagatgactggtgggtaatattgatgtttgatgaagatgcttacttggcaacacatgggtttttatagcattggtgccagcacaattttggaatcaatttaaggtgtgtatagataaggcatcaattcaataccgtaatcatagctaagatgatcggataaaatacaaatgtatgtgttcttatcctagaagctgtaactgaaattttaggctatgctttcatatctctatggagatagttcctagtatagcctaaagttataatttctgctttaaaacaatttatgtggcatggttcaaattgtcccttaaaagaatatttgtttaagaaacagggc

SEQ ID NO: 9316 - DNA, 1501 bp, Oryza sativa
agactcttcttccactcgcttcactcctcccctatatgaagtttcagctaaatttcacatagttacaacgcgattttgaaaagatttaccgtacgtcatagttcagttaagtctgaaaattacaactctaccatatattgatgcttcaaaaacgggatgctagtaattagtattgggataaaacgtaaaaaaaatttcctatcaaattttaaaaattacatatttgtataaaacatttgtaatatgttgtataaattaaatcctacaacattaattttgacattattttcaatccatattattttaaatagtgatcatagtgaccaagatacgacatgtgtatgatccgttaggatcatatgaaactaagattggatatagagaaaattagtatattagacataattagtatcgttttgattcggtaggatcgtacgtagtacctgatactatgaacaaggaattcaggatactaacaacttatgttgttagagactaagatatttataaatactaaacattattcgcactaatttgagattttgtcccacaagaattttgcatatagcatatagtgaacggtagtatatatcaacatataggtatactcacggtagtgggaagaggtgcacgacgacggtcacccgcgaggcgtagtgctcgaccgccttcttcagctccggccacgcgtcgcggctgtccgggcagacggggtcgaagtacgcctccaccaccaccgtctcccccagcgccggcgccttcccaccgtacacgaacccgtccgtcctcgccgggacgggcacctgcgccgcgccagggcggcagccccaggcgcagcagccgatcaccagcaccagcagcagcgacatcacacggtgtctggcctccatggtcaaggcttcttgcagcagctagccgatcgctcgcactttggtttcttcgacgagctagctagcaattcgaatgtgcataataagcttgtagattacaataagcagatgaggatgatatataatggtgtatatgcagcttgttagctgaaatgcctgatgagtgcctggacaattcgccgaaagtgagggtgggtgctgacggctacctcccaacgacttcatgggtattccggcgcggcaaagtgctggatgctgttgtgatggtgatcaccgaaggtagccaggtgagtacgtgttgatgacatcacatggaagttcgacatgatcaaatcgtcgtcgtcgtccagcagaggggaaaacagtctcggtttcttttttcgccgcttcgggccggccgccggcgaacaaatttgccgcccaatttttttttagaacacccaattttttgttaagaagagggaaaacggtacaaatttggaggaacgacaacacggtttgtttgtcattcagaaccttccaaagaagccaacagactgactaaccaggacattgtgacaacggcatcgaaatagcgacgaggttcgattgccatgaggcccgaggcccga

SEQ ID NO: 9317 - DNA, 1501 bp, Oryza sativa
ccatttattgtttaccttatgccattgataacttgggtatcaaaatgactagatgttggtttaggaaaatgcttagccatgcctagttcaactagtacacaaatggggatcatattattacatagactttgactattagcatagctttggattggtgccaccgcaatggtgttagttaattaaaatacactgaatggtgggctgtgtgtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgggttgtccggttgtccagctgccggattcaccacggcgcacgaggggactgcccactgccttttgaggggtgggggtgaaactttagcgtggtgtggatggttagaggagggttatgcgaagggtcttgtcacgatttccccctttgcagtatcatggtgatacttcggtgcatggcgacatgtgtggaatagtgtcttgtgggtacagttgtatacctctggctagagtaaaactattcgaatagctgtgcccgtggttatgggcaatcaaccaaattcactatgattagtctcatccctagtttagcttaatgaactggtgtagttcaggtggttagttgggcctgttgcaatgtggtgtagcgttggacagtgattcgttaatcttgcttaatctattgcaactgttttactgctttcaactactgtttttaaatgcctgctttattgtaaatgaaccttttagcctcctttggttatatcctgcatcatacctcatcttccggtatgacttgctgagtacagtgggtagtactcagtcttgctctcttttcccccacaccagagcggaagttcttcccagttggagctgtctcagaaaggttggtttcgtcgctgccgtcaaggatgtctgtggagtagagtcgctccgctacagaagtcaagtttccaagtttagctcgttttatcttttccgctgcatttgtaatcttttctatttttgtaagacgtggatctgtatgtcaacaattgtcgtttgtgtaccctctcactaacaagagcttagtaaccatgaagtacactggcagaggggttagagagcacattttgaagatgagtggcatcgcttcaaagctcaaaaagatggacttggttctccgtgatgagttccttgttcaccttaaaattgcctccttgccttcagtttttgaggtttttctgttgtgaactacaacacactgcccgaaaactgggactttgagaagctcattgccaagtggtgcaagaaggggcactatcagaaggattgccctgaattcctaaggcatctcctaaagatagggattctgtacgaggaggactcttcaaagagtagaaagacgcaatagtaatgtgaa

SEQ ID NO: 9318 - DNA, 1137 bp, Oryza sativa
tcctgcaccccgagtgcagccgaacaggcccatcccacatagtctaaaacacaagagtacatagggtattacgctcccgagcgacctaatctgtatacttggttgtgtttggtgttcatcgtacgaacgaagcttgatctcaactcgccccttagccgaatctcaaaggggagggggggggggagttcttacttccctgctagaggagattcactcttcgacaatagtgaacagtgaacattagaatgtgattcttgctacattggacatctggtgccttagtatttgtcttaaaaaattttcttctaaaatagcaaaagaaagctagatatatacatcattgagtactatcgtgtcaagatgtttcgtagtgcttcagctccaactctacctctcttgaagctagatcccagtcaaatagttttagctccacttaaaaatggcacggagtgatactctcacaaaataaactaaagaagcaaaactaggtttagatagctctataaatccagtacaaatctaattactatagttaaatttaaaacttagagccttaccaaacggactccaagaacataacttcgacagatttccccaaaacaaaagtgtttcaccaggatctagacaaaacaaaattaaccatacacacaaaatatgccctttttttttttttgcccaactctatcatacttgtactaaacttgggttattctgtagaacatgacttcactactaaaatgcatatgagagaatacttgattctccgttattccctcgagatagatgttttgttagttgttcgctgaccatctcgtcgctgttagaacttaaaaaaatcagctcaaaggtcttctttccgcccttccccctttctccgagcagcgaacggcggcgcacggcagccatggtggagcgcgaggatgttggtgggccgatttcactggcatgggccgagcgcgagcctgttcgtcgtcggccttgctcgctcgattggagcggccgcgaaacgaagggtagcagcagcagcgccgtgcgattcggaacggacggaccaaggagcgacgcccgacgtccctctgacgttgcgcttctgggtgggttcagttcggttctagggctccgataggaacgttgcca

SEQ ID NO: 9319 - DNA, 1501 bp, Oryza sativa
ttaattgaaattttaagacttcgattatcaatgactctaaactacaatctgaaaatatgaaaaatgatgttgtgttcttctttttaatatgcttttacaacaccataaattttctcaatctataaacttattttaataaaaaaaatatgaccaaaatcgtactgtaaaatactaaaaaaagactgaacgtcatttttttaccaagcggagtagaagtaacattcaatatatataaaaaaaaacagcactgcagggatctattatacctgtgataaattcattgttatatgtagcctaagcatgtagcgttgtgattagtttgttaccaaaataaataggtaatattcaaaaatcggtcaaaatagtccaataataatatttttgataatcctataaggaaattgctatgcatacaatcaaactatccaactcacttagtacaactgaatttgatcaacggttctaaaccgccgcaatgcatatgtgctcttctttgattggtatatggttgcatgttttttgttacacatgaattgtacaactgggccgtatatatagcaagcagtactcatcctagaaacttcctctcacaaaacattagcaatggcaacaaaccagacacactttaaatatctctacccctatcaaatactggcaacatctcttcccaacaaaatattgacaatttcaatagggttgatttgggcatcaaaccaaacagccttatcatttataacaaacaattttcaaacttttctatgtttcagaggatgatgatcaacagtttcaaggactgctaagacaaagctaaagttaatctatatgtgggcccccatgacaagcccatgaaggtattctgggccgaagaaggaaagcccagccgttcgagcgtgtttgtccccctcccaggcccgcacctccaaatttcaaacgggaagcaagccgtggtgagcaaaccgacgtgccgccgcgtacttaaccccgtctccgcccacctccacctcctccaccgcctcccccttccttcgcttcctcctcttctctcctcttcccgctccgcttccattccacgcccagccgcacgcacgcttctcgaaccttctggaattttcgccggctggagtactggaggtagggcgatccgatcgcaagtttcccgttgcggtgtggtcggaatcgattgttttctgcgattttgctctggttcgtttgattcgtcatgggttttttccccctcggtggctgatgctgttctgttcgaatattttggtggatcgaacttgggatttcccgtgattttttccgtgaaatcgggggcagtggtgcggtttcgagccccctaatcccgtaggattttttttttctgctagatttgctcgcgcatgatcagattctaatttccgagctatgcagtttttcgtgtgctcgcaatttcagtttcgcgtttctccagctttgggttcagttttatttttcaaaaatcatctcctacaagcctcga

SEQ ID NO: 9320 - DNA, 385 bp, Oryza sativa
tcatgctcagcaacaagttgcaactctgtctgtagccatcgcctgccatccgcactagtactactacagaactactactgtggccactaccgcagccttttgtttgcttcctccatctaggggacctcacctcgatctccttgggtttccaatgcttaaaagtacttttctgcttaattcgtcaaattacgcctcatctgaaacatgtagagatatttattccgatccatgttaagatgaactatatagtgctgtaggaattttcttagaagtaagatctaagatatatatagacgtccggctggttgttttgatggaaaggtcggtttaaagtggattcttcccttctaatttcgacaaggaaaattgcttttgtcccgtcagg

SEQ ID NO: 9321 - DNA, 355 bp, Oryza sativa
cagcagctggctaacaataggatggtcgccatctcgcacgcaaataaagagcgaatggtacacgagtactacgccggagtgctaggctccaccccttgaacttcaaggaagcacacactcagcttacccttctttagccctagccgacctgtcatgcacaacctcgaggtgtgcttcactgaggacaaagtccggaatgcaatcaaggacacccctaatgattgcgcgtcaaggacggatggcttcaccggcttgatctacaaatcttgttggtcggtcattaaagaaaatatccttgtagccctcaaccaactctttcatctggacggatcaagatttgacaaagtaaacaagg

SEQ ID NO: 9322 - DNA, 1501 bp, Oryza sativa
attcaatagtaagttaaaaaaaacttttcatcggaatatatccatgtatgaaattgttttaaagatttaattgcaacgaatttaatggtgcaattgaatcatgatttggaaaaataatttaagagaaacaacagtttaaaagtgtcagcgcccaatttttccacaggctcctcccgagtcatcctggcgatgacgatgacgggagcttgtagccttctttcatggagaaggctgccagcgatagggatggaggagaaggatagtgcttatagccttctttcatggcaggtattcaaaaaattatgaccaaagtacgaggaagacttgtcttttttataccattgttagaattgtagatagaatcggttttatgtttttgacggagagttttagttcccaaaagagtctcctatgctgtgctgcatagcacttaaggacgtgagaggagatcggcctttgtacgtgattcggcgggaaagaaataaaaaagagatcgtttttctaaatcaatgagtttttttatcatccttgaagcagtaacttgaggtaagtactcgaggtaccggttcaaatcaaacggtccaggagatgtaccggccggatgaaagaacaacagagagaaacaacagcagatatccacagctaccacaggttgccctcgtctcttcatcagttggttgcacgcattgctgcacctgcagcaccggtgacctgctcggagatctgttcgcgccgctgatctctccctcccctccctcgctttggtggactgcactgtgcgtccctgcacttctccccttcgacgacgtgtcacgccattcctcgccgctctcctcttgtgttggacgccatgcgggagtacgtgaacatgaaaaaattagaacgaaagaaaagacggctacttggctcacactacgccagattctcacacttctgacgggatacctgtgacgggcaaacgatttggtcactagtgaccgtcacctatgaagggtaataagggatgccgtcaacggtgaggcatccggccgtggcccatcacaggtatcccctcacctgtgacgggccgaaaggaaaatccgtcacaggtgagtcagtgacgagttttgcttccaacccgtcactggtatcccctcacatgtgatgggccgaggcattataagccgtcacaggtgatgggccgccacctgtgacgactttgtttcccggcccgtcacaagtgaagggataccagtgacgggcaactcaattgaagcctgtcaaaggtatgaccaatacatttgatgggcttttttttacctaacccgtttgaggtgtgttgggtctataaataccccccaaaccgccaactgctttccatcccgagtagttcactattcacaaatcggttggaagggcaaggggggcgaatttttgctaaaattcaaggtaaaaaacatattattcttcccttcattctcaatatatcgatcatcatatatttttcttcctatgttgttga

SEQ ID NO: 9323 - DNA, 1068 bp, Oryza sativa
tgagaatattgcactaaaaatttaaattttgtttggcgcgcagctgatggggcgtggctaggggtgggcagaaaaagaccgaaccgaaaagattgagaccaagaccaaaaaaatcgagattgagaaattcagtactaggcagtgaaagaccgaattttgttcggtcaattcggttattctcctcgggtaactggatagaccgaaaagaccgaattatcaaaaaatgtctaaatacaacctacaatccactatatttaataggattaaactctaatttttatatcctacttgttctaggcatgcaacctaataagagtctttattcataagggcttacgaatttttttaggattttctgttgaaaatttccattatttctttgcatatatgaaaatgtcgttgaatttcggtcaggaccgagaccgagaccgaaaaaacctagatcgaatttgtcggtcctgatatttttacgctgaaattcgatcttcacttttcaaagaccgaaaaagctgaaattcgatcttcacttttcaaagaccgaaaaaaccgaaagatcgaagaccgagaccgaaattttcagttagaccgaatgcccacccctaggcgtggcgctgtggtctttatctatgttttcaccatctagtgtaaactttacaaataacttattcccctgcttaatataaacaccagattaatttggcttgtcttgttttttaaaaaaagggcccaactttttttttttcacaaaatagccaagctgttgttaaaaacgtggctgcagatttgacatttcaggcgcacaagattcagcaaatccgttttctgaaacatgtgattcatatgtggtgcgaatattggcccgtcaattgcatctcctagctgtaaaatgtacttagaccattcccaaaccagatattagacataattttcataatctctacatcataaaaaaaaacttatactagatactactattacaatgcaaacaacactatttcatatttaaatttaatgctacttatctcacatgatgtcttggatattgtgtagaaaccgtgtttcatgcaa

SEQ ID NO: 9324 - DNA, 1501 bp, Oryza sativa
tgcaaaagaagacaccacgttggacatgaaagggaatcatacgatgactacaatttgttcttgaatcagactgaaaattccccaataaatatagtgaggcttccatgggattgcaatcaagcaaatcacaaagcaagggtgtcagacccaaaaaatcccaaatttataaattgttgtttaaatggaattattagaaatgattttaaaagcctagaagaaaagatctaattttaagtaataaattcctatataaaagtgggatagataaaattttattaagtacttctcttgattctatagttcctagatttttctaggatttatttgagccaagaaagtattttttaataaatggaattgcatttcatgaataatttaaaaaagaaaaaggtttaaaatctttcttttggctttgcgccgaaagtcggcccaaaaccttcccttctctctcccttccttccttcagcctgtgcgcgtgcggcccgagccagcccaccaagccgagccgcccctctctccccctctctcccactaacaggtggggcccacctgtcagggccgtcttccacctccagccgccagccgcgccctagccgcgtgcaagccgccgccgtcgggatcgccaagtcatcgccgtccccgtcccatcctccgtttccaccgaagaccaccggatcatcgccgtcgccgtcgtcccgaaggtctccgccgcctcgacctcgccgccgttgccatctattgccgtccgtcgtcatctgagccttcggtgagttcgccgcgttgcgctctacccgctggtgcccttcgtttgcgctgtcgcgccgtcgttcgccggcgagcatggtgtgccgagccgccgccggcgatgatgtcatcatcgacgtcagcgccacgtcagccctagaccggtggtagatcggtcagatctattaggaggaattatccaacgcctacaaaatcatgtatgtcactgtagcttgtcatttcttttcggtttttgcatgagcgagcctgcttgttcacggcgtgagcgtcgtgtgtgagttcttggccacgattggatggagtactggcgcgcatggcggaggccactacggcacctcccggtctttgcgttttttttttctgtttttcagtttgcatgtaatttgctttatattacacaagtaaaccccgaaaatgttgcaacgtttctacgcagcaccaaaaacttttcctgtgtcgaacacttggtgattttactgtttatcatcttctacctccagccacgagtgagtttagagtgagaattgagggttgccgccaacatttggtatcagagccatgtcggctcttgtgggtggtcagtcctgcacgccacaccggcgtgggcgacagcattcgccgtcccctcctcgcactcgcggccagcagcttgtcgtgcagcgggtagtcaaggaagggggctctgtcacctaccccacgcttactcgttccaattactctgattgggcggtgttga

SEQ ID NO: 9325 - DNA, 1501 bp, Oryza sativa
gagagaaacgagcacgcgttcctcgttcaggtgcacctcgccattggtcagctcgggttcatcgacgggagcaagcttgcagacctgagccatcagcaacgtgggctcctcatcaccaccagcctgctgtggttctgcaacaaggagattacctgggccagcttttcgcgatcccgctttgccttgcggcaatctttggcccagtggcctagcttgccgtagtagcgacactagtctttggagacgttgcggcttcccagttgtgatggcgtggacttggtgtcgccaccattgccgtcgtgcccttgctggcgtgatcccgcgttggcgcccccgattactagtgtcacgagacaactgcccggtctgcttggtgttgcgagcaggtgtctccgtttccccgagcagagcctggcccgcgtcttccccgtcggaatccggatggtcgtcgatggtgaggagccggccagtcaggtcctcgatggataaaatcgtgagatcaatcaatgtttcaattgacaaggccatctgacgatacctgcggggaacaacacaaagtaacttgcgaacgattttctcctcggtgatgtcatcaccaagaagacggaggtcgctgacaaccccctgaagccgaagtgaagtcctcgactgattcgccgggcttgcatcgcatggactcccacgcttggcgtagcttctgcgcatgggattctttcatgcgatccgcgcccactcgcatggacttgagcgcatcccaggtgtccttggcgcatctcagccggcacagctcgcaggatggccgaaagaacctgacgatcttcatgaaagggcacgtcgccggtgtcgacagcttcccacagaccctgagcctgcaggttcactcgcatcaacaccgcccaatcagagtaattggaacgagtaagcgtggggtaggtgacagagcccccttccttgactacccgctgcacgacaagctgctggccgcgagtgcgaggaggggacggcgaatgctgtcgcccacgccggtgtggcgtgcaggactgaccacccacaagagccgacatggctctgataccaaatgttggcggcaaccctcaattctcactctaaactcactcgtggctggaggtagaagatgataaacagtaaaatcaccaagtgttcgacacaggaaaagtttttggtgctgcgtagaaacgttgcaacattttcggggtttacttgtgtaatataaagcaaattacatgcaaactgaaaaacagaaaaaaaaaacgcaaagaccgggaggtgccgtagtggcctccgccatgcgcgccagtactccatccaatcgtggccaagaactcacacacgacgctcacgccgtgaacaagcaggctcgctcatgcaaaaaccgaaaagaaatgacaagctacagtgacatacatgattttgtaggcgttggataattcctcctaatagatctgaccgatctaccaccggtctagggctgacgtggcgc

SEQ ID NO: 9326 - DNA, 1501 bp, Oryza sativa
gtggcatgatcccaatttctataaattcgagtgacatgtagccgatatcatgaatagtactgtcatttatctaaaataacatatttctagtggcattgatccaattaaccctaatttctagcaacgaaggcaatataatggctcttttctgacacatgatcttaataatatactaggctggctatatgtttcaagttttgctacacgtaagtactggtaaaaacaagtcattttaacaaatttgatattcctttttattttatatcttttacaagagattcagggtgtggagatgaaaggcaaaaggcagtttaattctaagaaggttctttttcagcgaacgggtcggcagctccgccgcggttttctgattggatgaacctgatatatagtccattccaagtcaaataaatctctgcaattaaattctgaaaaaaggttgaaagggagggccagatggaaccagcagaagagaaggctttcatcatgggataaaagttacatttataatgccttctgtgtgcatgcactggaccatttaatgcgcacagctgcaaaaccaccaaccatccggtcctgtctgtgtgtgacactgatcgatttactttaattttatgaatggaacttaattttgttatatttgaccaaaggttaccatcgacaattgtagtatattctagtatgtatactatacataagtagaaatcttactaattaattaattgatttggacattatgagtagtatgttttaagaaaaatccctggggtagctatgatcatccgtggacaatcatttacccgaaagtaggatttggttggccattgaatttatagtaccgattgttacaattgtgtctcactcaggtataggcatggtggaaaaaaaaaactcgtagcttgtggttccggttttccggttcaaccgttgggtaggtccggttttttttactacggtataggggtggaaaagaaactcaaagcttgtgattgattcgtagcgagtttggttcggattgactcgaactgtaatcttaataaatcgagccaagctaaacgtttagcttgtgactttaatgagctgactcatgaactgctctttagctcgttagtacaagagataacatattttcatatacttagtgcttctttagtcctttagttacagccaaactattttttatctagtgaattcttcattatttagtgtttattattatgtttacatataaaaaatagtaaattataaattataaatgttatagttcgcatcaaatatgtctacaaagttagttccagtttagaacttggagttgtactaggtgttaggaatagaggaagagttggactctatcataagatctctcttaaatagaggagccaacctattgaaaccatatggtgacttaggctgtgttcttttggaggggttgggaacccctcccctccacacgcaaaatggagcgatagattaacgcatggttaattaagtattaactata

SEQ ID NO: 9327 - DNA, 1501 bp, Oryza sativa
cccgacctcataagaagaaaacagggaaatatcagcacacacatgaatattagcaccagtataaacccaccaatcaggtgaatgaaaaacagagagaactgtaggtaaaaatttaccgtaccacgatattcgtccgccctcgctaatgaccatgttggcagacttctggtccttgcgctcaggacaatccttggctcaatgcccaggcttaccacacacaaagcaatctccctttgcctttcccttgcctttcttcttaaaattggttgtagccttgggtttgacatcagacttgactttcttgttgttgtgagaagcgtgagggttcttcttctgcaccaaattggcagtagaacctccctcgatatttttgccccagttgtcctttgccctcgccttctcctcaacacccaaagagctaacgagatcggtaacactgaactcttgtctcttgtgttttagagaagtggcaaagtccgaccaagaaggtggcaatttggcaataatgccacccgccacaaacttgtctggcaactcacagttgttgttctcaagttcctttgccagcatctgaatctcatgagcctattccactacagaacggtcatcgaccatcttgtagtcatagaactgctccatgacatacagctcgctgccggtgtcggaaacttcgaacttggcctcaagcgcatcccacatgtccttccttgaaggcatgtgcatgtacacgtccactatattgtcagcgagtacactgatcaatgctctacggaacagacaatccgaagcctcgaacttagcctcctcctcaggagagagaggtggttcacttcgtttgccccgtgaaacatagaagcattgcatcgctgtcaaacacagtagtgcatgtgctttccatctcttataattagaaccatcaaaagcatgtggtttcagtgttgtagcaaagccaactaccgaaaatgaccaattaggtttttggtttattggaaatttggtcataattcggcatattttaatccaaaataacaagataattaccatgatatttacaatgggatttgatccagtgatagtggtgaatgtaatcaacatgagcatgcttaacgtagaagaagcatcaacaatcacataataacgcaatgttgacactgcgatgaacattagtagtaaaacttctaattgaaataatgtaagaaggttataccccaagaatggtcctccgctggagtttgaggaagtattgcctctattgttgttgacaggaacctccttctacttgtctccagtgttgccgttgtctccagtgttcgacatattggtgaagacgaagtagacgttgacgaatagtgagtagtcgcgcattgcgctccccaaaaacctaatcgcccgcctgtccgtgcaaacgtcacagcagtacgtggtttcggaggcctactctcccaacgcgtgagcacacactcgtcgggatgggattaccgtagcagcaacagccttggaa

SEQ ID NO: 9328 - DNA, 1501 bp, Oryza sativa
taagcgtactccaactgattagttgttgtaaataagtttagaaaataaatacattcttcaaattagtaaaagtgtctcatatggctatgaacaattggtgttgaaaacaaactaggcgctaaactatacatattgtcaaaatataaagaataatatggtgctctggatattatcatggtagtatgactctagctataattttttttaatatcatagagtgattaacctcgctcattttcaaaagagaatactctatctatatctaaaaatttgagtagtaatgatcaacaccataaacaaattgtgtctactctataccacaaatctacttaaaacatttagaaaaactactttgatcacctccaccttctctttgtccttcactaaagggtaccaaacatgaaaaatagtgtttactacggtgtcataagtatagcatgaaacatatggctaaatgaaggtggccccaatggaggccaccatcgctaatagtcctcaacttcatacttaccgatgtaatactccataatcgtgcgataacaaattaggcattaaaattatgctgcaagctggtcttaaggagcatggctacatgtttcaaggcaatagagaaagaaagtcttgaggctatgatgggcttcacccatattagagtagcatttctatttaactttaatggtgctatcccattaatggatagaagcggtagtatttttacaatgtctatattctatagtaagacatgaagcttaagtagtggatattttagtgtattaatgatacattagttttatattattggtacatatgcagttcacttagcttttaaagcataataagtaatggtgacaataggagaatttatatgttactcggtcaaaatgttttttttagtttgagagatattcttcttgtttaataacatttaaatggaaatggcgggatgtaacttcttttagcattgtttatataaaacatttaataagaagcccacgtatctggcacgggctttcttcctagtcggagattaaagctctttttaacatattcatttccatgtggctgttcaattttgtggaagtactcgttcacaaatcaaagttacaaaaatgtatttatatttagaaagcctggactacgcagattcaggaccctgacatcttttaatctcaaggagaaaggggacgagaaactgttcaatgttgcacgtacactgtataccatcgatgcagtgtactccctccgtcaaaaaaaaaaaagaaggcaaaccctggtttccgtgttcaatgtttgaccatccgtcttatttaaaaaaattataaaaaaattaaaaagacaagtcacgcataaaatattaatcatgttttatcatctaacaacaatgaaaatacgaattataaaaaaatttcatataagacggaaagagttggacatagaaacccagtgtttgctttttttttttttttggaacggaggggagggagtatgtgtgctagctgct

SEQ ID NO: 9329 - DNA, 1501 bp, Oryza sativa
tgccgctgacgtgtggggcccgccccctttgtggacgtggtccgcgcctcaccccttgctgacgtcagcgaggtccatttcctttgtaaaaataaataataattgcgcaataaatcgagtttaattctagaagttcatttaaatggctcaaaacttctaaaattcatatctaattcattcgaactccgaattgagccattcaacttgcaaaattcatctaaaattgagctctacaggtttgtttactttttatatactgtttccttggtttttattagagtttttcgtcgttttgcgtgccagcgtgtagttcccgtcgtttcggaagatcgcgttcgcaaggataagagttcagaagatccaagtgaagaagcaaggcaagtcacacattccccttgagcatgttgatcccaatttataaatgttttaccgtttacaaagaaatatgcatgttttgctaattacatgggatccgggtattacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattacagtattagaccttttctagtatcttgttgagctgcgtgctcgagacatctggccatgcttcatggtcgtaattatccaactaaaacgcgactgaatggtgggctgtgggtgcatggttttgttggtcgcacccatggcagttaaggaccggttcgcgggatgccctggaagaacttatcgtacttaccacaagccagcgtgggcaacgactgggcttgtaacgtagctttcctctagccgacgcaatcaggcaagggtgggcgtgatggagtttggatgggccctgcgaaggcctatgcggcttccggattcacctaggcatgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtcccatcttaataaatcgacccaatacactgtagttcaggtgggttggttgggcctgttcaacgtggtgtagcgttgatcagtggagattaaatgttactttaattactcaacagttttactgttttgctcaataaaatgttttacaaccgcctttatgcaaatagccacaaacccctccttgtatccccttgcatgtctgcatcgttggtgtggcttgctgagtacggtggttgtactcagtcttgctattattcccccttttcagaagtgtagtgcttctgagctgaagat

SEQ ID NO: 9330 - DNA, 497 bp, Oryza sativa
attcctgcagcccacgcccttctcgtccccatgggcactagttgttgggcggggcgtggccacagagcacgatgaggccgaggacgaagggtgcggagaggcggtggccacggtatagcagcgtgatttcccggaaccactgcatgttgtccacgtcacgcttggggtaggtgacgtcatgagggcgaggtcatcgtcatcgttgccgatgcagaggacaacctcccttctggtcgacggcgccggatccgtagtcgcacatcgacacacaatgatttcacatcacaagaacgcatctcacatcaacaaatgaactctcacatcacaagaacacatctcacagcaacaaatgaactcaaaaacgcatctcacaaatcacaaagaatcacaaataacaaagagagaaggagagggagagatagattcgccggtcgccgacgccgttgccccacctccacgccggccactgacgcatgctgccgctctgccaggccccc

SEQ ID NO: 9331 - DNA, 542 bp, Oryza sativa
ctaacgggtggactatatatatataggtagtcctgttgtcctgatgtttacataatgacgtgggatggtcaagattgttaatagttagacaaccttgaacaagtatctgtatgaatcagaggttatgtaagaagctagatccgtatccgtattaataatagtcgttcaatcttggcgttccatggacgtatacgcgtggaaataacgtgtgtccataacagtcggggattgattgtttccaagaactaccagacaagttttactctcccgtttggccgtttctccaatcattttgcagtccatttttggttaatttggtcgacataaacagctctatacacgagtcattaatctagctgggaaaagagttctatagttcggccatttcattgtaaagaaacgtgagtcataaaatgtgtatcatatataatcccttaaaatatctcggtggtaagaatcataatcccttctgcccctccgctttctctctcccccaatcagcggtgacatccctctccccctccccttcctatctcgatagc

SEQ ID NO: 9332 - DNA, 1331 bp, Oryza sativa
gatgatctttagtcccggttggtcatacaaaccgggaataaagatcatctagtcctgttgttcttataaaccgggactaaaaatcgtttttagtcccggttttaaatggaactgggactattgtagatttgggtcgaccgatcaaagatggtttctccaccagtgtggggatgctgacatcaaaattttccacgccaaattaaacaagagagacaaagtcccaagtcagtttcattgctggatcaatgtttgagaaactatatgacaaaaagccattgacaaatcctcaattctatgttttctccatcaacgaaactgaattctactatgccaccgtataagtgccttttaatttcttctctctcgagagtactttgagcactgtgaataaaattccaaacagctaatggatattaactaatggaaatgggaaaagggggaagtaggtggaatattgtagaactcgtatctgtagatggaaaatcggaaaattgacctcttgtcgatggcatatatattgtagaatattatttctcgatgggtttctataaaatgttcgcaaattttatgaaagatgctgtactattagtcacagctgtagagtcgtcattactagactcagcttccctgtgagccgtggtattttctgttggtcctgtaagcaacctacggaaaaatgtattttttgtgacgggtggacttaaactcatagatttttttttaatttggaactctgccatcttttaaagttggcaaatattttgctactttcaaaaaggaaacaatatatccatcccaggggatatatagactcaaagagcctagtgccttcaatcatcaagaatatgggggtgtttcatgagaatttcatttttcgtgaaaattctgcaaaaactaagaaagatcgagctggcactttttcatgaggctggacacttataattaaaacttacgattcagtggaattggctgtaacttcaggcaaagatggtacaactggatatttttatttctgtcgtaattaatctcagttctggctcattgcgagatatcagttttcaatcatggaatagctaggcatacagcaaagagatcccttgtcaccgatccattatgtattgccaaacagaaataatctccagcgcctcaccataacggctgagcaattaatctgaactcctaatacatatatactatatgtaaaaagaacaagtggcatttgacagaaaaacacctcacaaatcatacaaattctagaccgttggatcgctttaagattcgtgcaggcagttctaaccctaaacccctatctctcccctcgtcattccagg

SEQ ID NO: 9333 - DNA, 277 bp, Oryza sativa
acccaacatcgtgttgacccgagtaattcccctgtaacacaccgccccgcccgattggtggtgcggaaaagccccgtacttttgcgaaaacgacgtccgtttcgacccaaacccgtcgcgtgcgcgcggctctttgttctctcggtgatttccgtgcggaagtcgcggttagttcgttgtaggtgacgacggggttttcgcgcaagaccgccgagacgaagtaggagatgggccacgggaatatttgggctgtgcgctcgcgagcgcggccgaaaga

SEQ ID NO: 9334 - DNA, 1501 bp, Oryza sativa
agcagaattgagacgatcaataataacagaacgacgatccttaaacaacttataaaaatctctggtagtagtttgtctagagacaggaacaaatctagggttatgagcagccttaatatagttcacaaaagcaggagattgaccaaaactgattggaagatcctctctagcaatcaatctacacaattcaaacctagcaacttcaggactatattcccatggaataacagaaccatctgcactaaatctaagcatggactgaggcaaagcattagacccaagctttctaggtttgcatgacttaatatgcctaagcaaatgtccagtgccagcagaagaacgagcactcaaagttttatgacagtaattgcatttagcaaagactcgaaccctattaccattggtcgtttcataaagttcctcaaagtcatcccataccttggaggttttggtcttcttgttggtacaagtcgcactagagccagtcggcgtcccattgcctttgtcgtcaaccggcgggtcgtcgtcatcgacattcacatggatcgggatgtcggaggtattgccgaatacctccacacgatcctcctcaacatcatcatcgtcatcaccgcgcatccccatagtcctcaactcgtagttgacagaggtaggatcgtcgtccatcgcaggcactctggtccctcaacggcggctgccgctaagcaacaggcttgcgacctgcaagcagccaacaacactcaaggttagggtcggaaatggagaaaaaaaaaagaaaaacaatggttccatgcttgtaccttcgcagccggagcaccggagttgccgttgaagacgataggctcacggatctacgagaagaccaagggatctggcgaagaagaacaaaagggaaagagacgaagaggaaggctggatctgaaagagtggaaggacgatgactcaggcgaccatgcgtggccggtggcccccatcctcatgcgcccctcatgcaagtcaggcgaggaatcgatcggagacgaagaggaaggctggatctggaagagtggaagggaggcgactcggtgagtctcaccggtgcgcgcctgaggccttgagcgagtgagcggcggacggtggaggaggagatctggtgggcggtggagcgtcggaggcggatcggcggaggcggttgagcggtggcggctagggttagggttaggcggagaggcggagagcgagaggcgagaggggactggggaggggaggggcggcgctcgctggcttatatatgcgggcgcacgcggcgcggcctggctgtctgttgggctgggccgtgctcgtgcctaccgttggtacgggccgtggtcgtgccgaccgttgggccgtgccgtgccgggccggcccatcgtgccgacctcggtccatgccgtgccgggccggcccaccgtgcccagccataggcccaggcacggcccaatagtcgtgccgggtcggcacgggcccgactgctaccgggccg

SEQ ID NO: 9335 - DNA, 1501 bp, Oryza sativa
aaaattcaagaagcgtgcacttgagaaaaaagataaattttccatctttcaggctcagccgcccaaaacgggatgactcatgatcaaatatttaattaagtattagttattataaactttaaaaataggttcattcgaatttttaaagaaacttatatatttatttttaaaaaaaatacaccgtttaacgattaggaaaacatactaatcgaaaacgagctttatagccaaaccgtttaacattttagaacaagaaagttaaacgttagtagtatgcattccaacccaaaccgaaccacagaccacatacgatgctctgttcttctctttccggaatattaggtgattctccgcgctttattgcgaaaattactaacttttaataattttttaacaatcgagttaaaagtaaaaaaaatattagttatcaataacaaataaaactgatttgtcaaactatgttaagagagaaataaatttagtagactctatgagattgtagatgaaatatgatatcccactttgattatatggatgaatatatgttaacaagtattataaaaatgatggatatatatatatatatatgtttaaaatatcgtgaaaaataatgtgaaggaagattattggacgttgatttgtataattcaataaattatagatgatgttgcatgcttacataagttttgtatgtaattattgctagtggatgatgatgtatcatatctgtatgttgagttttagaataagtgggttaactttaccgtattccctccgtttcaagttataagacgttttgattttagtcaaagtcaaactattctaagtttgactaattatgtagaaaaaaacagtaatatttacaacaccaatataattttattaaatctataattaaataaatttttataatatatttgtcttaggttaaaaatatttctatttttttctataaaattagttaaatttaaagtaatttgactttgaaagtcaaaacttgtaacctgaaacggacagagagaataggataggatagccatcggctgcggcgaggtaacttggtaaacggaaattaaaagcggccaacatcacggccacgaggtcgccccgttcttccatgttccaaaaatccaaaccacgtcgcgctcgtgcctagcctccagtctccctttcatggaagcttctctcggccatgcatgcgccaaaaactcaagctggttgttctgacctccaactttaccatggtttataaataccgatggccacctcgttctattatctcccaaacaagccagctcaatcaatcatcgagctagctgagctagctaagtgccatattgcacgtactcgttgtctgtccgatcatccttttttttttcttgtgggggtctgtccgatcatccttgcgtggctaggcaggtagagtagctacctgctcggctgctcgcgttccagccagggtccgggcttcggatatcctcggagtccgacaccaaatcaa

SEQ ID NO: 9336 - DNA, 1501 bp, Oryza sativa
  unsure (1)..(1501): unsure at all n locations
gatattcttatcatcttgatcgataattctcaagattaaggcgattggttactttatacatgaacaccataaatctttgagcgattggctactacagtgattagggtcattttgttatttatgttttttcctggctagattgataggtggttatccatttcactgacatagctctgttccatccaaaaagccaaaaaaagaagaaaaaagttcagttcctactaaatgacgattatacccctccacacattctaaaccatgttctactcccgctaattagggtggtagtatatatagatataaatcgttcgatcaaataagattaacggtttaaattgttttctaccaacagtggagagcaccataatctttaggcgaatccatattatccggaaaacacaccaacacatgtggtccataatttcaccatacagaagatcatccaaacataaattactagtcacatatataaatacaacttatgccctcgatggcaacaatttacaacaataatgtcaaatagccatgcaacaaataacaggccgaaacaaagatacagaaacatgcacacacacgataaagcaattagcacgcatcctcacaccatacggcggagacctttgccacacacgtacgtacataaattaaactagatccctaaaaccaggacatggagcacaagtattgttgggaataaacgtaaatatctgaagatacagaggcacaacccaagacataccccggtccaagtctccaagacttgggccaaatcttgctccaccccatggatgcaaaggataggtgtacagtcataacaacactgctatggtcttgtagagttgcacttgcacgttaggcatcctcatcaccaaacagaaatccaagcgacgatggccctccaggcgcacaacggactctcgtggacggccggtccttcaaaaaaaaagtggggcaaactcaatacaaatagctcaggttatgcttatgcataccataatccatttctagagtctacaagcaagaggtatatatactctctgatatatactcaccgtgataagaaggccagagttattgcctacttggttagtatggtagatgtgttgggaaaaaagggccccaaagggaatttccgggnggcttaaaaggaaataaccttaatttgggggggtttggngaaaggttccttttccttttttcctttncaaggaggggaggccaaagccagccttggtgttcttgatctgcttcgtcgctggccatcttgtccccaagaacaatattgccttttggggccttgttggttccttgaacggatttagtcgagtgatccggaatgatatcctccggctccggctcgaagaggtagcccagagagctccggccaccgccactgctctctcctctacaggctctactcatcttcttcctctcggcgctctctatctgcgtttgttgatctgagcgagtgtgatctgtagcaatgacttgatgtactggt

SEQ ID NO: 9337 - DNA, 1501 bp, Oryza sativa
cgggggaggcgacagcgtgttcctgcccttcgccgcacaacgcccacaggcgccgtaactgtacacggtatggacatggcacgctcgatccttgtaatttgtactctactaccgtgtggcgttggactgttctcgctgtcaggtgtcaggcccgaccgcccaactttgagaggacctactccccactcgtagtatttgtaccgtttcataaggctatttacaatgctcataggtgacgttcagcctcaaccatctacgtcgaaaattcggcgcatgtacatatctgccattcccaactgaagatcacggagcctaaacgaagcaacccgttcttcgtcagaactggcaagcgtggggcaagacgcggggcgcattgagagggggcatggccctgtgcaacgccaccatactcgtgcaacggtcacggcggcagcacagggagaagaaggaaagatggcaactgcggtggcctagggcggagaagggaagatgccggcggcggaggaagagaaggcggcggatctagcacctaacctcatcgtcgtcaccgttccgccccgcctctgaacgcaatagtgacagatcgacggagagggccgccccgaaccctgcaagcgcaccgccgagctccccccgcgccatccgccaatcgaaggaggaggagaggtggagccccgccgccgccgtcgccgcttggactgcacctctgccgctcgggccgccaatcagaggaggagaaggagaggcggcgccgcgcttgggccgcgccgccgccgagctccgttgcgccgttcgtcgcgggcgtgccacggagctccccccgcgccatccaccagtcaaagcaggaggagaggtggagccctgccggcgctgttgccgcttggattgtgccggtgccactcaggccgccgattgaagaaggaggagaggtggcgccgctcttgggccacgccgccaccgcttgggccgtgcctccgccgctctgctcggctccgtcggcaggagacacttggtgccgccactcgctttctctccgctaggcaaaattgctgagagaggagagagatggagaggaaaaatgaaggagagatagagacgggacccaccgaaaataatctgcattgtggagcatgtgacatatatagttcttaatccacgtgacttgtgaggttcggtaaaaattggtggcacattgctattgccctaagaaatatttgcccttgcagccgttggatccaaatcgaccggcaaccagggccccatcgccttctcgctgacatgaacgtctgtgagccaacgagaaatcacagtcgaatttccccgcttcgtcgtccccagatgcacacgcgttccacggtaagccaccgggcgactcgacgactcgacgtctctttaagtagtagtactacgaccgagccgcggggtctctcgattacactcccccgtcacactctcccgctccatccctgtccacgaaagcgcgcgcgggtaagatacgagg

SEQ ID NO: 9338 - DNA, 1501 bp, Oryza sativa
gtttttttttgtatttaatcctagaagaaattgtgagcgtgttgaaaattaaacacgggacctcagagttagaaaccacataccccttaccatttcactatcaagtgaatctcagtactaatataaatcacagaagggttttgtctcaggtggctcctacctaagtgatcatctggttgtgcatctcaccattcacatgtctctagctttgcatagaaaagggtttgattttttggggatccacaataattggttgcctagagacattctaccaaacaatgcatacatacccctatatcctccttccacctcagttagtgggagggacatggagatcatcacaaatattataatcaaaattgcaccattaattagtgtgtgagtgctactaaaagactactactacctaagtgtgtacagatgtgggctcaggaattatgaggattatgaccagcattagggagacatatataatcaactacatatgtaccttgatagggtataattcatgaggtatagctgaaattttatacatttgtttgtacatgcacatcatggacaagtatgtgtacttaatgaggattgaatattatgatatagactgaaaatgaagccatatctacatattgtacaaagaaaaatcagcaacatcaactcgcccacatataactacataataaatcaaagattctagacaaatataaatacataagatggatgggaagcaacaattattgagctgcatgaaaattaagccaaacattattcaaatctatccgtggaagttgaccgtttgatatgactttttgaaacaagctagggaatttcatgcatgactagggatcaaactcatcatatgtaaaaaagaaaggacgagagaaaacaagtaaactatagtaaacgtcccatgtctaaaaaggataagcattattttttctcatggtctactgaccataagtccatgatatggtaacaaaattcaatcgattaccaggaatttgttgttatccgtctctttaaacatgtgttgagcttggagcacattcataggtgtgtgtgctgtgtatatgtatgcacttgtggagattatgggtaccccatacccacacggcatagttatccgactagttataggggataacttatatatatggaatatgtaacagattatgacttgggtattacgtttccttgtatattacggaacggcctaaagtcctggtttgataagattgtaaagtagatctaggaaaccgatactgtattggataaggtttctatcttgtaatcctgccccccatcctatataaggtgggcaggaggccctctagaaggcatgagacaactagatcgtcagatctataattcacccggcggattcaaatccccaaacaggagtagggtattacctctcattgagagggcctgaacctgtctaaatcctttgtctccgcatccatccacttttaggtctcgtgtgctacccccttttattattgcc

SEQ ID NO: 9339 - DNA, 1501 bp, Oryza sativa
tgacttcatgatcaggttgttgcctttgcctgtgaaaagtaatcagtataaatcttttctcttttttttccttcagaattttatttatttttggctttttacaacttaatttgtaattaattaccacacagaagtacagaacatacacacccttttatatacacgtacctagcctagctatcttctgcaacaaacaaatgttagtatttcttacaaaaattaattaacaccagatggtccagactaattaattaaagtaccccctcctctcaaaattttaaaactaagcctttttagataattaaaaattaagcctagttaatcaactgatcattatacctcctcctacagctaatggatgacattgtaatttagcgcacgtacatacatacatacattatccaacatgattaattagtgggggaaaagttgattgattagtgcccaaaaagcagcgggttacacggcgaagctctgctaatacgacagaatccggtgttaaacccttgcacgatcaatggcctgtctttggactagcttacatgccagaaagctcttgtctgctaatgcaggcaactgtccgggtccggaagttaatgactatacttaattaaccaaaccatataattatccataattaattaaactcagatctatatgattaatactatatcgaaccatgcgcatatgtcgccctaaaaatctagctagggtgccgtcttttcacttattcttatacttatcagccaaactttaaattttcaatcttaaatttggagctgattttgaggtttttttcattgaagtttagtttttagcctttgcttttagatcgctatgtaaaagttttactcacaaattacttttcgtttgtaaatatgacgtttgtcttatttcgtgaataagcgaaacgatgggtccgctagaatgtatgcagttgaagtagctcggaacaataaataattacttaacataaaaacattaggactaattaatttcacatagaaaaaaattaatatgttggtagattattcgtatgtaggtagctaatatatgttaggatgtgatatagaaataaataatatgttagtgtgtacgcgtcaaccaaccacaagcacatctgtctatatagtatatgcagccaataatgaatgaattagcagatgtggttagcagtagctaacacaactacttttcgtgcgagaggtgttgtcgcacactaatgggaatgaataggactggatatatagagtatggtatgatggttaattggtcgatcaattaattatgacgcatcagtgtgatagctatatatatgtagctagggtaaatacaaatatatgttactgatcccaaccttgctaattaatttaattatcagagacccaacacttcaattaattacgtgtacgtacgatatataaggccagcccagctagcaacttagagctcatcgcttgctcatattccccactaataaaccgttttcatttattgaaga

SEQ ID NO: 9340 - DNA, 661 bp, Oryza sativa
tgatatccctctctctctctcacacacatctctttttgcaagatctcttcttgttcatcatcttcttctttttttctcccccttttgcttcaccaatccatcttttgtcacgagatgtggccgagctgaagctagtagtagtggagcagcgaaagcaagtacgccaagaaaaaaaaaaggaagaagaaagaagaaagaaagaaagaaaaaaacgccagcttgagggcagagggcaaaagcggcgacgaggagcagtggccaaagctcagattcttcccgtgggctatttttaccacccgcatcccctctctttgagccccttggccgattcattcaccgacgcaaagatccaacccctcttcaggtgtcggcagatgccgcctttgtgaggtttccagtggggggatttctcgtcgtttcttgcgtgcggttgcgttcttgatccagtgagcgcacggatatatccgccctggtttagtagagagagagagagagagagagagagagagagagagaggttcttgattgagttccaagtgttggattgggttcttggagctgttggattgggtttttttgggagagagatgggggtttggaggtgtgtgggttgaccgaattggatcaagattattgcgggaggggggggggggggttgcaa

SEQ ID NO: 9341 - DNA, 1501 bp, Oryza sativa
tcacctagtgtattcacaatgttttactatgtataaatttaatgttacagtgaattgaaacaatcttttgcaataaatcacccacatattatggaaacccttttttaagggaattcgtttcattttttgttccaccaaaatgtttctcctagtatacttttaatgtttcactttgtatggatcaaactttgtatggatcaaatgttgcagtgacttgaaacattttttcgctatttactgaaacattacttttatataaggtgaaataacgcctaatttaaacgattgaaacattttttatctacctagtgaaacaatttcgatatactcggtggaacagcgtgcaacatttaaaaataattcaataataagctgatttgttttctatcggaatatatccatgcgtggtcttgtttttaagatttaattgcaacgaatttaatggtgtaatcggatcatgatttggataaataatttaagatatgaaatagtttaaaatggttttgcatacgtgcatgcttgatgacgtcatgctgacgtgggagtccgatttttcacccaaaaatccggcgtccgattcctactagcctccctattcttcatacgcaaatctatatcttctatgggagtacctatacatctttcgaaagatttttatgatcgtatcacacagatttttaatctttggattaaaatccgatagatataataaaaagcaaaaagcaattaagaaacaccataatggacactaaattaccatatcctcaagaaaaagaccaaatccaatacaaaatttaaaatttacatgcgaagattcaaaaattacagtgtaacttacaaaagttacagtgtaagtttcattaattacactgtaacttacaagaaaatgcactgtaaatttgagtgagaaaatcgagtgagagataagaaaaaatctttcgagtgagatatagcaaaatcgatcttctatataggtattaaaatttatgctctttgctgaagtactcactttgcagttggccccggcccattttgcttcaaatggaggcctatctgtactgcattgggccggcccatttcgttccaaattgaggcccatctatattgcacatggcggccactcctcactggccgccgccatgctcgcctccgccgccgccgccgttggcgtcgccgcgttgctcccggggcggctcaagcccaagccgacgccccgccttctcaagcgcctcgccaccgcctcgtcctccgcgtcgacgccgccgagcccccggagcggcggcgcgggggtggaggcggaggcggacaccacgccgctcttcctccgcccggcggcgcacccggtcgcggcggcctccctcgccgcgttccggcgccgcgcggcggagctcgtgccggactccgcgccgcacctccaccgccacctccgctggctcctcgccgacgccgccgcccgcgacgcgggcgccgacccggcgctcctccgcgcgccgctcggcga

SEQ ID NO: 9342 - DNA, 302 bp, Oryza sativa
cccaatccaatctccgccacgcctctccacctagcatcatccgtggcatcggccccaaaccgacaaggcttgttggatcatgttacttcccttttcattctcctgtgatctttaccgatcctctacattgtcccatccgctgtatcaattccgtctttggtaacttgcccctgctatcagctccgcccttgctaactaccttctctaccggtatgttcttactatgcttcccgcatactcctctctccactccctcacctatccttgaattttaattcggacttcaccaagctcatcaatga

SEQ ID NO: 9343 - DNA, 691 bp, Oryza sativa
ccgccttaccgcggggggggggggagggggtggcggtaatcgcgccataaaaggtaaggggaaccctgcgcgagatgccatcacggtagggaaaaaaatcaaaactcggcacgttctggttccatgaatgtaaattgctaaaataacacttttttttacagcgccggggcagtgaaacgtccagttttttggacggaggaatcccttctttctgtatagttggtatagttggtatccactagctataaaactgctttgagaattagccacatcaccccaattagctgaaaccgttagatcttaaatcaacgtttcaagagtgcacatggcactaccatctgtgccaatcaggcccaaataaacaggtttccgtcgtcggcccgttactaaatccagtcgcatcatgaaagccacttaaaagaggaattgcgcacaaaaaaacgtcatcactaatcactaatgtgaagatcagaggtcatccttaattccacttattgatctccaatctccacctaattaagcctctcccaattcatcattatcgtccacctcgacaggcacagtacgtagtatataccaatctattaagtttgcaataaaataattttagccgccctttactaattgctaattttgattttatttgaaataaattctatcaaagctgtttctatttattcccttctctaga

SEQ ID NO: 9344 - DNA, 816 bp, Oryza sativa
tgagctacgtagcagcagtaacccattaattttgctccgtgtccatcataaatactatatcgatttatataattttcggaatccctagttgtagatccgaaaattatattaccttcttttctttgtgatttgtgaaaaaatagatataattttatcgattctctcttaaaaatgcattatatgaaaatatatatgtccagatgtacgtatatactagttatacgttccctaaagctcatgttattagtgatttattttttagatgatgtggcaaattataaaggattgcttatatggattaattaatattgtatactcctttcgtttcatattgtactcctccataaacaaaacacttatcattttgaataactttaaagtttaaaaagtttgactataaatagtttctaatatactccaaatcaacctgttacgctagccgagaacttgaccatccccattaacacatcagctagcccgtccggatgcagacgagtggttgggtcaaatgagatcgacaatagccaacgttgacactgcattcaaagcggttgtggcataagagcaggtataatagcaggctataagacaaaggtataaacatattttaaaagataaaggaagagagatataagtagcgggctacagatttatagccagcggcagcacggactctaagacgtactgtgtgtataataggtaggaccagatattaatagtacagtaaacaactattatatgaattagctattacattggctatagatggtctgtagctaataattagctatactattaagcgtgtctcctaccagg

SEQ ID NO: 9345 - DNA, 881 bp, Oryza sativa
ttgcaacagtattatatataaaataccactcaacattgaaaatatcaggttggggcgcatgactgtatcaatcaatgcctactaatatgattcgtgttattgtccgtgttagtgttagtgttagtgttggatcccttcacgaggggtgtatttagaaatccggtatttgttcagggctaaactcgcaaaactacccacccctcccccccctctcaacgacacgacgacatccgcttgtatttctttcgtttaacttcgttctctcctctcctcttcctccccccacccgcctcgtcgccgatccgatccgcctccgcctccgcctcgcggcccggcctgcctgcctcgccgccggtggtcccgatccgaggtaaagcttcgtctcgtctccctctctcgcgcttccggtgccccgccgccggccaaaatcccgccgcgccgccgcctctcagcctgtttcccggcggattagggcgagtccgatccgtgtgcctgcgtccctgcgttgatctccgtcctcgcgagagcagcctcgccggcgccctgctgcttcccgccgcatcctcgccgttggtgccacccgtgctttcccccatccctcgcgtcgcgcctctctctctctctctctctctgtgccttatcgtgagcttctcttctagatctgggggcttctctctttgccttaaccgaattggtgaggtctgccccctgattcaggggggcgcagggcggagagattggctgagaggctttttcgttgttgtcggtggattaggatgatagagcgatcgatctcgttaggctaataatttgtttgatccgatcaggttgattgatggtgttttacctgcgtgcaggttgctcttgctgggcatcaaaca

SEQ ID NO: 9346 - DNA, 312 bp, Oryza sativa
aaaaacaaaattagtgtaatttatttatagaaaaaattataaaagaaaaatgatgattactactccctccgtccaataaaaaatctatcagaggttgtttaagggagtactcacgtggaaagggagcgaaacctctctctttcttctagcaacaaacggtcgaacgcagccaaaaagcaacaaaaaagacttcaagttggtacagcgacgacgccgccctttcttatttcctcgctcttcgacgtgctgcggcctctataaataagaaagccgggattaattaaagagtgcgtgtgatcagatcgtgtgcca

SEQ ID NO: 9347 - DNA, 644 bp, Oryza sativa
tctgtgaatatctacatggacgggaacttcacgaaatatcttcatctggttattttattttaatgaaatgcttctataatatggaagtaataaagcactgcttctgtcaaaataaaataaagcattatattttgcttgtgttccttcaatgtgatcacaatgacttctttttctttcttttgtgcgattaaattgtttccacaattttggattttgtcaagcatgatattatctgatatctttcagtatgttatattagtttgaattttactcttggcatttacttgttatggtcaaggcatcaagtgctattttacacatacctccatgtacttggcagtggttctttatcttattgcttaggaaacgtcacatgatgatgctaagtaacttgaatgaaacactcccatcacaacgtgaatcttattttttagccttggggacaatcactgtttaatgacctttgtgaagtacaatgtgtctattcacagttggataatatcaattaaactgtaaaatcattcatgttgaaaacagaatttatgaaattactcgctgtatatacaaagtatcagtcttctgtacataacgtttattttgtgtaccccatgtttatcatgcaactgctcgtttttatttatagg

SEQ ID NO: 9348 - DNA, 1501 bp, Oryza sativa
ggatctaggcatctagcggaatagaaaacaaacagcaggagcaagttacaagtatctacgtatcactcaggtttaggtttataaagtgggtggtcctatatagaactccctttatattttaatatatgatattgttatcttttttactaacgtttaatcgttcgttttatttaaattttgtgtgtaaatataaaaatattcatatcaaacttaaagaacatttgatgataaatcaagtcacaataaaataaatgataattatataattttttaataaaataaatgatcaaacgttgtaaaaaagtcaacaacgttatatattaaaatatggatgtagcatttccagagaaaagcgcgtagactacgtggaagaccatccgtgctcctcgttgcaagtcttgtcaaaacttttttaagtagatattagcatctagtcgtagataattaattaagctgggcctgggaagcttcgaaaaaaatggctgcacttggaaagtttgcgtggttagtggccgcccatatcactatatcatcagtgccgatatagtacatcgaaaagggcaaaatcggtcgaaaaaaaacaatgtgcgaaaaggtgcaaacagaggacgaccgtacaccctatatatcgtcagtatcaataatatagccgacatgcttggatggtaattagactagccacgcctcttattacttaacaattggttaggttagtgcatattgtgtgatggtaggccataggcactaggcagcggcacggcatagaaaatacagaaatatgtaaagtatttttggcacgaagtctattggtcatgtaaaaaaaccaatcctatctataaatctagacacatatatatccagattcatatctagaattaagaattatttttttcggagggtgtagaagtactcatgctgctgatcaatattctctgattggttaacctatgagtcggctatgactaataacccgtagatatattgaatgaagcgatatggcacaatcatcattttgtttatactggttacataccacaatagcttattaacaacaaagaaataatttacaaataaaacttacatgcacgctcttatcaatttgagaacaaatgctgaaaaataaaccacgtaaaggaaaaaaaaaggctaaaatcaaatctaaaatatggttttaaaatctaaattttagctgcggcttgtaagctaaagggtaaacaatgtgaccttaacattttactggtaaaagttttatgcatgttaatttgtggtttagaaaataaggcagaaaaacattccacgataaaaccctagaaattaagttttaaatttaaattttagttgtacctgataatctaataaacagatgataaagatcacacttcaaccgtgaataccgatgttgcgtgtcagcttaatcacttttacccccatagtgccaaggcaagatatatggtactgactacagtaacattgtcgaatcatatcacaacacatacaaaca

SEQ ID NO: 9349 - DNA, 1218 bp, Oryza sativa
gccccatcgtcatctacttttctgagatttgtatcaaagttgcgactgtatcatcgccatctacttttgtgcgacctggggataaaaaggagagaaggaagaaatacatattgtacctcaacaggagagagaacatacttacgtacgtacatcagccagagttggaactgctaccacctgttgctatccaaaacagagaatcgttgctccaaatgcaaatgatttcatttttatgatgtcagtaatactaacaattaacagaggaacagactacagagcccacggccggcgccacagggcacatctgaacaagcgtggagcccatgtgctggacgatgcacacagccatttatttttgttcctgaaaaccatatgcacagccattaactgtaaagcacatataaatacccaaggaaacaaacaatgttgttacagatgtcattgtatagcatggacgtgttccactgttggatgaaaaagaagcagcgtaacatattactcggccgcaaaattggagcggcgcgagaagccctttcggcagcagcatgcacgagcacgacaccgagcatcggccaggccggccccagcaagagcaaagttaagctcgcccagccggcaagcaacacggaacgcacgatcccctgctcacgggtcgaattcgaagcagcagcagcagcagcagaaggagaagcttcttaattcgttcgcgtttaacaaccccatccccgtagacgacgacgaggaggagaacgatggcatggcatggcatccctgtcggcgtgcagtaacacctcactctgctgctgtcccgacgttaacctctcccctcactgacgctaagcacactggcagtcgcgtactacacgcggttagagcgagcttccattagcccccgagaaattaacaaaaagcaaaagcagaaggaaaaaaaagaaaaacgtcactcgcatcacatcacagcactagccgctctctctctctctctctctctctctctctctctctctcctcaccagattctatataagcagctcgtccaaccttgggaggcacccagcagcagccagctagctagctactcctactcagcagcagcagcagctcaggtctctccagtgttcttcgagctatacactagctctcacagatttttgctccgactcatcaagcggattgattcgatcggctgttagagagagaaaaaaggagagttggaga

SEQ ID NO: 9350 - DNA, 779 bp, Oryza sativa
ttcctgcagccttgctggagttgctcttacggagatgtctcggtggatatgtggtttgaggtgctttgggttcctgcagttgctcctccaatcagcacaccagttcttttgtgtcgtgagacacatatccactaccctgcacatcatgatggttatgatcaatatgatatgttcactggctcaaataatctccttatactttataatctcatgattaatatgcatagagcatgacgataatcaataaattctactctctcagtttcaaagtacaagtattaatagtttgtttagaaaaaattgagaataaaatgaaatactttcaatgtcttttcctcagatccctccccaatcaatgatggaccaaaataagccgtgcaatgaaagatccctccccaatgatggaccaaaataagctgggcaatgaatggagtagtaaagcactactaacattttttctactttcctcgttatgtagtacgagcaaatatatttttaaacaaacagtggatgatggtacttggctttggaatagtgtcatggaaattatttataaaactgactatattttggaaatggatagagttaattaatgttttgtttatatgggcctcaatgctggccatgcaaatgaggtcttacaactcacttcccctcaaacgccccctaatttgattaagttatatagagtaaaagttatatctatgttcatgtaggtgctcatgtgttacacgtgaggtagggtgaattgcagcttgagcgctaccctgcttggtaga

SEQ ID NO: 9351 - DNA, 1501 bp, Oryza sativa; identical to SEQ ID NO: 7524

SEQ ID NO: 9352 - DNA, 1501 bp, Oryza sativa
gtgtcaaacagtaaagctttatatagctgccccgctggcttttttatatagtcatggtgctgtttgggtttttaagcaattgattggatacaatatcattgctttttgccacgtaagtgtgcatttttattgaccaatattatggcttaggctgattatatattgtggtcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttgaaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttatttttcagccctccacagtcttcagatttggtaaaaatactcgggagaccatggcaaagatgattgaagtactcggttttggagtaatctagttcgagagaagattatcttttcgactgtgaaggtctcaggggctactgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcctgcccccatcctatataaggtgggcaggaggccctctagggggcatgagacaacttgatcgtcagatctatactacacccggcggattcaaatccccaaacaggagtagggtattacctctcattgagagggcctgaacctgtctaaatcctttgtctctgcatccatccacttttaggtctcgtgcgctaccccgttttattattgccgaattcatgtttcgacaaagtttacagccggcttagacataggaaccaagaaaatctgtaagacagacatgtggatcatatatttatagtgaatagttaaccactatatgagtgagctgatagatagactataactaagcagctggatgtattattatcttgctctaacgagcaccggctgctgggctcctctccccgtcgctcaacggtctattggcccggtctaatagtagggtccgatcttttttggtccaaccgatcgaccgaaccgggtctgctacgataggtggaagtgtgcccatatccactcctcggcaatttcgcattccccccgaaaaatttgaaatccttttcgcatccctctcctctccgcgattc

SEQ ID NO: 9353 - DNA, 1501 bp, Oryza sativa
cagtagccccctcttgctgttccccatcatcgtcatcgtcctcaggaacggccatcctacacttccttgcattagaccttgtagcccttccccgtccctttccggccatctcgctctccctctcatccaggcttgtgtccactgccttgcctctcctagcagcagctctcgtcgaccttgccctcggcggcggtggcgcaacggctgcctccggcgccgccttcctcgacctgccgcggcgcgtcaccaccgggacctcctcctcctccttctcctcttgttcctcatccttccccttctcttgctcctcctcctcatccggtttagggggctctgcggccttcttccgcccacagcggcgcgtcaccaccgccgcgaccacctcctcctcgccctcctcgtgctcctccgctttggggggttgcgcggccttcttccgagcaccgcggcgagtcaccactggagcctcctccggctctggctcttccttctccgcaatgggcggctcaaccgccaccgccgccgctgcagcgttcttccgtccgccacggcgggtgaccgcagggggtttctcctgctcccccaccactgcggcggattggcgcgaggagcgcctagggccagggttgggatccgaatcgggcgcgatggagaccacgagcatgctggactccccgatcttgatgacatcgccgtcggagagcggggaggggacggtgggcacgaggggggagccgttgaggagggtgccgttggaggatcccacgtcggagacggcccaccgcgaggccggcggcgggaggaactcgatggagaggtggcgctgcgacgccccggcgtcgcgcacggcgatgtcgttgccggtggcgacgcggccgacgcggagcacggcgcccgcccgccactgccgggtctccccgccgcggcggcccttcttcacctgcagcgtcagcaccggcggcggagcgtcggccatcgccgcaccgccctgcagccgggagtggggaatcgcggagaggagagggatgcgaaaaggatttcaaatttttcggggggaatgcgaaattgccgaggagtggatatgggcacacttccacctatcgtagcagacccggttcggtcgatcggttggaccaaaaaagatcggaccctactattagaccgggccaatagaccgttgagcgacggggagaggagcccagcagccggtgctcgttagagcaagataataatacatccagctgcttagttatagtctatctatcagctcactcatatagtggttaactattcactataaatatatgatccacatgtctgtcttacagattttcttggttcctatgtctaagccggctgtaaactttgtcgaaacatgaattcggcaataataaaacggggtagcgcacgagacctaaaagtggatggatgcagagacaaaggatttagacaggttcaggccctctcaatgagaggtaataccctactcctgtttggggat

SEQ ID NO: 9354 - DNA, 1501 bp, Oryza sativa; identical to SEQ ID NO: 9075

SEQ ID NO: 9355 - DNA, 1501 bp, Oryza sativa
aaaagaaaatacctagttaacatgaatccaaaattttaaatttaatagtaacaaatataacttttcaatgaactatatagtgcgaaccttattgcggtttgtatgtgtaataatatgtggagaaactcataatgctatgatataggatagatgtaaggacattaatgtctaagcattttaaaattgttacgaaaaaggaacatgcaatggttggtccaattttagtgaaatgtgagaaccaattttttaataacttattatgttttctctaaatagtttaatttagtctctattgacattttctattacttgctttattttatattttataccagctcaaaatataagctttatggatctttaaatcaatgttttaattataaatacaacaatatctaaattagaaatcggatgtgtagcttgaaatttatgcaagttttaaaatttttgattattttcggctatataaacaggaaggggtagagtggagagctcaagacgagaagggatggggcgaatagtgccgtgttgtgcgtatgtgtgggggatggcgaagtggaggggtattttttttctattttatctaaatgatttaagtgaaaccaatgatatatttttttctcacattttatgttatttttttctaattcttaagacgtaacacatggttgcttaagattttcttaaaagaatatctattggttgaaaataatggatctacctatttaagtggaaactgatgctaagatggtttttcttccaatttgtaaagttatatttttatttaaggcgtaacacatgacgccttgagtgtgctcagaggatgtccagtgatttacggtaatataatacttattttcattttgtattatggtccgtgttttttctatttggttaccatgcaaaggaacagtgtctatgcttaaatgacatattttcattttttatagagtgaaatatgggtaatatggatcttaaatattttatttaattgtaaaaaaacaaaaattcaaataagttaaaattatgatttaatttaagaattataatcatttagctttctaattattgatatttctttacttagttaaaaattaggagataaaggaattaaatgagtgagtagaggaagagagcgttgaaggatagagattatgcgtgcatataattgcaataattctttttatccgattatgcgtgcatataattgcaataattctttttatctgtcgtaggctctccgaatcttccattataattaagagatgaaataaataattcaagtcatcaaacaagcataatgaaatatccgacgcctcgagagagtaatattggagatattgttgggcctttagcctgccagtcaacttcagcctgagatgtgcccgttaaaccactcgaaggcggtgaccagatatgttacacatttaggagacttgacaaaaatggcttaagatctacaacatctcaaatattcttaactcatactcatgtgaatcta

SEQ ID NO: 9356 - DNA, 1501 bp, Oryza sativa
ggggagaggggaaggagggggaggggtgaaacgacggcggcgcggcggcgcggggcgcgaggcggcgggctcgcggcgcgaggcgacgagactgcgcgcggcgcggcagcggcgatgggacgcgcgcggcgacgggacgtcgatggcgacggcgacagcggtggcgcgcggctcggggcgggatgcgatgggcggcgacacgacggcacggcgcgacagcaacgataggacggcgcggcatggcgcggcgcgggcttgacggcgacgggcggcgacgcggcgaagggacggcggcgcggggctcgaggcgacgcggcaacgggacgacagcacgcgtggcacgggggtggcgatgtcggcgcgggctcggggcgactcggtgacgtcggcgcggcggcaggcggcgatggcgacgggcgggcggcgaggcgacggcggcacgcgcggtgatggcgacggcgacggcagaggggaggcggagcggcgcgcggcgcgcggggcgcgagggcaacgcggcagaggaggggctagggctagggaacgcgaccgaacacctagggggcaatgaatagtggcttttcctatttatcccgattttagtgtatttcccatataaatttgattccacaattcctaatttttggatatatgcattttactcaatatttgtgttatctcaactaatgatttcaccctagattaatattactcatattttatttttatataatttatttgaatttttaattagggttaattcttattccatcatatttaaatttaattgatccaaatatggtcacgataatactttatttattcctatccacaactaatctttactcacgattaataaacttcgagatcaaattcaaataaaataggcgaataagatcggcatgatgcaattaatttaaaaagtttttgaaaatccgtatttttagagtttagatttttgtcgtcgaattttcagggtgttacacctgccatgtccgtctctcccgagccccaataaagctcccccgcactcccctccacctttttcctctttccgccgctcgctcccgtgccctccatcactcccgcgccgctacacctgtcggtgacatgggaccgggggtatcttgactagaggtttggggcagctgcagtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccgcatttaatgcagcgcaacacactcgttcggtccgtgacaggtcacagtgtgtgaccggtcacagaccggtcagatcgcgggttaggtggcaacaggcggcctttcgcacgcctcgccccgtcccgtcggaa

SEQ ID NO: 9357 - DNA, 1501 bp, Oryza sativa
ggacggggcgaggcgtgcgaaaggccgcctgttgccacctaacccgcgatctgaccggtctgtgaccggtcacacactgtgacctgtcacggaccgaacgagtgtgttgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacaggtgtagcggcgcgggagtgatggagggcacgggagcgagcggcggaaagaggaaaaaggtggaggggagtgcgggggagctttattggggctcgggagagacggacatggcaggtgtaacaccctgaaaattcgacgacaaaaatctaaactctaaaaatacggattttcaaaaactttttaaattaattgcatcatgccgatcttattcgcctattttatttgaatttgatctcgaagtttattaatcgtgagtaaagattagttgtggataggaataaataaagtattatcgtgaccatatttggatcaattaaatttaaatatgatggaataagaattaaccctaattaaaaattcaaataaattatataaaaataaaatatgagtaatattaatctagggtgaaatcattagttgagataacacaaatattgagtaaaatgcatatatccaaaaattaggaattgtggaatcaaatttatatgggaaatacactaaaatcgggataaataggaaaagccactattcattgccccctaggtgttcggtcgcgttccctagccctagcccctcctctgccgcgttgccctcgcgccccgcgcgccgcgcgccgctccgcctcccctctgccgtcgccgtcgccatcaccgcgcgtgccgccgtcgcctcgccgcccgcccgtcgccatcgccgcctgccgccgcgccgacgtcaccgagtcgccccgagcccgcgccgacatcgccacccccgtgccacgcgtgctgtcgtcccgttgccgcgtcgcctcgagccccgcgccgccgtcccttcgccgcgtcgccgcccgtcgccgtcaagcccgcgccgcgccatgccgcgccgtcctatcgttgctgtcgcgccgtgccgtcgtgtcgccgcccatcgcatcccgccccgagccgcgcgccaccgctgtcgccgtcgccatcgacgtcccgtcgccgcgcgcgtcccatcgccgctgccgcgccgcgcgcagtctcgtcgcctcgcgccgcgagcccgccgcctcgcgccccgcgccgccgcgccgccgtcgtttcacccctccccctccttcccctctcccctataaaga

SEQ ID NO: 9358 - DNA, 1501 bp, Oryza sativa
acatccgtatcaactcaataacttgaatccggatagactgattgcatcacaagaaacttaacaaactcactttgttattcgtggtacttttttttctctctaatgcaatgtataataacttttgctaatataagataggagaacgtggcgataattgtaaagggtttatttaacgtgaaaggaggaggaatttcacgtagtagtaaagtcccaccggtgaagtgaacatgtgctagtcatattaagtactactagatggtgaccaatcccaataattaggtttaccacagttcctcctagaattccggatgcatatgtagcgtgtatgatacgaatagtgcttctatgtcatgtactcaggctgtgttcgcatggggtggttgagaacttattctctccgcacggaaaatggagcggtccattagcgcgttattaattaagtattggctattttttttaaaaaatagattaatttgattttttaagcaactttcgtataaaaactttttgtaaaaaacacaccgtttaactgtttaaaaaacgtgcgcgcggaaaacgagggagatgggttgggaaaaaggagttgcaaacacagcctcactccgttttcgagacatgagtatttttaaggagttttaagtataaattaaggtttgaatgagaaatggtgatgatatgttaagatgcgaaaatagacggatgaattaaagaagagaatgttgtgattgattaattgagatgacgaataatgtgtaggaaacagttatatgagttaaataagatatgtatattttctttttgaaaaataaacaaggaataagaattagacagattttattatgacaataattaaagatagaattatataccgcgctgcagacatataggtgaataaatgaaatttgataagcttgaagctgcctcatagaaatttacacttttgatttcaaatataagtaattttaaacatacatacaagagtcttttacgaacacttacataaacaattcccaatgtggttttggtgtcttcgtttgtacgagtacttatataaaataaactatagcaagtatttatttgcgaacacgagcaataatttaataatttataaaaggatagtattttttacaacaagaacaacacatatagtagatctgagatgagaatgcaatgcctaatccaacaaaaactagaagagttagacaagtttttttttaatatttaggtaaaccgttctaaaaacggatactacttgtctaacccaaaaaagaataggatttggtaataaagcgaatcctcgaggaccccgtcgcaaaaacaccccctccccttaaaattcccacttcttctcaccttcttcttcttcttcttctacctttccctcccgcttccgattcctccacctccatgacctcctcgtcggcggcggcggcgttggagtagtaaccgtgcagtggcgggggcgaagtgtaggttgcggcggtggctgcggcagcgatgg

SEQ ID NO: 9359 - DNA, 1501 bp, Oryza sativa
atttcgtcctggcatactgaagaaccatatcggttagccactaatcgcagaagcaccacaaccacctagcaatagaaacaacaacccgaaatttgacttgactttactctttccgcaaaccgaatcaaacaaaatccacagtaatcatccatgactcgatcagatacagcttacgatccagaaattcaaaataagcaaagcattggtaccacaagcattgaacatcatcttgtataaatatttaataatggaggacaattgcaaaaggccaaggataccaccacaaaagacaacttttttccggactcactcatcttagttccaataaaaaaaaatctcacaagtaacaaatgccgtatcaaatgaagcaagaaaaaaaaattcttcagagagtcaactgatcctccttgcaagtaaagtaaagatccttagactcgattagaactacttttgcaggtagaactttccagcttccacgcccaaatcattgcaatccttttcacccgcgagaaaagaaaaaagaggaacaaatccatccaatcgcgaagcaaaagatgtctctgacaagattcactacttgaatcaaagctatatttttcacatcagcagaatctacccgccaaaacggcgtcacctgtgcccccaaaaattttcaccttttcccagcctctctctcctctgacgagtgacaaccaaatcaagattctaaagaaaaatttccaaaaaatatttctactcccatgagaaatccccttgactcaatcagactatcaatttactacccaagaacaacaacctcgccaaataaaaaaaataaaaaaccaaagcagaaacagatccctctctctcccaccgagcaaaccaacaaagcaaggaaagaaagctaaccggaaaccgcgtcgccatggaaagcaagatcctccgctcgattccactgcccacgaatccaacccaacccaacccaactcaacccagcgaggaaaccgcgtagaccctaccctccccaaccaccgccaccgacgaacctcacaccggcgcgcggggggagatccaaacacccagagagcacgcgcgcgcgggcggccgcgaactcaccagcgcggacgccggagtcggcggccctcctgagccccatcttcttgacgatgaagctcgccccgatgaaggcgctcgacgacaccgcgaggaccagccccttggcgttgtcggtggacatccccgcgagccccgccgccgcagccgccgacgcgggcgccgccatcgctgccgcagccaccgccgcaacctacacttcgcccccgccactgcacggttactactccaacgccgccgccgccgacgaggaggtcatggaggtggaggaatcggaagcgggagggaaaggtagaagaagaagaagaagaaggtgagaagaagtgggaattttaaggggagggggtgtttttgcgacggggtcctcgaggattcgctttattaccaaatcctattcttttttgggtta

SEQ ID NO: 9360 - DNA, 1501 bp, Oryza sativa
actatcagtttaaaagccaatgctaaaaaataaactacaaagaaaaggacccccaaatcaacttcattttaaattttagttttggttgcatctgataaggactccctccatcctgcaaaataagtttcctacaatttaaaatttatcacaaaataaatttatttctactctcttaactatcctcggttgtaaattgagacattttatttcttcaatactagtaatacctttgttttctaaaaagtgtctttttacgtatgaactaggatagtgggaatagtaagagtttctctttcgctactgttttttttacgtactccctctgtctcaacatataagaatctagtaccgaatgagacgtttcttaatacaacgtatttggatagactttctatctagatattttatactacaaaatattcaatccgataataagtttttatattttgacatgaaggtagtagggccttgtttagtttgcgagatgaaaagttttggcatatcacatcggatatacagacacacacatttgaagtattaaacgtagtctaataaaaaacaaattacagagcgcctgtaaaatgtgagacggatttattaagcttaattaattcatcattagcaaatgtttaatgtagcaccacattgtcaaattatgacgcaattaagcttaaaatatccgtctcataatttatacgtaatttgtgtaattagtttttttacaatactcttatgtattcgaacatttaatatgacatgacagggtgaaaagtttatcttagggaataaaccgggcctagctacgatcatgccatcagcgttcgtaattccgatccattttcgcttggagagtgagagccaccatgaaaatggagaggaggcgccagcgtggcggattccttgctccgtttcatccggtagtacagaactacaggagggcaagggcatattccacgtgctcccgaacccgtcccaacccaaccaaccgtcctggatttttcacattttggtccttttaaaaaacttatttcgcaagtagacccctagaaaaacttatcccaaaaatggtcctttttggggcgccagagtggctggcgccgttgttcaacaggacggcgccagcctctttggcgccgtccccctgccgacgtggcggggcgatgctgaggtggctaaggggagtgcgccagagtggctggcgcccccccccctccgaattttttaatttttgttttatttgtttgatatttttttcacgcttagggacacacaagaaccaaccatagaaaaattgaactcaaataaacgtaatatgtgacatgtagaatttttcctctcctctcctctctccgaactagtgcagaggagagagatgtgcaacttttttatttttattttatttttttgatatttttttcacacttaggaactcacaagaaccaaccatgtaaaaaataaactcaaacggacgaaatatgtggcatatggaatttttcaaagc

SEQ ID NO: 9361 - DNA, 1501 bp, Oryza sativa
cgacgaaagaggcaggcttctactcaccaccaaatatttgtcacatatcaaatcaagaaacaacgaaaaagagagcagttttatgcacagttcatgaatttggatcacaaagtagttattgcaactttcttcattccattgagaactataggtatatatatgcataagagtagtatttttgccattgggatgtatgattaaaacttggtatccacgcaagaatttaattgtaccaaaccgcttctggttatcaaacatggcaatacataaatattttttcattgtagtataatcatgtaagatcttgttctgaagatttaattacaacgaacacaatggtgtaatcggattatagatcggataaataatttgagagaaaacttattaagaagggggaaatgcatgcatatgtaatagaaaaaagacttagcatgtgtactggcttctggcgttgcgtgataaggcaatttcgagaggcctctctgattattttttgcgaatttgtaagctatcgtgaagaaaggaagattatacagattcttactaatttatcatagatgaaaaatctctatgtttgatgtggtattttaagtagttttcttgtttctaatcaaactgggactctaactcgtagtcatccgtcctataacctctgtaataattggttgtatcttcttttaagtaaagaccggaatgaattccattattaaaaaaaaaacttggatatgtatagatattttgttttatgccatcgtttgtgctacagtagcatagtatgctactgttatatcctccaccatggtatagaacacatgcaaactataaaacataaagaaaatgttacatctttttttgtctcttgcgagcttgattctatcaaatgtggttaataccacaacttatacatgacatctgattgcatgttttataccccaaaactgaatgacttggtgaatttggaccacagcttgtgacaacagctaagggggtgtttgggaattagagactaaatttagtccttgtcacaaaacataagtcccaaacataagttctatgtttttatgagagggactaaatttagttcctagttctcaaacacccccttagctgttgtcacatgtcctcaccaaatgcctgccacaccatcaaacaaccaattaacttcataactattatgtgtgcctgtaattaatgttgttctcacaggaaagctcaattccatgcagacaattgtactacacagagtccaagtcttcaagatttttagtgagtcatctactggaccagcaatgccgtggcttctgagcctttcatgccatagacttggtcacttggacaaggcccctcaatcctcatgcaatggtccattattcttctgaatttatcctggacaataatatgctcagatccctggaacttggataaatccaagtatatttcttaaaaaaactacatttttcttctcaaataccctgattttctttccaaggcctaaaatctt

SEQ ID NO: 9362 - DNA, 1501 bp, Oryza sativa
cttgttaaacactctctagcttactactactatcaactactgctgctgctggagtactactacacccatgctcaatgtgtagcaactcaatgtgtctagaatcttatcacatcaagctaactacacccatgagaaacaatgcagaggcagccaagacaatctgtagcattctcttcctttttgtgaaaaccagtgctgaacatctcattcagtcatctttactctttaccagaaagtagcagtactacatgcacaacagcatgcacagagtaaggcagattccatctttccaagcaacatcaaacatctttggcagaaagccatcagaaaaaaagcaatccctgaatcatctgttgggctctgcataactgcattgctgctgttgctgttgctgtcacacacatcctccctccaaaaaccattcaattgctcatgctgctgctcctgcacatgcctgtctatggattccagcttcccttttgcttttcaatcacactaacaatgcaacagcaatcctttcttttttgttactacaaaatttttgattggttggtccaactccagtgcaacaccttgcagcttatgttgctgttaggcaggtcagatgcgtgaacattcttcctagggtggtgtatcactgtatcctacagcctttgtccctttttaacactggttgtatatagtaattagttgcctgtcatttgggataaacagtgcacactattaagtaatcagcacatcatcactgcataattattgccatctgatctgaagcttcaggggaaccatatccctgaatttcccaacagctgcagatttcaagtaggtactctagattaggatgctacatcctactacaccctagctacacaacctttgtccctcaactttggctctatggccctgtttagtacacactaaacttcccccaaacttccaactttccatcacatcagatcatatccaaaactttcctactcacataaactcctaactttttttttccaaactaccaactttccccaaacttctccccaattccaagaactaaacatagcctataatagagaggcagtggatcaagcctactccctccgtccctaaaaaaaggttaacatagtacaagatgtaacatttccgagtactatggatctggacagaggatggagtgagtaccattttgcataaacagtgaaaactaatcatcatattatcactgcatcattattgccatcttgtctgaaactctgaatcttcggggtggcaaccatatctgaatcctcccaacagctgcacatttcaagcaggtagatgaggatgcttcaccctccatgagtgaccacttgtcatacaaacacaaattgtagctatcaccattcatctcatatatatatatatataggaggaaagtagaccgagtaatggtagtagcagtagatacatcaagaacacatagacacatacacatcaaaaaaaagatttgcaacctcgttgcaaacca

SEQ ID NO: 9363 - DNA, 1501 bp, Oryza sativa
ttacaagtgcacacattattcctacagcggaatgctacgtgaggtcaccttgggtatggaagtgtgtgaggtggtgtgacgagtttaatgtgtaataggcactaataaaatttgatgactatagacacgaaacatctttactactttaaaaggacataatgatgatggtgaactccactttatacattgttgaaattacccacatttctcatcctagcctatatatcaacaaaattgctcacctttgtcatctcactcctgacttctatcatagccacaaaccccaaatctccccctttcctcatcattttctctcctaccaacctccatgtcacttgctttctcgctgcttgctcccatcatgatctctgctcctcctactcaacatgttggcacttgatgctcaatgtcccttgcccctcccgtcatgacattcacgtactttcctcctgctcatatcctactcagcacatgagtaagggggttcacacctatctctttgctggcaaagaagaccgctattgagtggagtactagttagctacaacattgccacatctcttcctccatatatgctacatggtccatccttacgtgactatgattctacttagatttattttttaaaaaacatattgtgtatatatatccttttgtcctcacttaggtaccatctagtgccaagccttgggtccttatagatatcatgatattatttcacccagccacatcggagccatattatttgcttgccgcacaacatgttaaattcactcgtgcgcatatgcatctacctgaaagggtcaattcggcctagaggctaatttaaaactttatgcggaagctaaaactgatataaggtcggaaagtctgatccacagtcagactatccgaaaatatcagatagtctgatgttggatcagactgtctgatccaccaatgaagcacaacaagtagatctatcacacaaacaagagtaaagcacaaatagcgactagatctatagcggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaaccactccttccactaaggggtatctctttcctttgcggaggcgagatccggccttcacaaacttctcccggccaaccacacgtagatcggtgccttgggagtgacacctagccgtctaggagttctcaacctccaagagtaacaaacaccacacaactcttggtcaaaccctagtgctcaagatcgagtgaaacacacactaggccctcaaacaccaaatccacaaccaccaagatccaccacacaaagaacaaggagggatttgagagagggaggaagagctcaaagatccaaagcaccttagcactaagctcaacccaaagtgaatga

SEQ ID NO: 9364 - DNA, 1501 bp, Oryza sativa
catctcatgttgtcgttgttttcttctgctgaggtcgagcctaggaaagaagggaagagaggaaaagtactgacaggtatatccaatcgattttaaaaatattttttggtgggaaaaaaaagcttcggattgagtaacggtataattcgtgttttgaagagttttggtgtgaaatatttggtgtgttaattcagcgaataattttaattttcacaaaaaaatgtggtggtaatttggaccatttctaatttaaatcactagcgctaagcggctattttaggatggagggagtaaaacttacccttttcattttggaaaaagtacgaattacccgcctgaacatcgcgacagtatgaattactctatttaactcgaaaaccagacatccttcaccccccaactatgcaaacctgacaaataaccctagctcaatccgcggtggttttagtcctacgtggcatatgtgtgatagtccaatcagaatttctttaaaaaaattggagggccccacctatcagtttctcattcgtctctatctctctactctatccctttccccggtcccctctctctcttctccctcccctcacctccatcagagaatgacggtgagcgaatgcagttgggtctaggcaacgaagggggagccgaggatggcggcaggcaagggcggagccaactgggggtgccgaagccagggatggcgacgcgcccctatctccgtcgtcaatgcccaagcaacctccgcctccccccatcggcacccgcgcgacctccgcttccaccgctggccgcccgagcgacctcttctgccgccagctgcccaagcaatgtgccacgcacctccgcctccgtcgctggccgcccgagcgaccttcgcctccctcgttggcaccgcggagactacgactctcctcatgtatgcgctggcgccggaggctgaggaggagctcagctcggcatggaaggtcgtctcgtgaagagatgtaggggcggccctcgtcatccgcggtgtcggcttctccagtggggtaatctccggtggtgggtgaggatgaggaggaggggatggtgggagacggggcggcatcatcgacagccgcggcgtgtggtggtggtggttgcgctggtggtgcagagaggtgggaggggagagatctaacagtggaccccaacgattgttttaatagtatttagaaccaaaatcatcgcggattaaccgtcgggaggagggggtgaggggttatttgtccgatttatatagttaggggcgaatgatgtctggttttcgggtttggggttaatccggttgactgcgatagtctaatgggtaattcgtgtttttccttttatttatttttttatgcaactttgactcctagacgtacattttattatttatcatattaaaagatcatgaaagtaccatttatgttgatgttgacgtgacatattttaattgtaaaagatatttgaagtttgttttacatttttgtactta

SEQ ID NO: 9365 - DNA, 1501 bp, Oryza sativa
tttaatgggccatctgcgtatgtacaatatttccgggtccccatgggtcacccgcgggtaggaatctagacccgcccccgtccccgcatatttccgggcccccgccccgatgcacctgtggggccaaatatagccccgaccccgtccttgtaggggcgggtccccgtcggggaaattgccatctctaatgtaaatcaatttggaatggagatagtactattgggattgcctatccatttgtcgggtgatttctaaaaaaatcatccagatttttctacccttagatttacatccaacggactacaaagaaaaataaaaaaaaaatacatactccctccatcccataatataagggattttgagtttttgatggcaacgtttgaccacccgtcttattcaaaaaattttgaatttattaattattttatttgtgacttactttattatctataatactttaagcacagcttttcgttttttatatttgcaaaagaaatttgaataagacgagtggtcaaacgtttcaagcaaaaactgaaaattccttatattttgggacggagggagtatttacttacacaacaattttatcaaaattacaatgcactaacatgtcatattaactgaatttacaaatgtaattgtagttatatagtattgtaattttatattttaaagaaaataacaaatagatatttacttacacaacattgttatcaaaattacaatgcacttacatattatatcaactgaatttacaaatgtaattttaattatatagaactgtaatcttatattttaaagaaaataacaaatagatattcacttacacaacattgttatcaaaattgtagtgcacttacatgtcatatcaactgaatttacaaatgtaattttagttatatagtactgtaattttgtattttatttttattttaatttcaaatgagagaggagagagagcatcatgcatgtcgatttttcagagcaaaaaataaaaataaaatagtgactctaaccatccgacgctgttacacgcgacccaactgaaccctatgcgggttcccagcccaacatatacgcacggatcttggcacatatggaacggcctaaaaacgacaaatctgagagaaaaaaaatcacatgacaaatctatagcaaaatcgagtactttttaaaaaaattgatccattctttgatatgcaagaagtaatatttctccgttgatttcggaggcccatcatatgaagcttttatggtgatccgataaatattggtgaccatatgcattccgattggtttcgttttcatatctggattttagagtattcgtttcggtttttaaataaaaagatgaaagcaaatatagtagaggtagctttcacagtatccgagccgtacgttttcattcctaatggcagtttatgaaaattcaatcaactgatgaataaacactcctttacgattgctaagatcacacttaaaaattattcttaaaaca

SEQ ID NO: 9366 - DNA, 1501 bp, Oryza sativa
cttaggttttcttaatcactcgcattaattatcaatcaccaaaaccgccacctatttgccacgtactaactagttcatagaattacattaacacgtggcaaatgaaaaaagaaccgtacagctgacatgtagaatacataataagaaaatttcttattatgagttctacataaaacacacctcgtccgactcagacgttttaacatgtggtaacgaacacgttaccggttcaccaccgcacatatctcacatatttttgttatgtgtgaaccgtggccactgtcttgagtttgtgaaggtttagttagttccaccatatagatcttacttatcatcggacaaccatgtaacatcaacgcggggtatgtggtattatcgtacaacgatggaggcagtggtacacctggtagacctatggtcgtgtctcgtgtgggcacacacaaaccactactagcgacgtgagagaacataaaggaggtggcccatggcaaccgaagttgagttgaggtaaagatgaggataagtaggaggctacaccaatggtgcctagtggctcatcggccggacctaccggcggtagcacatgcctccccagaccccagcttgaggggttaggagaaacaggatcctatttttttagcattcctgttacaacaaagtaaagcactcacacttgtaaaatcaaaggtgttttttattattattctgtgatgaataattgggcattggagattattggttttgttatttggaatttattcatgaagtggtttggagatgattggattcacaggtgatcgcaggattcattatttcatgtgaccgatcagaccgggctgtgtatgccggtcagaccggcggtaatcgagcggttggaccggccagcccgcggtctgaccggccgacactgtgtcagtttcgctttcgggttgtttgtttggatatccgtgattatttcatgattatggcttctagatggatactatacgtatgtaatactgttgtttgctactaatgagtcaagttggagatagcttggtctcggaatatggtttctttatttatttcatgtgtaggtgactcgatgtctcgggagagtatttgcggtgatggaccgggagtcggcttggggataagacgacgtccgtggtggtcagagattatgcgggatacttaggctagagttgatgcacgtggttgatggagattccatatggcatacgatggaggtattgtgtgtgtatgggatgcggagtcgaatttggaaggagtccaaatttggtacgattggttatgtaaagtttctttcttgtactagagggttttctaaggtgtttaggactcctagtatgagtttggttcctgcctgcctcgggtataaatagagggggagcatgaggcttcccggtatcgcttttgaaagcaattgagttgagttttgagttagggttttgagtttagtcgaaatttctgtaaggagtgctgtttgtgcacttcgtaa

SEQ ID NO: 9367 - DNA, 1501 bp, Oryza sativa; identical to SEQ ID NO: 7156

SEQ ID NO: 9368 - DNA, 1501 bp, Oryza sativa
agggggcggtggcgacgggttgggccggttttgggccggctcggccgcgggagaggggaaggatgttgggccaaaaacggcccaatggctttagggaggggtttcagaactttttaattaaatataatttgtgaaatgttgtttcatttattaaaaatacttcccttgctcaaataattcccagaaaattctagaaaatagaggaacaagcaaagtatttaataaaattttatctagctcaattttacgttgaaaattttcctagacaattagggtttagcttgtaggcttttaattttaatttctaaaaatgatttaaacaatgtatttttaatttaggcgatttttagggcgtgacacaatccaagctgccatgatgtggtcgcagccaatctttgacccatccatagcggcccagcaagtaccaccagttggagccgggcaatcgaatgccgtggcccaactccacgcacaagccgcgatttcgcccttcgccacaccgtacccgcagcaaggtgcggtaaacagggcgggaggcgaaaaggggctgccgctgagtgggggaatcaagactcgtccaatcccaccccagttgaagttcccacctgtcccgcgttattcgggcgaaactgacccgaaggagttcctctccatctacgagtcaacgatcgaagcgactcatggtgatgaaaataccaaggcgaaggtaatacatctcgctctagacggtatcgcccgttcttggtatttcaatttaccagccaatagcatttactcatgggagcaattgcgcgatgtttttgtccttaactttcgaggcacctatgaggagccgaagacgcaacaacaccttcttggcattcgccaaaggccgggggagtcgataagggagtacatgcgtcgcttctcgcaagcctggtgccaagttcaagacataaccgaggcgtcggttataaacgccacttcggccggtctgcttgagggcgaactaacaagaaaaatcgccaacaaggagccgcagacgctcgagcaccacttcgcatcattgacgggttcgcaaggggcgaggaggattctaagcgacgacaagctatacaagttgagtacgataaagcctccgtcgccgctgctcaagctcaagcacaagttcaaattgccgaaccacctcccctctctgttcgccagtctcagccggcgatccagggacagccgccaaggcaaagccaagcccccatgacttggagaaagttcagaacagatcgggcgggcaaggctgtgatggctgtcgaagaagtgcaagccctccgcaaggagttcgacgcccagcaagcaagcaaccatcagcagccagcccgcagaaggtccgaaaagacctctactgcgcctttcacggacgctcttcgcacaccacggaacaatgccgaaacattaggcaacgtggcaacgcgcaagacccaaggccgcagcaaggaacaactgtcgaaacaccccgtgaagcagt

SEQ ID NO: 9369 - DNA, 180 bp, Oryza sativa
tataagggtaattatataaattcccctgtacaacctagatcctagtagaaagagcctgcaatagggctataaatagccccctagggctatgtaacgggggatcccaagtgaaattaaaaatttagtacacttcattttcccaaccactgttgagtaaccacgtccttcgacgtatacagt

SEQ ID NO: 9370 - DNA, 1213 bp, Oryza sativa
aaaaagagatacgagtttgggaaagaaggggaaagaacacagccgaagcagggttcgtgcaacctcctcaaccatagtactaaatttacaattttgcattatctgtgcgaaacaatagcacgattttcttaaaaaaaagaaaagcgtaacatcatgcttacattctattacaccacctaccttggaataaaattccttttgcaaccatgccaggacaaaatttctgtgacaaaaacagcacaagccactcgcgaggccgtcggcaaagctccacgtatacatgcatgcggtggcttgatggcgaagtgatggagccaagtccagcatcatgtcgatccaacgtgtcaactccaaaaaaactttaaaaaaccggtccagcgggaacgcgcagcgcaaacgaacgaggctgccgcgtgggccccactcccgtggacccggtccgcgcgcccctccccctcggctgatgtaataaatcctttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagctcttttcttttacgttggtcgtgtagacgctgcagcttctgaagatccgctcttcgtggaggttgaagccgacgtttgggaaagtgagcaaggcaagtcacatcatccttgaacatattggatcccattttataaaattattttgatttaaattattgcattatcgctttacttaaattcccgcgttatcattgttttatttagcgatgcctatttacctttgttatgaccttattattattgttattgatattattaccttgttcaccctagattaaacaaaaccccaactagtggacactctactcatggtaccactagtatgaatttaggtagatgcttcgctggttaattaggcaacattaggtggttttacaactctagactttgggaatattctcatcatctggacactatggaatggatggattattgtggaattggattcacacctccccctctattcaaaatcctcaaaatggttttaggctaggcttggggtgcatggttttgatagtagcacctcggccatataaggaccggt

SEQ ID NO: 9371 - DNA, 1501 bp, Oryza sativa
aatactcaatggtgagtgtaaaacatcgtttaataatggtaaaaaacaagacgagcagcataaagacggtgttatataaatttatagtgattatactgtcttcatgcggactcgctttcataaccactggaagattcgtccgcatgtgcttgctcgtcgtctgtaaaaccagaacactctgctgcatcttcagcccactcgtcgtccaaacatcttcgtagcgaagggccctctctgttgtatctccttgttgtactagcgaccgcagtactagccgtgcttccagcatgcgtaccacggcctctacccttgcctgttccccgtggcctgcctctctttcccttaccccttcttgaaatttgtaggattcttcgggcaagtatccgcgtagtgcccatccctcagatggcaccacccacatttccttatgcacaactttttgccctttgctccaagttgaacttcttcctccgggccacgagtccttccttttttcctcgacttgggggggggggctccctgctaattttggcgatttcaactcgtccaacaacgccttcctgcatattggtgtcaaccgtcgcagtagtgtcgcgcggtatctcctctatttggctgcgcagtcccttcaaaatagccatagctttgtcaaatgctaccttcgatttgcatgccgccctaaccactccaaacgcttcaatcatcatcatgtttgtcctgtaattttcttgaacaccatcggtccagttgcctctcggtcatgcctgtcaaatggcacgtcgctcttcactttctttgtgtacctctttaggatgtaggcagcgggtatcttctcaagttgtacatgaacaaatgcccggagcatgtgtgtgcaaaacatgcctacaagacataaaaaaaaaaagaaatcaattggaccagcttatttgtgaagtgcgataaaggattgctggaatttttaatgcgtgcataaatcaagcttgaggttggtatgaaaaaaggacatgtatgctcccactgtttgcactcgcatgtaaacacccctgcgtcaacatctgcaattagcttgaattgcttctgacaccaatcgtgtttttcagaacgtttggtgtgtgatactatccacccgttgcggaaatcgtggtcttgtgaaatcctcaagtcggtgctgtcctgtagcgcctcctcaaacaatctgaaagccgccctggtgtacagtctcgacatctgtataacaaatggccacctcacagccaacattggctttccctgcacaaaagagaagtcattagttgtgtgtgagttaaagtttaggtgaattataaaagtgatgtaataccgaatcccctctgtacagaatatcactaaccgagcatgctcttgtttcagcagcctccttctccttcctatcagttataacctccaacattctcctagcaaaacggtggagcgtagtttgctagtcaacaaacttgtgcttcaccaacttgttcatgctctc

SEQ ID NO: 9372 - DNA, 1501 bp, Oryza sativa
atctatacatcatttaaggaaaaatttgctacaggacactccaaaaatatgtaattagctgtaggacataaaaaaacatgaatttgcccgaaaacactccgaaagtatggtaatttgctgcagtataccgaacgcattaaaatataatattcacccaattgacgagagagaaaccatacaaaataacatatttgcccttcttcttccgacgctcacttgcagcgagctccattggcttgcccatggcggacaaccgctcagtgtagtcgacggcgcggtcgtgcggcatgccactgtcaccggcctcgtccttaccaccaagtccccacctgaccgcgagcgcgtcaccgagctcatctcccgcttccgtggcgccacaagctctggtggtctcctcgagacgttgcacgagctcagggacgtggccgctgtgagcgagcctaacaggaagctcctcacggccgtccccggcacggtggagtgctggagtgatcgattgacaatagcaaagattcacatatataggaactatccattttctgctgatggagtgatggctggttttgcttgacttgttgcttgctgagttgctgctgcacctgcaccgctatggcgccatgcgaccttggctggtttgccattgcctgctagcttgccaactaccatgccactgccgccgccaggaacccggcggcctcacccctcctagccttcgcctgccctcctgcatgccgcgccggctctaggctccacagcagccgccgttcatcgatggggtgacgaggatttgggtcgtgtcacgtcctgataaattcatcccgaaataaaaatcattttctaaaagaaataatagaattaattaaaattcgaaaagaaattagcaaacactaaaatacgtacaagaaaaattcgaatgtggcccggagaatttttgttaaattctccttggtctaaaatgagccctcaaattttacttgaattttcagagcaccggaaatatttattaagcaacaacaacaattatcaaagtttattaaaaagaaaaacctaaaaataatcctccttcctcctttgggccaagtcctccctctctctctccctcggcccgcggcccaagtgctctcttcctccctctctttctctccctctccttctctccctccttctcttgggcctccccttcctctcccggcccactcccttttcctcccctcccgcctgggccacctcctggcccaagccgccccacctagccgccccagcctcccgagccgcccccccccctcacgcgcgccgcacgcgcgctaaccgcgcgccccgcgtgggtcccacgcgccgggtcgtcgtcctcctcccgcccggcctccttcctctctctcccgtgaaccctagctcctttcctccctcaaatccgtgcgatttactcatgggattccaaaattaaatagggggaattaatccccattgattcctctttgattccccccaatttccccttgat

SEQ ID NO: 9373 - DNA, 1501 bp, Oryza sativa
tgtgagggcatcagaaataccaacactaggcctcatatgttacccacaatactataaaacccctaataggtacacccataactattataagacaaattatgccacaaaaccactaataagcacttggcacgcgcagagctcgtcgaggcaccactgcttgcgcacacaggactggcatgtggacttatggttggagatccaccagcagaggtgccgctcgtcatcgtccgccgcggcgcccttgacgtccgtctcatgtgagtgtgatttggagaattggagatttggatttggatgaactttttgtctaatgaggattgtgagatgtgagttgtgatttggggattttgatttggatttggggcaactaggagcaacttggtacatcgactagaatcgagccaatgcattggatcttttttttttctcccgtgcgcttcaaatgcataggcttggaaagggattggatggagtttttcaagactgcgtgtacgtaaatactgattcttgagtgttttgactaccgtgaaataagttttaacaaacaatcaatgaagcatctaatagtcccacaattgctatcgttatagctgttatttatttaacaaagactaatgttcagtaagaaatgaacacaatgcccccaattaataaatgatatagggtatcaggctgtagttaattaggtgcaggattgagaaacaatagaaattgaggtgataaatgtgacaaagtgtattctaacgtgacaagatttctggaacaaattttgaatactaaaaaaattgaattggatgtgataaatgtgacgtacaacacctttgatatatattttttcctctgttcactagtacagatccttccatctgtgacgactcttaacaagactggaatttgcgggccgtcacaaggaagtaatctcgatcgggctgaaacttcagcccgattgagatatggtcgcacaaccatggtatatcggcataaaactaaagcatgtcacggatgacacttatatgtgacgggccatagttgaggcccgattgagatgagggttccatatctcaatcgggccctaaaagaagcccgtcacagaagagggtaatctgtgacgggctccaactagaggcccgattgagataagtttaatgcctgttacagatggcactctttttttacgggcttttattaaggcccgatagagattacttgtatgcccgtcacgattgattattttagaaccgttacagatatttgttgcacagtataaatacccccaaccacctagtgtaactgtatcccactgttaactattttggtgggaggctgtagggggcgattttttgtcttttttccaaggaaaacagaaaattcccaaaagtgatcaaaatggatcaatcaattaagtacaattaatcattaattgagcaatttcatcatatcttacttttgcaatactgatcttataagatgtgcatgtaatttgttttttttattttgtagc

SEQ ID NO: 9374 - DNA, 930 bp, Oryza sativa
cgcttttgagagcattgagttgacagtttagttagggtttcgagtttagtcgagatttttgtgaggagtgttgttgttgcactttgtaaacacagagagaagtaataaagttgtcatctactttgagagttcttcgatttgtgttttctcgacttcggcagtctaacccgcgaaacaccagcggcattgcggcggtcagaccggcggagtacctgcggtcataccggcgacggtgtaaggcgacttcaggcatagctgctgatctcggcggttcgaccggacgttgtacttcggtcagaccgacaatattcatacggtcagaccggttcgactacttcggtcagactgcgatcaatcgaatttgagggtaatctttaattccacaaaagtttgggtttttgggtataccaaccactcacccccctggttggcttagttcctgtgttttgatcctacaattattactagtacaatgtcgacactttgttccacaatataaagtgcacaaaattatgataaaagttgaaatgaatgaatcagtgaatcaccatcagcactgtatggtgggttacataagtgttcactttgtctcgtgggttctcgactatagtttcttatctattttgtgataaaatttgtcataaatatttctccagaatatttcaggttttttcatgaatcgtgtgcacatccattagtatgctccctgctaactaatgaaataaatgcaaataggtaagttaacttataaaataaaatataaataactctagtatttgtataagcaaaagataaagtacttggcaggtgacagagtgttatgctagtattaaaatgtctaggattttacaaaatttgcggagaaaaaaatattcagcaagtttcatttattgtcatcgcactgttggtagaattggatttacgaccata

SEQ ID NO: 9375 - DNA, 448 bp, Oryza sativa
aaaaaatttaataagacgaacagtcaaacatatgctaaaaagtcaacggtgtcaaacattttgaaacgaagggagtataatgcagagtgacaaaacagcaaaactcatgtctcgcatgagaaatgtaagacaattagaatccaagtagttgtaattggaggaaggtcatttcagtcattcagtaggaatgggaagcactgggatagataacctcttcggcagattgagagtactgtctccgaatttctgttacttcaatgatcctgacgcacagcaactatctcgaacacatgatgagctgaggcgcattggttgtcagtcagacatcaagtgatttattcttctgactacgcctacaaatcgcaagaaatgagattgcgaaagtacagcctgaattgttgcatgcaaattttgtttattatgaaatgagaaaacgaaacagccgcca

SEQ ID NO: 9376 - DNA, 207 bp, Oryza sativa
gcccaggagaaattgtagtcgctgttaaacatccattattatcatttgatatttatgaaatgactgttattctcgaagtatttatatatttcgttgcatgagtgtttgagttatctatatgcatgaatgtgtatgtggcatctttccacatcattcaaatgcctaactataaatatgtgcagactgttgatgtacctaaggacatca

SEQ ID NO: 9377 - DNA, 1501 bp, Oryza sativa
tctggaaaaattatttttattcattataaatgacctagtatttgaataaattattttacttatacacttttatgcagttaaatgcacttttagacaaagtatggttttagccgagtaagaactacagttaatctagtttttattagtttgactgatttatttgaggtaccaaatttagttattaaatcataccaaaattacagtgagttgcatgtgttgattagagcctacatgaattttcccatgattttatcttgcacgaattattttagataattcgcaagacttatatcttataaatgcttccctttcctaaatgcatgtaaatgtttataaaagttatatttggactctcattaacctgaggtgatgttgatatgttagaattacaatttacattacacaggtcataagctccttacctattatgcataagtttacattagtattaaattaagagaatgcttatagagatgattaagatagaatataccctatatgatataatttatttggtcacttccatgttcatgactagtcttcagatggatgaccgaaatagttttgtggggcttgacattggccttgttgatatattttaaggtgtatggtttctattttaacttcctctagctagcactaggccctaatggtttagttgtttatctagatcttagttaatattcatgagacctattatgaaatgcaaatcgaaaatccaaatgcaatccgaatccaaatgcatatgaaggactcaagtcaaacatgtctatgagagtatgcatgcttacacataaatttatatttttgtcctaggttagagatgcaaaggtttttaatttgttctaaaattttatcatgcaagagttggatcaactccacctaggtttaaaatggaaatttttggtttacaaaattgaagaacttccctttcaactagttttgatggaaattccttaatcctagaattcaggtatgttacaaaacgtgccctagttttaaaagcaacaacaggtttgtgaacaggtggtatttgtatggtgattaatttactacttgtgtaaaactttttgacagtcaccaagctacggcccagtactactagaagccagtacaaaacgtttaatattcagcacatgggtagctaaggctttgcatcattgcatgaaatggccgggagttacaatagtgaagataagatggtacactagtagcttattaagtaccatgcaattaatccacatggatgaatcatttgtccttgtcccagtaaacaaacaatacacacataagaaatattaacaataataatctaatgaagataaataatcacagtatatcatgcagatgcagctgggacgtgatcctggttgcgcctataaataggcacctcactctcccaacatctgcatagacgagtggaagaaagtagtaccgtctcttagcctcttgctttgctaatctcctcgactaaatctcgatgaaaagaagctagaaaaca

SEQ ID NO: 9378 - DNA, 1501 bp, Oryza sativa
tgatcgtctcttgctgcaggactaagcctagcaccagcacacacataatcaaactcttcacacctttcatgttttctagcttcttttcatcgagatttagtcgaggagattagcaaagcaagaggctaagagacggtactactttcttccactcgtctatgcagatgttgggagagtgaggtgcctatttataggcgcaaccaggatcacgtcccagctgcatctgcatgatatactgtgattatttatcttcattagattattattgttaatatttcttatgtgtgtattgtttgtttactgggacaaggacaaatgattcatccatgtggattaattgcatggtacttaataagctactagtgtaccatcttatcttcactattgtaactcccggccatttcatgcaatgatgcaaagccttagctacccatgtgctgaatattaaacgttttgtactggcttctagtagtactgggccgtagcttggtgactgtcaaaaagttttacacaagtagtaaattaatcaccatacaaataccacctgttcacaaacctgttgttgcttttaaaactagggcacgttttgtaacatacctgaattctaggattaaggaatttccatcaaaactagttgaaagggaagttcttcaattttgtaaaccaaaaatttccattttaaacctaggtggagttgatccaactcttgcatgataaaattttagaacaaattaaaaacctttgcatctctaacctaggacaaaaatataaatttatgtgtaagcatgcatactctcatagacatgtttgacttgagtccttcatatgcatttggattcggattgcatttggattttcgatttgcatttcataataggtctcatgaatattaactaagatctagataaacaactaaaccattagggcctagtgctagctagaggaagttaaaatagaaaccatacaccttaaaatatatcaacaaggccaatgtcaagccccacaaaactatttcggtcatccatctgaagactagtcatgaacatggaagtgaccaaataaattatatcatatagggtatattctatcttaatcatctctataagcattctcttaatttaatactaatgtaaacttatgcataataggtaaggagcttatgacctgtgtaatgtaaattgtaattctaacatatcaacatcacctcaggttaatgagagtccaaatataacttttataaacatttacatgcatttaggaaagggaagcatttataagatataagtcttgcgaattatctaaaataattcgtgcaagataaaatcatgggaaaattcatgtaggctctaatcaacacatgcaactcactgtaattttggtatgatttaataactaaatttggtacctcaaataaatcagtcaaactaataaaaactagattaactgtagttcttactcggctaaaaccatactttgtctaaaagtgcatttaactgcataa

SEQ ID NO: 9379 - DNA, 1501 bp, Oryza sativa
acattttaaaatacttgaaattttctcgaggattatatttacatcagatactactcatcctatatgtttgttctgcaggatccagatccagatatgcacaaaagggattcatggctttaagcttatctcttacgctccaggaatggatcagtcagaacatcaccaccggcttgtcgtcatcgccgccgactggtgtcttcgcctatacggttgtttggtcacaccaccattgttgggcgtctacgtcttcaccgaccggcttgccttcgccgccgccgactggtgtctccgcctgcagggctggcctattatgccgccgttgttgggcgtctacgttttcaccgaccggcttgccttcgtcgccgccgactcgtgttttcgcctgcacggctggcctattatgccgccgttgttgggcgtctacgtcttcaccgaccggccacctcgtccgccgccgactggtgtttccgcctgcacggctggcctattatgccgccgatgttaggcgtctacgtcttcaccgaccggccacctcgtcccccgccgactggtgtttccgcctgcacagctggcctgttatgacgccaactgatgctatcttcttcacagctggctacgtcgccgtcaccgctaatagacgtcatcatcttcaacgcaagctgtctacgtctgctgccgactagtttattcacttccatggctgcatgattctgccagtgttgattggccttatcgtcgtcatcgccggtcgtctcgtctgctgcttactagtgccatcgtctctacgtctggtttataccgctaccactactgatggacatcatcgtcttccatcgccgactagttatgccgtcgccgactgatgcttttatcttcacaactgcgcgtcttcactaccgatttgcttctgttgccgccgactcgtgttcactccattacggcaatgcaactttgtcatcatggtggagcgacttcatctttattatcttcggcaccggcaaactctattgctgctacttcgcaagttttgctacttcaccaaccacgacgtctttgtgaacctcgacatctcggcatgcgatgccgtgttattttactacaaaaagtggctctccaatattcaggatttctacttggacatcttcaacacatatcttcaatcaagcaatgactactcgacgacaagaagctataattctcgactctatgttcagttgtttcccaactaaccaaatagtcgggggctacacaaatacatggctcaaaattcgacaagctttatgtcaagatgaattaatcaattaatcagccaacgagtcaactctgggagtcatcaattttgtcttcgcttcagagcagtaggtcaagattaaatttacatgtctgggagtttggagtcatcaaccaatcaactcgtatcagattcaatgagttgaacaacagcatatactttcctctaagtgaagcatctgcaacagctatagcaccaagttctactgcc

SEQ ID NO: 9380 - DNA, 1501 bp, Oryza sativa
aacttggtgctatagctgttgcagatgcttcacttagaggaaagtatatgctgttgttcaactcattgaatctgatacgagttgattggttgatgactccaaactcccagacatgtaaatttaatcttgacctactgctctgaagcgaagacaaaattgatgactcccagagttgactcgttggctgattaattgattaattcatcttgacataaagcttgtcgaattttgagccatgtatttgtgtagcccccgactatttggttagttgggaaacaactgaacatagagtcgagaattatagcttcttgtcgtcgagtagtcattgcttgattgaagatatgtgttgaagatgtccaagtagaaatcctgaatattggagagccactttttgtagtaaaataacacggcatcgcatgccgagatgtcgaggttcacaaagacgtcgtggttggtgaagtagcaaaacttgcgaagtagcagcaatagagtttgccggtgccgaagataataaagatgaagtcgctccaccatgatgacaaagttgcattgccgtaatggagtgaacacgagtcggcggcaacagaagcaaatcggtagtgaagacgcgcagttgtgaagataaaagcatcagtcggcgacggcataactagtcggcgatggaagacgatgatgtccatcagtagtggtagcggtataaaccagacgtagagacgatggcactagtaagcagcagacgagacgaccggcgatgacgacgataaggccaatcaacactggcagaatcatgcagccatggaagtgaataaactagtcggcagcagacgtagacagcttgcgttgaagatgatgacgtctattagcggtgacggcgacgtagccagctgtgaagaagatagcatcagttggcgtcataacaggccagctgtgcaggcggaaacaccagtcggcgggggacgaggtggccggtcggtgaagacgtagacgcctaacatcggcggcataataggccagccgtgcaggcggaaacaccagtcggcggcggacgaggtggccggtcggtgaagacgtagacgcccaacaacggcggcataataggccagccgtgcaggcgaaaacacgagtcggcggcgacgaaggcaagccggtcggtgaaaacgtagacgcccaacaacggcggcataataggccagccctgcaggcggagacaccagtcggcggcggcgaaggcaagccggtcggtgaagacgtagacgcccaacaatggtggtgtgaccaaacaaccgtataggcgaagacaccagtcggcggcgatgacgacaagccggtggtgatgttctgactgatccattcctggagcgtaagagataagcttaaagccatgaatcccttttgtgcatatctggatctggatcctgcagaacaaacatataggatgagtagtatctgatgtaaatataatcctcgagaaaatttcaagtattttaaaatgtttataaat

SEQ ID NO: 9381 - DNA, 1501 bp, Oryza sativa
tttggtttactcacactgcagtggatgtacactttacccgcactccgcgactgcccaacacatgagcctcgtacccgctccatgaacttaaatcctcatgcactctaggcgtccatgtttctagcagtgagaggagttctggcactcccgggaaagagaagtctcacacacatattaaattatggttcaagttaagttctctctctcacacactcatggcagtcctaccgatggcgacaccgatgtagggcacgcctctcggccctacctcaatggttgtcccaccgtagcgcacctgcctcactcaggggtgaaccatctatgcagggatactgcctccgctcggctatctaatccgctaggtctatacccatacgagaagtacggttgtacaggggtcgtttcatgcttaacttcatggctcggtccttaattgatcggggacggtactagccttttccagataccacccaaatcctccgtccgccccagtcgaaaacagttgtttaattttatttctcctttcacaaatcatatcatcaacatcatggcaatgtggcgctcatgtctccacatgccgcatctcaattaccttcccaaaggtaattgcccaagcatatagcatttgataaatatgagtatgcataaatctagagtagcatttctaagcatttgtcatagttgactagggacttatacgtaaatcatggttacaaggatttaagggtaacaataatcaaggcaaggcataatcacaagtaggatgttcatcattgcatacaatttttatttgtaaataaaaataatttcggaattgggatcaacatgttcaaagaatagtgatgacttgccttgttcaaagtcttgcgggtcttggccttcacttggatccgcaactccctcgggctctatagttacgtgcgaaaattgatttgaattcggttagaattcaaataaaaatccaaataaatccaaatggaagtcgaatgcgaaagtcgactcttttatattaacttcactattcgcgaactagggcaaacccaatctcgatttatacatcctaaacaatttttgcgggtataaatattttgttatctgtcggtgacatggggccgggggtatcgtgactagaggcttgggtagccgcggtcacccacgtggcctgaccccctctggggggtcgggcccgagggtgacgtggccgcccctccctcagtctccccgaggggtcgggccactcctgtttcggccccgagggctggggcaccccgaccccctgtggtgttggcgccacgtgtgtgggttaggtgagcacagtggcgctcacctaaccgcatttatagcgggttagacgagcgcgccacgccgcattcaatgcggcgcagcgcatgcttatccggtctatgaccagtcgcggtatgtgaccggtcacagaccggtcagatcgcgggttaggtggcaacaggcggcctgtcgcacgcctcgccccgtcccgtcggaa

SEQ ID NO: 9382 - DNA, 594 bp, Oryza sativa
cttaaaaaaacaaccaagtgatgatacagcgcccggagagaattctccaaaacccagcgacaatgagcactaccaatacccaccccaatcacaacgcgccccccactccaacaccgccactaccgcgcgcgtcaaaaccaccatccaccgaagcacgcacatacagagagggagagagagagagagcaggcagtacctcgaggttgaagagggtggagtaggagagcccgccgccgttggcggcggcgcccccgcgcgacggagggcgccgcgggtccatcccgaaaccctaccgcgcccccgcccccacgcgcgcagagacgcaagcaggaagagggagaaccaggaggagccggcggccgcgggcgcacgcgaggtcccccgggagggaccgcggcggagggtggagtcgagcccccgcagcggcgggcggcggcggggagggaggcgtggagattagggttaggttttggggagcggagggggggagagaagggggggacggagaggagggagaaggaggcggtggggagggggggctgcgggatgttgtggtggggagtagtagtagtagtagtagtagtagagaaggca

SEQ ID NO: 9383 - DNA, 189 bp, Oryza sativa
ccctcctccccccaccaaacccccgcctcttgctccggtttcagtttcatcgctcaattccatatatgctgtctgatatctctcttcagacttcagaggggatgatcaatgtactatttccttttttttttctgaaaaaaaaaaagaaataactaagaatgaatctaatgctttcgatcctattgcagc

SEQ ID NO: 9384 - DNA, 1501 bp, Oryza sativa
taaatctggacggagggagtacttccttcgtaaagattgacgttgcagagattaagagacaaaatagctcatagggtaaaattaaatcggcctccatatttaatcagctgatgttaaatgcttgttaaacaacaatgaattaatgagcatggactcaattcaaattagtggaccagaatgatccaaggaaaaactagatgataccacaaagctgaaatgatcaccttttagggacattttgaaggctgtaaaacgacatcttatgagaacataggaagtaccgaagtaatagaatacgtgtaatctgatcttagtttctctcggtccaaaatataaaaaactagtattgaatgagatacatctactacaggaaacttgtctaggttcgtagcatgtgttccactcataacaatatatttcaagacgaaggtattacattaataataataataataataataataataataataataataataataataataatgtgaaagggcatgtaccccagtagttataagagtctcagtgataccttaggttctggcttcgactccccatgggagtgaatttaaatttttcaggatttaacggtgctttcagtggtaggcgacgtacccgtcgacagcgaatttgaattttccatgatttaacggctttgtgctttcagtggtaggcgacgtacccgttgatagcgaggcataatagtgtcctatctattcaggatttaatagctttgtgcttttaataatagacggcgtacccgtcgacagcagttttgtgcttttagtgatatacagcgtaatagtgtcctatctattcgtgtggaatataacgcgtactaaatcactagagtgaggagacaaaccacaccaactgacaccaacatcattttctctcgacaagtctcgagtgacgccaagttgccaactgtgactcgtacactctacagtctccgcggtagaactgtagagctccgctacacggcaaattccgtgcgttgcgcgtgagagactgaccgtgcacgagcccgatccggacccgaccggctggaagctgcctcggcctcgctccacaccgcgtcccggccggcccggctcgctcgtagcttcctctcatatgatttgaggctatccataatccattccacttctataaatcccaagcgcccactactctccttccactacccatcactcccccaagattccacggatattttctctccccctgctcccgtcgccatcgcaaaggagaaaaaaaaaaggtgagcaatcgcttctctgctcgctcggctcagatctgcgtgtgtacgctggtagatctgtggaaagaggttcaattttttgagcccagttcgcgatctgcggttccgcgagagtgaacggatcttccggatcgtggaaattcatcgtttgcttttcttttttttttttgtttcttctttggatgtgtctccgatctgaatccgcttgatctggacagaggaggaaggaag

SEQ ID NO: 9385 - DNA, 1501 bp, Oryza sativa
ccccgcggcgcgtcgccgcccttgggagacaccaggctcagcgccttgagcaccgcatctgcacacacacatgggagacatggcgatgaatttcactgcaattctcgttttagactcgatcttttgatgatcaacaaagcgagcaagcgagtgagtcagtcggtaccagtcttgagagcggcgggcggctgcgggggatcgacgaggaggttatgggtctggtcgaagaagaggtcgtcgtcgtcgtcgtcgtcgaaggcgtcgtcggggaggaggccggcgaggtcgtcgtcgtcggcggcggcgtcgtggagggcgagggagtcggccatctcgtcgagctgctggtgctcgtggaaccagtggtcgcggaaccaggcggtggtcttgacgaggtcccaccactgcggcgagaagtcctccacctgccggaacgccgccgggatgaagagcggcgcgtccgggttcagcgacgacaccgccgtggcgctcatccttccttccttcctcctctgtccagatcaagcggattcagatcggagacacatccaaagaagaaacaaaaaaaaaaaagaaaagcaaacgatgaatttccacgatccggaagatccgttcactctcgcggaaccgcagatcgcgaactgggctcaaaaaattgaacctctttccacagatctaccagcgtacacacgcagatctgagccgagcgagcagagaagcgattgctcaccttttttttttctcctttgcgatggcgacgggagcagggggagagaaaatatccgtggaatcttgggggagtgatgggtagtggaaggagagtagtgggcgcttgggatttatagaagtggaatggattatggatagcctcaaatcatatgagaggaagctacgagcgagccgggccggccgggacgcggtgtggagcgaggccgaggcagcttccagccggtcgggtccggatcgggctcgtgcacggtcagtctctcacgcgcaacgcacggaatttgccgtgtagcggagctctacagttctaccgcggagactgtagagtgtacgagtcacagttggcaacttggcgtcactcgagacttgtcgagagaaaatgatgttggtgtcagttggtgtggtttgtctcctcactctagtgatttagtacgcgttatattccacacgaatagataggacactattacgctgtatatcactaaaagcacaaaactgctgtcgacgggtacgccgtctattattaaaagcacaaagctattaaatcctgaatagataggacactattatgcctcgctatcaacgggtacgtcgcctaccactgaaagcacaaagccgttaaatcatggaaaattcaaattcgctgtcgacgggtacgtcgcctaccactgaaagcaccgttaaatcctgaaaaatttaaattcactcccatggggagtcgaagccagaacctaaggtatcactgagactcttataactactggggtacatgccc

SEQ ID NO: 9386 - DNA, 1501 bp, Oryza sativa
atcatccatcgcaaatagaaccacccgactagatctaaacctaggtgatccaatagacaaccctaacaatggtatcagagccatcctagcgtttagattggttggggaaagaaatccaaaagaaaggcaaagaaaagcaaacgatccaacggatcgaaaagatcgaaaccctaaccctaatcttacctcgtcgccggccgtcgttgacgccggccacggagggggagaggggcaaagaggcaccgccgaggagccactcgacagccgcgtgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagggcgtcggccatggcgcggcggcgcgaaggctgccggcgtcggcgacgccgctcggcacggcgcacgcccgcaagagaaaggagagggcgtcgcggcacaaccgctcgacggcggcgcactcacccttgagtgagtgcgcgcatcggcgaaggggagtgcgacggcgccgccgtgtcgccatgccgccgccggcgctgtgctagggttttcggcgacggcgacgccgctccgtgcaaccgcaagagaaagaagagaagaggagctagggtttcggcgccggcggccgggggcggttttgtttgcccgatccgccgcgcgaccgtccgatcgaaaccctagcgatcggacggccgacggcggccggaccgaaatcggcccatgtgggagcgcacggcgagccactttcccggcccaggcccaggttgcggcctggggaaaggggagggggcgcccgcccgcgcgcaaggcggccgtgggccgactggcaaaggccgaaaaagttcattttaggtccctcggggccgaatcaaaagaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatattttcatgcaaattacaatagaattttgaattgtttttacatgttttatctctgtttaaatttgaaccaacgggagaattttacagagcgtaaacaacagagttttgttacaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctact

SEQ ID NO: 9387 - DNA, 1501 bp, Oryza sativa
aaatggatttacatattgcaagcaaagtgcaaagcaaacgatttaatgaactggaaattgattatccatctattttctgacaccttaaaccgatcatgttgagttgttttcatcacataggagtagggcgagggattataatccaaataaggagaggccgagaaagaaatgtggagatgagagttgggggtagactattcctcttcaccaagaaggtgcaggcccttcttgtctgcttcgtctgcctcatacttgagggtgctgaccacttttgtttcatggctgtggtcatgagaacaatttcgtttttctagaggagtattttttacctggcctctacattcaactggacatatgcaacctttttaaattaaaaaattagctcctaaaacaattcagaaatttaattctatgaaaatttaaactcaataccttagggtgctattcaattcactgcaaccactgaactacatgagcacaatctcctaccgtggcatgggagaaggccaatgtgcagaggatgcagcaggcagtggcaagtgtgagtggcatttcggggatgatgaggagcgatggctcgttggaccccatttaagtgtggttcattttttctaggttgggcggttttcatttgtgtcggtctatttttggtcagagcagtttccatgtgatacattgggtatggtggtcgaggggatgacatgaacagaactctatcttttaacagtagaggtgaataaatactatttgcattaattagttacttggatagaaaccataagttagtaactcctcgaatgaaataattaaagagagaagaggagcaagaggaaagtcacctaagagcatcatgtgcgcgatcattccatgatccacattaaactgtgtggaattgcaatgttttgaaaagttcaaattaacatttttgtttgataaattactttgaactgggtttaagctttaatgacgtcaagatgaatggatggaatacgtagtactgacccttattgcaccagcaagtacatctaattaatgcattgcctgtcatcatttattgtattttttttgccaatcaattgctcagttatagtttaaaggtaaaatatacagtgatgaaaattcattaatttcttttctttgcgaggaaaaattcattaattttgacacaagcagagagagcacaccacccaagttatctttgcctgaatcacatcatctctccagataatgcaaatttctttttaagactccatgtgggacacattaattctcatcactaaaaaaacataaaagtcatcaagtaaataaggcaaacaccttgaaattaaggtgaaaatcagtaagaatatgttcttttgataagattaaaaaaacgtgtctattactcgccttttcctctatatatagcccattcatcacctctctgtataaactcatccaatgatccctccattctccacacctcaaagcctctcttcctccaaagaagcgtagaaagcaa

SEQ ID NO: 9388 - DNA, 712 bp, Oryza sativa
catgcttttgttcattttttccccatttagtaacacctgtttggcatatgctattcaaactctttgaatagttgcaaatcaccgtgttattaatgttctcaagatgattgggaaaatctatccccattgggacaataaaccaaccatagggcccaccccttattagattcagtgcaaaaaccttactacttttattgagttaagacttgattcatgattggttgatttctggttctgccaattatcaaggagtttatgtagtgtattattgaaaaacttaagaaaacaacctcaaaaaagtacgaagcttatttctcctgtttgtttttgagattttgcctagttcattttatggtttgcattagaaaacgtatcatcatgaaagcatttggaaacctttcattggtttatggaagagtttggcgaccaactttttttcttgttggtattgtactataacaattgttacacatgtcatcttattacatgttattaggttttacatgctgtagaacaacaaaccttgaattaaaattgctgcagtaatatggcaaaagatgaggttgtttgaattggtttcttaatagaatgtccgttgagttttcgttataatgaaatattgagtatggcatggaatgtcaacatgttttatttaatttcaatggaaaaaagtcgggtgacaatgtttttcatttctatttacccttttagg

SEQ ID NO: 9389 - DNA, 1501 bp, Oryza sativa; identical to SEQ ID NO: 6312

SEQ ID NO: 9390 - DNA, 1501 bp, Oryza sativa
aatcgagctgcctccgagtgcataaacaacaagcagagtcgcccactcgccaccgccaagtccagtttctctattccccagctgtcgcgcgcacgaggcgccggtggggatcccgaggaaggagagcacgtcacgactcacgacgtggacgcgcgtgagatccctccattctttttgtgactcgtaggtggacttcccctcgtgcgcccgcgcgccaggaacgcgcatagccgcagatggccgcgccgcgtcctcggctcggcaatttgctcgcgatcgccatcacccctcccgtccgtgcgtccgcgggaaacttcccttgcgaatcgcgtgcccgtccgtcctccgcccgcggccccgcccgcccgtgtgtggcgccgcgcgttttctgcgcacgcgcgaggcgtttgctgcagcgacagtgcacagcgctcggagacgccgacgtaggtagttgtatactaccatgaaggcactgcttgtaaatatctgagtgactgtgtctatggcatctgcttttgctatgcggtttagcgtgtcacgctcggtccaacggatcgatcgatcatgcgcttttcgtcatccaaaatcattacgatttagacgagcaacaatgcaacactagtagtagtccttgactccttgcagtactaagagcacccgcaatggtaaagtaagatgttctctataaaacatgtacatctcagcaatagactagattaaagtaaactacctcaatagtatgtctatatgggtatctataactctctaatgcattgcctcgtttttttttctataaactatctccaggttagtagatagctttgctctctcttcatttaatctctttcaagtaggaaaatatgctgacatggatctcttgtagagagcctatagataatcattgcgggtgccctaatgaaacggaatctggtcctttttgctgcccttcctgggacgcaccacggcagaaaaaagggtcaaaagagccgcgggcatcatgcagtagtactaagcagcacaaacctgtgtctgtgtttgtccgtccattcgctttgcacaaacctgtgtctgtgtttgtccgtccattcgctttcgttgacctctagctctaatcaagccattttgcggtgaccactcggggagttggggacaaatagctactgcccctctatttcaggttataagatattttgactatggttaaaattgaactgttttaagtttgactatgtttatagacaaatatagtaatatttataatactaaattagtttcatcaaatcaataattaaatatattttcataataattcttcttgggttaaaattgttactatttttctctacaaacttaatcaaatttaaagcactttcgtcttataccctaacctgaaacgcagggagtactaggcaagtgtgcagcagcatcgcatatgccagatggttaatgccacaccatttgcctgcagcagctcggctgaaacatgccagcgatctag

SEQ ID NO: 9391 - DNA, 1501 bp, Oryza sativa
tctctctcccggccggagcaagcgacgggtggggcgagccgcggccggagcaggccggcggagcggcggcggccggatcaggcgaggggcaaggcggtgctccacgctctccctcttcttcctcatcgcgccgtcttcgggcgcttctcgcgccacggcgctcgcctcacagccggcggagtggtggcggagcggagggacgggtggagcggcggggcggcggcagaccgcggggtgagcggaggggcaggcggagcgccggcggcagcaggccacgggcggcggaggtggccgggggaggaggtcgccggcgagcgcggcagctccactccgtcggccgctccgcccgccatgggtctggacatcacctcgccggggaggttgagggtgtagtcggtggtgccggcgccgacgaggagttgcgccactcgttgctgaagttctcacggaggaagtcctcgaacacctaacgtgggatgtgcgtcacgcccggctccaccacccgcaccggccgcccgtacggtgtcctccccaccggcagcgactggatcccgccgccgtacaagtacttgttcccgtacaccagcacgcccgtatgcctacacaacaaatcagattgagccaaacccaaatccaaaaatccaaatcgtttagaccagaataaacaaacagatctggaacaggatttactcaccagatggcctcgattggcttgcggaggaaggaggtggagagctgccgcgcgaggctgttgctcaggtcgtacacgttcagaacacccttgcccagagggaggagaaagggaggcagaggacgaggtcgccggcgagcgcggcagcaacactccgtcggccgctccgcccgcgatgcgcagcagaacggcgccgcccctcctcgcccggcgtcacccggcggagaggacagaggagaggggagagagagtgaatacagggagttgggggagagaggaggaagaagaggaaggtgagaatgacacgtgggtcccatcattttaaatctatttttttaactgacatgtgggttcctaatttttaatattttctaaatcaaattgccaagtaagcgccacgttattaccaagactgagtctaaatagtcacgtaggtgccacgtcagcgaaaaccaccatctaaaccaccgccatggacatatattgcaccggttttgacagttgatggacctgttgtatctggtttttcggttgaaggatgaaaatcggattcggtaagttaagggacctcggatgatcttatgccttttccttcccttttctcacgcggtcacgcctgatttctagcgaaaccgaccagaatccctattgggccgggccgcaacaccgtgtcacatccgatctctccccttcctttataaaagcaccagaatcctagaccacgattcctcctaacaaaccctacgtgataactcccggtgcatcgtgttacgtcgcacaaccatcgcagaagagctccccggaacggaa

SEQ ID NO: 9392 - DNA, 1501 bp, Oryza sativa
tgatcttccctccctgccaacctgccgcttaccatcttcaatatttttcttcatccctccatatcaacaaagttccagggccatgcgagaaagtgaggcacaaatgcacaatctgctggaggctgaagctttcacaacacctatcatccaaccgcaatgttagtatctccatctcctcatcctatccccaagaccccaaccacacgtctacaccccctcttcagaacacacgctttttcgttggcacgtccaaactccaataagcaacataaatgctaatagtaccaattgcacgatgaacttcatgattctacttacggagtactacgtgataacaacaggaaatttaaaattcattttggagatggaaaatcaaaatctagtacgatactactagcaatccattttctataaagtagcaattgaattgaccttatatggcattggtcgagccagaaaatcttcatcagatcacacgcggagctgaggctgttgcccctctttccggtagtagtaccactctagaacgaaagttcatacgtcaccgacagtgtaattccacagaaatacgtctaaatcgctgcgaattttcaaaggaatctcaaaagtaatcaatgactcgcaactcgcgaaaaccataccaagagcaagcaacaagccaacaacccacacaggaacaaccggggagaagcgtgaaaatttggaaacagggttgcacgagtggccgagccaatcggcgatgtcatcacctgctcctcgctgatgagctcgtggagccgcaccttgagctcgggcccgtgcctaccgccgctccgcgagttgacgaacaccaccaccggcgtcacggccgcctccacctccacctccacctccccctcctcgcccctctccgccgccgccgccacgccgacggcctcgtccttggccttcacggcggccgcgaccgcacgccgcgcgtacagcggcatgacgacctgcctccgcagctcggccttgtccacctccttcccccacaccccgcacgcgcgcaccgactcccagatcgacaccctcgccgacggcgccgtcgacggcgccctcggcgtctcctccgctcgctccatcaccggaactactccgtatcactcgcagccgcagctaagcaagagcagcttcgaaatcccctctcctatggcgagctatggcgagctggagtttttttttttggcccgagatgaaattgggggaaaaaacgtgccgactttttttttcagtgggtttatatagaggagatgagttttgactacaccgatttgcgcgttgctttattgctgtgtgtgctgctgctttgcatcttcttggggtgccaatagcgcgtgaccgttacgtctggccggggatggatttcaggagagaatggaaaggacacgaatgatgatggtgtttttttgctctgtcacgactcacgtccaggtttgctgattttgacgctgtctcgcccgtttttacaacctacggaaaa

SEQ ID NO: 9393 - DNA, 1501 bp, Oryza sativa
gcggcgcccttgtccagtgcggggatgagtggatcttccgatttgctccctgcagtgtagaacagttagcgaataaagatttgcatgcagaattgggtgtatgtttagaatttatattcctcggatagatattctatacatgaatagtttaaatatcacactgtatttttagaacggatcggaattgctacaaaacttagtatcccttttatgtcgaaaagaaaaggaattagtatatcctttgttcagtctcagatatactacatggcctagtctaaatagatctgtaacacgtatctatacacggctaacatgaaaaagacaaattcaaaaaaaaaaacgatcaatccattgttgcagattgatctagcaaagttgcaattaacgagcaacgtatatacgtagtactagtgaagaagagactactgctatacctggtgcgcttggacgctcgagaacgatctcctcgggggagaccacggtgaggcgcgcgccggcgtcgtcgttgtgcgcggcgtcgccgaacttggcccagccgcggcgctcggcggcgcgcttggtgacgcgcgtgcgcgcgacctcgcggacgcgggtggtggtggtcacccgcaccgctttcccctcctcgttgagccggtactcgacggttttcttgatcccgttctcgtccggcccgatgaccacgcggggcgggagctgcagggcgctgaggccgccgccgccgccgccgccgtagtcgtcgtcctcgtcgaggtcgctccaccgcatcgtctggtgcttagccgtcgtcgccgccatgattccgttccggggagctcttctgcgatggttgtgcgacgtaacacgatgcaccgggagttatcacgtagggtttgttaggaggaatcgtggtctaggattctggtgcttttataaaggaaggggagagatcggatgtgacacggtgttgcggcccggcccaatagggattctggtcggtttcgctagaaatcaggcgtgaccgcgtgagaaaagggaaggaaaaggcataagatcatccgaggtcccttaacttaccgaatccgattttcatccttcaaccgaaaaaccagatacaacaggtccatcaactgtcaaaaccggtgcaatatatgtccatggcggtggtttagatggtggttttcgctgacgtggcacctacgtgactatttagactcagtcttggtaataacgtggcgcttacttggcaatttgatttagaaaatattaaaaattaggaacccacatgtcagttaaaaaaatagatttaaaatgatgggacccacgtgtcattctcaccttcctcttcttcctcctctctcccccaactccctgtattcactctctctcccctctcctctgtcctctccgccgggtgacgccgggcgaggaggggcggcgccgttctgctgcgcatcgcgggcggagcggccgacggagtgttgctgccgcgctcgccggcgacctcgtcctctgcctccct

SEQ ID NO: 9394 - DNA, 1501 bp, Oryza sativa
aatcaacctttgggcgcaaaagagtataaagtatagttttaatattgtggcaccacaccttccacatattttccttcctttaacttgttctataccaatgataatgacggtaaaaagtttcacctcttcgagaagttattgattttatcaaacaaatagaaaatgtatctattaatctataattaaatctctctacttccactgtaaaaaactcaaacttttgaaacaacctgctgtgcaaagctttatattaatacagaaagggaaaaggtaacactgcaaccctgaaaaactataacaagaaaagaacaaaacaaacacacaacccaagagaaggctctagtatcaaatcgaccgctattgagcatgaccgatcgccgctagaactataggggtcgcacacacccttccaaactcaaattccacataggaggtcgttgacggtctcccgattatcatcacgtataaggattggggagaggttgaggacgagagagaccgctattgagcatgaccgatcgccgctagaactatagggggtcgcacatacctctccaaacgcaaattctacacaggaggtcgttgacggtctcccaatcatatcacgtataagcattggggagagggagaggacgagagagaagaagatccactcgtccctcgagccaacctgacgacaacaaccaaaataaggccaaggaccaagctggaggaagggcggcaatgagcgatgaatacttcataggcaacgtcttcaaggaggtcatgacaccaaatggcaccactgtcgcatgtctagatgaatcgggttttcacccagagagtcttaccatgaagagggggttggtagctccacaacactttaaaggggatttcacaacattcagagatgtcatatttgctggctaaaaaaaaagaaatcaatttttaatttttgtatgtatgaatctatatataaaacaacttggtttattttaggatcgaggagatactatactttgaagatggctctttcgagttcatactatttcgaaatattggattttttttctaaaaaagtataacaaaattctgtaaatattgtaaactcttagcactgtattccggaccaaatataagattttccgtaggttgtaaaaacgggcgagacagcgtcaaaatcagcaaacctggacgtgagtcgtgacagagcaaaaaaacaccatcatcattcgtgtcctttccattctctcctgaaatccatccccggccagacgtaacggtcacgcgctattggcaccccaagaagatgcaaagcagcagcacacacagcaataaagcaacgcgcaaatcggtgtagtcaaaactcatctcctctatataaacccactgaaaaaaaaagtcggcacgttttttcccccaatttcatctcgggccaaaaaaaaaaactccagctcgccatagctcgccataggagaggggatttcgaagctgctcttgcttagctgcggctgcgagtgat

SEQ ID NO: 9395 - DNA, 1501 bp, Oryza sativa
tatgtcctagatttccaagcgaccgggtaggtatacacattaaaatgttctgttagatcgaaatttccaactaccataaaaaaagttttcttctcagcagactgtgtagaatattcagatgctcgttccattttagagcggaagattctgtctgcttttcttgactttttgcaataagacatcctcttcagagcaaggtaatcaaggactcaaggtcttcatagcaaggtacaggcagcattgttccaatacttctgtaatcggaactcacaagccaagggcacgtttgatctagattatggaacggattattactacggattatttatttattatattagggtaagttaaatattttgagaaaaaaaaacattgacaaataaccaatgcacgcatgaagcgaataattcaatgagactaagctaagaataacagagccaaggaagagagaactggaattctgcacgtttgagagctcaaaatccatgcccacattgtcaaacatacacctgttccaaagcgcgtacccactgatggcaactgttaaactagctccaattgttttgtagcccatcagctcgtcattgtaaaatcgcagcatattacttacagtttacagcacatatcatctggtgtaggcattaactgcaactcgagtcattttcttcttctcaatcagagtcaactgaccaacacataagcccagaccaaataaagattaagaagtatagacaaagaggaaaaagaaatgattaacatcaccattggcttcggtaatcggtagctcggtcgctgagttttccccgtacagaccatatgtcccgcgacctcgagtcctcctttccaccgacccttccgaccggttcttccggtgccacgcactcaccgagcagcgcagcaaggtcaagtcaacaatgcaagcgacggaaaagtcccgtattatttttagaaacacaaacacagcacttataacacacactcacctatataaacacagcccccccccctatcagcatatcttgaaattgacgaagttaccacgagcatttcgtcgaggctagggtgacatatcttaagattgatgaagtcaccacgaacgcctcgctgtcgacgagtacgttttctaccccactgaaagaataattatatgcgcatatatttatattaacgaattcatcataggtatctcattgagactagaccgacatattttgagattgacaaagttatcatggatgtcttgctgtcgacgggtatatcgtttattactgaaaaaataattagcattcgtgtcaaatttagaacttaatcggatggactagttgaaaaaaaaactatcccgtaaaatttttatccgtatataaagctactgccgcgttggactgcggcggcagcgcacggcgagagccagaaaaatctgcaactgctagtgcgagtgcaagtggtggttgctgagagcctgatattgtgatgcgggtgtagatggcgaggcggtcctgct

SEQ ID NO: 9396 - DNA, 1501 bp, Oryza sativa
gcggcaacgtacgttgacgtgttcgttctcgctctcgttcgttcgatcgttctcgttctcgttcgttaacggcggtgtggcggcatcggggcggcggttggcgcggcggcgtggcggcggcggcggcggcggcggcgtggcgacggcggcggcggcgtggcgttgcggggccgtggcggtggcggcgtggcgtggcggcggcggcattgcgcgcgtggcggcgaaggcggcggcggcgtggcgttggcatgcggcggcggcgttgcgcggcggtgaaggcggcggcgtggcgcgtcgtcgtcgtggcgcggcgtctcgtggcgggcggcgcaacggagagagatcgagatcggagagattgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaatgtctaagtgttggtgaagaagacgagggcgcaccgggaatatatatacccccggatctttactcccggttgttgagaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtgataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccata

SEQ ID NO: 9397 - DNA, 1489 bp, Oryza sativa
tgaaacgaagggagtatctgacttgtatggtctttagctatatttcatccaatctacacgccgttctcatcaaatatgtagctattggaagcacatgcttctctttttaatttattacgtttaattaatcggtcagtttaaaaagaagcatacatcagcactataaattatggggaaaagaagtccttgaaggtggtggtgtccgaaactcagcgtcgagatgaatggctaacgtccgttggcaataaagtactgcatgttgttttttggccaggccagcaccgtaccacacgtaggccgtgctagcctgttagggttgttagaagtataatatattagttagagataagagtcaaaaataaattatagagataaaatatattctagagatagaatcctagagataagaatagagttctagagatagaatcctagagataaatctactcttacatgtattgtatttcaagtctctatctcctatgtactcctatatatacctcatgagagggtcgatgtaatatatcaaaaaatatcagaatacaacatattagatttttcacaagggcatcgactgccatcgatggagaaaaccatacaccaccagcattgttactataggagaagacctcaccgatcaaagaagaaaccgtaattccttcactattaaattggcctaggatcaatgggccacatgtggtgactgcgttttattcatccaacacctaagaagcaatctaatccaatgatccaacggctaaaaattgatgataatgtggaacattaatgtttgagatttagtatcttaattgtagttagtggatcatactataactttatagtagtaagaatggatttatcttctttcacgtgctccgatgaggtctatctcggactcgggccgcctccccatggatgattcggccccagctccggcgatgactcgacaaaacgcgcgcggctgcgaacacatacctctacgccgcctccaacgttaattcgcgtctcggcgtaacatgtttactcagctatatctagtctgaaagaaaacccaagattcagagaaagcatgtgttacgcggctacaaaagaaaaaaaaaggtctgtggaaatgttcaggctgtagagatgagaaaatggacaatataccactttataggttgggttgggcgcaacatgtttactcctgtagtaacacaaacggagtacgcaacaacagcagaggcaccagatgcatgtaacatgttggttaaattgtgatgaacttaatgtaacatattggttgatgaacttgatcgacgtacttacttgaatagagaggcaaagcaggagttgttcaggttacacggattggcggtatattattcagtttcccgagctttattctgtgtttcaaaaagtaggtgctgactttgcacctcaacaggggtatagttaactttgcaccgatctgacatttaggtgttgtttaagtttggagttttctgga

SEQ ID NO: 9398 - DNA, 1501 bp, Oryza sativa
tcccctcgccggcctatatgatgcaaacacataggtgtcggttcgtttaaataaccgccacctttcgtataggtgccggtttttgtccacggccgccacctatgcaatttttggaccgttggcgggagtatttttagtgccggtttttgataaaaaccggtaccaatgaccttcccaacaaaaaccgacacctattaattgttataagtgccggttttttgctacattgacaggaaatgacttataggtgtcggtttttggctaaccggcacctttgtgaccgacacttatgggtgtttttttagtagtgtcaaggaccataaatttactcttctcgtgaagcctagctaccatctttctctgtacctacacagggtatataactgtctcttgctttctgctttctgaataggagcaaatgttgaagagaggatgtgcctgccactgcactgcctataatcaacgcccggagctggcttaggtaagtagtatatttgaggccatacaattacaccgacagacaacgatcatttgactgaaagacagcctgaacattcatgtcatgtatgctaagtgaaaacctttgggttttttttttcaaaaaaagaaaaatctgtcagtagagaaacaggcgcagtagtctgggcggaagggcttgtgggcttcgtcgagaccacggaatggaggaggggacaagcgcaatggtacagcatgaacaggaactaaccatgaacaccaggtgattgatttattagtaatactagcttgtatagtgtgtacattaacactagtgtatactccctccgtcctaaaataaataaaataatttgtctcttaaatacccttcacctatccattcaccaatacaacttttgtattaatcaggggcaatttggtcctttaacttcctccttaactttacattgggaagctagggtaagagggagtaaggcacaggggttgtcaaggaacaaggtctcattgattgggtgcagtgtatgtgttctagctagctagttaactgcatagggtgatttgtttgttgtaattgtattcgagaattgtattgttgtaaaactgaaatctggctgagcatgtcctagtgaattcaatgttgttcaggaacttaatgaaactaaatatatattgtaattttatagaattaatcgatcgtagttgacctcgagatctacgtaacatgttttacaagtaaaactgattcttatactctacacttaaaagctccaggatcgatcaatcacacagttaataatggagatcgagattattgattagtgcgtgaatatttctctaggaccatgcaagtaaggaagcatcgaagcagtagttgacgcgaagttttgaaaattactcctccataagtcccattagatatatatgtgtgtgcctgactgactatgtaaaggcaacatcacgtagatgaaaaggggacagagctagagagacgggagctagcccactgtaattcgatcgtagacga

SEQ ID NO: 9399 - DNA, 221 bp, Oryza sativa
gatactatctggggctgatggatggtgtagtggtgatgtataggatcctatggcattcattccaagctacctgatgttgaatagtagatgagagaaataatgcgaatattgcacgtgttatattgagcttcagaggccgatatatatagtagtacatgggaagagataaggaaggattacaaatatagaaggagtccacacaaatcaatcatatcctaata

SEQ ID NO: 9400 - DNA, 359 bp, Oryza sativa
gtatgtgcacttggtatttcagctatgaattcatttgtactagactacttgatctagggaaatggtactgtttacacgattgattcctgttataaaaataggggtccacagagctggtatcagagccatacgactgtaggaaaagaccaaaaggcgccccaccccttttctaagttggccaaggaaaaattcccatttagtaatactttcaaaaataaaaacgctatgtttacaaaactctatacgattttcatcttactcttaactattttcttcacaaaacgagttttactcttagctgaccttgggtttttcttaaaattcgatggcagatcaggattcacccgctacctgggaga

SEQ ID NO: 9401 - DNA, 1501 bp, Oryza sativa
gttttataaaaagaaaaaccctaaaaagtcttctttttcccccttcccttcttgggccggctcggcccagttctcaccctctctctcctctcccccgcggcccatcggctcttcccccgcgcgcgcgccgctgaggggcgggcccgcccgccaccctcgctgacgggtggggcccacccgtcatcccctacctcgcgccacacccgctgcccgcccgtgccctagcgccgccgccgccgccgaatccgccgcatcccgccgtccccgcgcgccataaagagggggaaatcactccccgtgattccctccctctttcccccacttttccctctctctcacaccctcggattcgttcggatttactcccgcgaacttcgccggcgcatcaatggagcccgagatcgccgcgccggtttccttcccctccggccgccctctctcactcccaacgctatttaaacgctccccgtgcctccctcctccgtttccgccactcgccgctttctctccccgtcggaatcgagcccgcgccgtcgtcctctctctccgccgtcgccgccgagctccggtcggccgcggctgctaggtggggcccggccgtcagccgcccgctccctcgggtgcggctgacgcatgggacccacggcgccggccggcgcaagccgcgtgcacccggtccaccgtggaccgtgaggctgccgcgtgggccccactcccgtggacccggtccgcgcgccctctctcccggctgacgcaataaatccgatttttaattaaaatttaaatgaagaaattcgcaaatatccatttaaagagcatataaacttcaaatagccataacttggccatttgaactcggaattggaccgttcaagtctctaatttttccttatgaagccaaaaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcacgcgttatcactgttttatctagccatgcctatttacctttgttatgaccttattattattgttattgttattattaccttgttcaccctagaataaacaaaacctcaactagtggacactctactcatggcaccactagtttaattttaggtagatgcttcgcaatttaattaggtaacattaggtggtttttcaactatagactttgggaaatattcatatcacctggatactttggaatggtctggttattgtggaattggattcacaccgctccttctattcaaaatccccaaaatggttttaggctgggctcggggtgcatggttttgatagtagcacctcggccatataaggaccggt

SEQ ID NO: 9402 - DNA, 347 bp, Oryza sativa
gcctcacgccccgagccgccgcgccgccatcccgccgccccgcgcgcccacgcgccccgtcaccgctcgtcccgtcgccgtgcgcgttccatcgccgcctcgagcccgtgccacagtcgccgtcaccatcccatcaccgcgcgccgagcctcgcgccgccatcacgtcggcgcccgtcgcgtcaccgtcgtcgcatcaccgccctgagcccccgcgccgccgtcgtgtcaggccggccaccccttcccctctctttcttccccctctcccctataaatactccacaccccctctccatttcccccactccatctccctctttctcccctcttccctctccaccgagc

SEQ ID NO: 9403 - DNA, 1501 bp, Oryza sativa
attaaccatcggctgaagaaagcaaaaccaagacaggaattgcgtgttaagaatcagattcctatagccgatgatgttgtagccgatgaggcaaagaggttggcaaaagggaagagtgttgtagtggcaccaattaacatggtttttacattgccagccgaatttgggattgatcaagccgatgtagacaaggtggaagaggaatcggctaagttggttgtcaccagaacaagcagtgttcgagaaacctgaggggacagagaatcggcatcttaaaccattgtatataaacggttatgtcaatgggaagccgatgcctaagatgatggtagatggtggggctgcagtaaacttgatgccttatgctacattcaagaaattgggtaggaacgccgaaaacctcatcaagacaaacatggtgcttaaagactttggtggcaatccatcagaaaccaaaggggttctgaacgtggagttgacagtcggcagtaaaaccatccctacaacattctttgtcatcgatgggaagggttcttatagcttgttgcttggaagggattggattcatgctaattgttgtattccttcgaccatgcaccaatgcttgattcaatggcaaggcaacaagatagagatcgtaccagccgacaggtcagtcaatgttgcttgtgccgatttagctctttgggagatggatggccttgattgtttatctggaaaagtttgggatggagattttttaaaagtatccgattctgatatacagccaattgaagatggagaacccaagctattattttgagggcgtcgtggaggattcgaacgtctacacaaaggataatttcgcctcggggggcatgttttgagtttgcttatactatcaaaccttatgcgactaataataaggctgagtatgaggcagtacttaaagggttgcaattgctcaaggaggttgaagccgatgctgttgaaatcatgggggattctttgttagtaatcagtcagttggcatgagaatatgagtgtaagaatgatacgttgatagtttataatgagaagtgccaaaaactgatgaaggagtttcggctagtaactttgaagcatgtatctcgagagcagaatattgaggtctatgatttagctcaaggggcatcgggatataagccgatgatcaaggatgttcagattgaagttgctgccatgacggccgatgattggagatatgatgtgcatcaatatttacaaaatccatcccagtcggcttataggaagttaagatataaagcgttgaaatatactttattggatgatgagctttattatcgaacgattgatggagtattgcttaagtgtctgagtgcttatcaggctaaagttgcaatcggcgaagttcatgaaggaatttgtggtactcatcaatcggctcataagatgaagtggttacttcggcgtgcggggtatttttggccgacgatgttagaagattgtttcagatattaca

SEQ ID NO: 9404 - DNA, 1501 bp, Oryza sativa
tgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttgatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggatatggttgtcggtacaaatttccagtctcctttggtttaagcccaaattgctccctcattacatcacctatcacatcagcccatggtcgctgctgaggtgttgcttgagattgttgtggtgtgggctcatgtcacgaccggaaataacccaacgggtgttccttacgtgcgtgtattattccttgtccca

SEQ ID NO: 9405 - DNA, 1501 bp, Oryza sativa
tgcgtctaggtccttcttcagctgcagattctcctgacgtagctccaggatcttcatgttgttctcgaccatcccacggcgcaccatctgatggaagtcgatacgagccgcgtcgtacgcctccaccatgcgcgccaggtgcacgatggtagcgtcatcctccgagctagcatcccggaaggtggcgaagtcgcgggctcctccgcagcgagggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagtgaggatcactgcagtaacctcccacgcagcgtggggctctgcatcgtcaccctcctgctccggaagcggcctggcctggtagtccactccaggcggataccccaggacaacgcacatgccccgtagctccaaaacgaagccagtcaggtccaaaccacgatggttgatgctgccggccatctacaaacaaaaacaaaagagaatagcaacattttaaagatcagattttgacgataaatgaagcagcgggacagagagagactagaggattttcacaaataagaaaggaattttatttcgaaaatattgctaaggcttgggatctaaagctcgtcctagggtcaagggggctctgataccaacttgtcacgaccagaaataacccaacgggcgttccttacgtgcgtgcattattccttgtcccaggaggcaaggtacaccaaaagttgatacaattcagagtttaataagcggaagcgtaaataattaatttattacatgggcggcgaaagcccaacacacacaaagacaaacgggaaacagcggaagactagggcgatgaccacaggcgcttgacggcaggcacgagctaaacaccaaagccttcatcatccaggggctcctcttctgggtttgggaaaaattgagcaagactgagtacaaccaccgtactcaacaagacacacccataagtgcagaataaatgcaagggagtacaagggggttataatataagggttaggatttgcagtaaacagcattaaaagacacttagttgctcaaagctattttataaatacgatcctagagctataccagattattaataagggccgtgaacccacacgaacctgccttaacccaaggcctacgatgattcagaccgaagtggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaacagattatactctgatcagaggtgtacatcacgtgtaaccatgtgccacataccaccacggtatacggacggaagacgtgacatagtttccaacccatcctagc

SEQ ID NO: 9406 - DNA, 1501 bp, Oryza sativa
aatatataaactatgatgaaaagggcacaaaatcaactctaaaattaagctttaaaatttagaatttggcttataagcataagcctgagcaaaacgatgggttgcttgtttggtttgttctacttaaagttatatattttgacatacaccaaagccaaataacttggaatgcttttttgggttaattcgatccatgccattgcaaatatgtcatttatgataaatgtgttggagtttaaaacacttaattggttaaatcttagcctagacatgatcaccttctacttatgcggaaattaattgatttactgacctaaaaatgaagccattgttcttctgctttcttcttcttctagagatgcctcacgaaccccttccagtgcctaatcgatcggacgattgacttagggtttagggttagatagagttaggttgttaatttgcctccctccttctctttctttatatagcgacatcggtggggctcagggttttttctcaagctaaattcgaatctattttgtaccgatcacacaaaacagatttctcttctttggtttcttgttaggataggaaaaccagtgggattttattcttcctagctaaccggcattagccaagaaaatcatccaacattctccccttgattttgagactaactgacgagtttactaaataaaatacctccccaagacaatgtgtcacaagcgtcactgagacaacactatggtacgcaaataaactcaagcttaacttagtgggtattgattgaaaattaagttcccctcatccaggatcttaataaggctctaatttacacatgtgctagctagaacatatcttagttaaacttaattttactagcctttagagtatggagccatgagcaaatgctcagcttaataattagaccctgggacatatctttcacaaccatatgtgaaaacacatgttgttactagaatagaaaactgtgtttaattagtgcacaacttatagcatagtataattttgagtggtttatgagcgctatttaccactcttagttcagggaaattttcttaaacatatgactgaatcataacatgctacaaaatccaactgcatcgtcgactatgcaataagagattattttggaccttttccatggttattgctcccctatgtgtggacatagcttaatctaaattagcttaataatctttataaatatccacacatctcacaaaataagtgtgtccaaatatctctaaactttagagaccaaatagacttttagaaatataagcatgttacttaaagttgccttgtaaataatacaaagcattcttaataccagtggtctagtctagatttaattaaatactgtcaagattcccagtattatgccaaatctgtatgcatctagatttgagctaatatcaagcttctgtcagctgaatcataaatgattatctttataatttaatttcaaatgactgaattaactaatccaatgagg

SEQ ID NO: 9407 - DNA, 444 bp, Oryza sativa
ctagaagtcccgtcaatcatcggcggctctgcaattatactcttatacaccccgctcgctgcttctactttttattgtcattaagattttaaaaattgaatatgattatcaatgaggttttttttttactttatagaagtcccggcaaccgttttccacgtttgcttcacggcctgcctgacgtccctccttttaattgtcattaggattctattttggtgatttattaacaatttttatatctcgtatcaaccaccaccactctactcctttataggcatgttacttaatttatctcgtcatgtgttttagatggtcttttctttcaataatatttatttttatcaaaaaatttagttatttataaattgtattcctaattgaaatcttaattttctttttctaatttcagattttttaaaaaaattagttaatattgtattg

SEQ ID NO: 9408 - DNA, 1501 bp, Oryza sativa
cgcatcaaaattttcctacagatataaactttcaacttttcttttcaaactttcaattttagtcaaacttccaattttagcatggaaataaacacatctaaattgagacagctccacccaactccacttccagttttggtggagctgaaactgtttggctgaactccagctccaggaggggtggagctggagctggagctgtgccaaacaggccctgagtaccttttgtgcagtactgcagtgacgaaatgatagtaacaaaatacatgtatccaatatcaatttcatcattttaaaatattgcacagtcaaaatattatgtgcgaagtgagcacaacttaagtgattaggttccttgtgctataaccagtttatctaggtttacgtactagacttgacacggatactcgaatctactgctaattattattttagtgatagataatgtacccgttgaaagtgaggtgcctcaatttcaaaatatacaagtctagtgttttaaaggtgatcgtactcattgattgatataaggtgtacgtgtgtccattgatagggtgaggtaaatgtacgtgtattataagcgtatgtgtttgtatcatgttttattactgcatgcccacacaaggaggaaaaaatgatcaggccccagaaatcatcgatgagtttagagtctattactctcttgccgagggcttactctgattctgatggatggccgcctgggcggctgggccgggtgctgatagtcgagcagggatgcgggaggccagccggtcgtggaaaatgttgttgggtatatggtccaaatttctgtgcttcttctgttagtttaatttggagatgattgctcagcttgggctgaggctgttgggccgatttgctcccgggcttctatggtcaggttatctagaaaaacaagcgtactcacccttataaattcacacatttttattctactactataagcatcttcgagacactaaaccgatatattctaaaattgatggagtcaccgcctcactgtcgagggagataaaaaaataattagttataaatacgaacacccatactgagtcaaaaatctatacttagttatgttctaccacaggaatttaaccagctaagctataagttactaaacattcctcctatttgatacaaggaaaaagaaatgccgacattgtttttctcttttaaacctcttatatatttttttttcaaaaagatgtctccaaattttaatttttagatttaaactttctaactacaacactaggactgttaggggtgataaaattcccattcggtaggggtaggtccaaaatttgacatgcgcacccatcaaggtgggccgtgggtcccagagaaaatatagtgctgggatggagagctgttcctactaacgggtcacccacgggtttcagcggaatgtggcctacctaacttggctaccaagtttatataaaaagacccacctcgtccttcaacccagcaggatcta

SEQ ID NO: 9409 - DNA, 733 bp, Oryza sativa
taatattccttatttttaattccgaatttctattattttctacttgtatttctatatggactttagtttcctcttataatattcctttttttattccgaatttctgctatttttaaattgtatttctatatggactctgccttttctttttctccgattaatgtgagaatttctagtccataagagtgaacgtggtggctcatttttctattcctttaatataataatagatattctaattttttttcttataaatagacaccatgtgatagtctctttgcctttgaggacttatttgtgataaaaaggttatatttcaacctttctttaaaaaatataaataggtcatcgacgttaacatctttgtctccaactcctttacatctcggcttctaggggtgagggtgttggcactaggacattgaacctcaatactagggtcattgacttcaagaaaatgatctcatcttataataagtttttatagggatctatttatataatatgtacttgcaggggactaacaccatcctttctgttcagccaaaacactaaagagaagaaggtcttgagattttcaagtgttcaaatggtaaaatactattttagcggtgagagcagtataatactactcgaacggtaaagtactatcgagtggaaagttctattcgagtggttttatgctattgaagcaactcgtcccgtttgagtgtgtttctaaccagtaaaaagt

SEQ ID NO: 9410 - DNA, 1501 bp, Oryza sativa
catatagccttttccttacatataattttgttaatattatgtacgcattccttaattagaaattaacatatgtacataaaacaacaactttaggatactatccctaataccctataacaattttattttattcatttattcacatttgacaactagaattataccagtgggtaaagaccaatgatataatagctattaggagctccgataaattgaaacattaggatcgctatatacatcataattgaaaagttaatgaaaaattcttccttggttttgggccaaatactattcattccttcctttctagccccaacctagtacactaccacccttcgctcggtctgtctcttttcgatccagcaggcccaacttgcacaaccggctaataaatatatttaatgtaattgtgctgcgtgtgcgtgtggtggatcgaatcagaaaaaaaaaatcagaagcctaaaaaaactggacggacagaaaaaccccgaaaactttatgtatcttttaattagttatattatagatgtaagaaatggttatctttcatgcagcttgtgtaatgacttgtatctctttcatgagagatgactcctcatatttctcttacatctcgtcatttgaatcaacatggcagtcttggaactaatacttactcgccactccatcgtgggcacttaattagccaaaatgaccacttttaaaataagttttagatgcattttttttctaaaaaaagttttagaaatggaaatttgcctgcataccttgagatttgggatagcttaagtccctggcaaacgcaggaaatttaaccaaaaaacaatatcatgccaacttcgggagcaacgtactactgtacatagatcaattctttacttatgaatggtatatataaaattgaactaggcgagatgcatggtttcagatttgactgttcttgaaaccgatcagacttgactgttagttgtgaagttttccctgtgttccaattacaagtagacactagctaatctaatactaacagtagcatccctcttggttgttctgtagtgtactgaaaactaatacaacaatgctactagtgcctgataagttgatcttcgaacaatgtgcgcttatagcaggtacatactctgagattgaatttctcaacttgtgttatcccaattgtacttcaccaatccacttccttacaagaaattcagctcgccttattttgtaggtactggatactgatcgaaaatcaacaacagttcgtttagcctttttccctacaccaacttgtcacgttctcaccaataattctcgaccggcagaatccctaaatttcttgccacgtacgtctgcatccctccaaaaattccctataaataccccttctcggccactccctgcaactcacccaagaacacactcgagctgaccacgtctagctagctatatctctcaacatcttccgagctactactagtagctagctagctagaggaagcagcag

SEQ ID NO: 9411 - DNA, 1068 bp, Oryza sativa
ttaatatgatattttaacatttgggaagcgtgtgcgcggagaacgagagaaatctcctctctttctccattgatcaaaaatttttgttgatgaggaaactctcatcaaatagtaatctcataaagagtttgctcggttatgttttaccatgtccgcaatgcagttgcaatcgacaactacaattaccgacgtcaacaaatgaatttcaatacttggttgttgtagctgctataatggttttattgtaaatcgcataactaaactggattaaagatgatacatagatgcggtgagcgtaataagaaaaagaactgcacataatgctcttctctctctcatcacgcatacagagaaaccctccccaatattttctcctttattcaagagcatttttccacatagtgtttaaaaggtaaactcaaatgatatttataaaaaaagtatatcccagtagcatattttattcgtccactcgtttttggggtgaggaaaaaaaatcttgtattgtgctcgtcattgaaaatacgaaacagaaaaaaaaatcacctactcgaaattaattaaaatcttcttgtttggttccacgcattcagcttacgtggagcaaccattttccatgcccttggctcttcgttgcaccatgcttgatgcttcctggtcatagggtagaattcatccacgtcgctttgcaggcttgctgcacctgactgctacgtgcacccggagtactactcataaaacaggatttgtcagacacaggcacacagcgaacctaaacgacggaccttttcaggccccacccacgtgccattgctttcacggatcagatactctccgcgtctccacgacgagcagaaagcaccaactaatcagctacagcgtgcgcaaatctcaaactagcaccacgctaatttaaccttctcagtcgatttatcattacaaaaacatgcgcaaaaccaatcaaatttacgcacgggatcgatacgagacttggttcttgcttgtgacgaactcagaacgacgccagctagcggcctagcgcgcgtggctgctgtcttcacgccacca

SEQ ID NO: 9412 - DNA, 610 bp, Oryza sativa
aagatttcaattaggaatacaatttataaataactaaaatttgtgataaaaataaagactattgaaagaaaaaaccatctaaaacacatgacgagataaattaagtaacatgcctataaaggagtagagtggtggcggttgatacgacatataaaaattgttaataaaacatgaaatagaatcctaatgacgattaaaaggagggatgtcaggcaagccgtgaagcaaacaagtaagacggttgccgggacttttataagtaaaaaaattaaaccccattgataatcatttcaatttttaaaatctcaatgacaataaaaaggagaagcagcgtgtggggtgtataagagtatagttgcagagccatcgacggttgacgagacttctagaaaataaaaaatgaattccaatgatagttatgtttaatttttagaatcacaatgacaataaagagtaggtggcggatgggatgttgaggtgcgtagtggcatcgtttgataggacttataaaaattataaaaaataatgaaactacaagtccaatttttaaaggttcgtaacttctaaaaggtaaaaaaaatgataatcatgttcaatttaaaaatctcaa

SEQ ID NO: 9413 - DNA, 420 bp, Oryza sativa
gcccccatccagatcaatgcctcgtcaaccgccgtcgtcgcaggtcggccttgccccatccgaattgactcctcgcagagactgggtggtggtggcggcggcgggccattgacgggaggacgagggagatggactcgccgggaggagggtggagagagagagagagaggcatactagaaggacaacgtctccgcttgcatctgtgtctgctggccaccgcctgcctcctccgcgctcgacggccaccgccgccgcttccccttccgcttccacacccaccggctgcctcccgccgtcggccacttgcgcccgctacttgggcactcctcctcccctccgccccttgcgccgcccgcaccgctcctccgactgcgccgccacccgtgccgctcctccgaccacgccacccctccacctagc

SEQ ID NO: 9414 - DNA, 1501 bp, Oryza sativa
gccaaccgcctggtcgctgccgccgtcattatctaccgcgtctgcccgcgcctgccgcccgtgtcgccactccgctccacaccacccccgccgtcatagacgtcgtcacgacccggcccccgccactccacgcgctagcctccaagggacggaggcagagctcctcctccctctgccgcgtcgcccccgctccctcctctttttcccaaagtggcaaggagcaagctccctttctcccttcctttttccttttccccttcccgccggcgtcatccgcctctgtcgccgttttggccgcgagcgccgagcgccagctcgcgccttgaccgcccaaggtcggtttccaaaccgacatcgtcgtcctataaaccaaggcgccctcccatcgattcctcctcccgtttcgctcgccgccaccgcgccattgccgcccctctgtcttgcctccgacgttcatcgccaaacaccgggagagccgatgcgttcgtggacgcggaaggggactccgggcgctcgccttcttcctcttccccggcccaaggccggagagatcactcccgtgctgtcggcctcttgtcactgcgccccgtcccacacggtagtgcatccctccgttctccctcctcgttccatctcctccccttagactcgggtagtagcatgtgtagcctccccgtagctagccggcgccgccccgactgctgccgtcgctcaccgtgtgctcgccgctgtcgccgcccatgctccgtagcgcccgctcgtcgccggcctcgctcggcgtagctccgcccaatccgacgctagcaatgggttcccgtagctgcgtagatgctctcgccgccgggaatcggcccctcgtgacctcgtcgccggttgccgccgccgcaatccggcgccgtcgagctccctccggcgaatccgagccgttggctcgtctcccctcgtcctgtgcaacatcccggtgtgctcgccttcgcctgtatcgccatggttcgctccgccgctcgccgccgtcgtccgccgtccgttccggccgacgtcgtcgtctacctcccgccggcccacgtggcagccacgtaagcgccacgtcagcgccacctcggccgcgaccggatcggctgacccggccagccgctccctccgttccccccccccccccgtgcgcatggtccgcggtgagccgtgaggctgcgcgtgggctcgccgcaccgcgtcctccgcgaactgcgcgcatgcgccgcgcctccctccccaaaccatagcacgacccgtgtcacaccccgaagttctcctcccaagcctaaatttaatttataaatgaccctaagaaaataccggtgcaaagcaagagtaaacccttttaaatcaatgcaaataataatcggaatcggcatgtggaatttttcttggattctacatgtcaaaatatgctaacaggatttttagtggaattttcagagccttggaaataattttaaccaattaaaataagcaaagtgca

SEQ ID NO: 9415 - DNA, 1501 bp, Oryza sativa
ccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcaccatgggcacgactagcaaaaccatgcacccacagcccaccatgtagtgtactttaattaaccaacaccattgcggtggcactaatccaaagctattaccaataatcaaagtctatgctttagtgtgatccccttttgtgcattagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgaaaaaccacgaatcgacgaaacgggcgaaatctacgcgacaaacaaagcacacaagcaaaacatgctataagactactgaaacaggaaacaaaaccatttttagtggattctatacatttttatgaatttactgagacttgaatggacttaatcggagctcggatgaattagttatgatttttagaagattatctatgtttttactaataaagaaaaagccttaatcaatttattgcgcaataattcatcccagggctgacgtcagcacaaggaggggtggcgccgacacgcgggacccgcgggttagtgactcaaggagagagaggggcggctggcaagcgggctccaccgagcggcggctcatggggaggaggagacgcccggtcggctcggctcggcctcaaaccggccgaccggttatggcgagggcggtggcgcgcatgcacggtcgccggcgacggcaaccggaggcgcgggaagcggcggcggatgacggcggcgcaaaggcggcggcacacagccgaagcggcggctcggcccggcacggcgctaggagggagaggaaggggaaaagagggggaggggcgcctcaccgcgagttggccggcgtggggggaagacgacggcgaacggcgacggcgagcgaccggggaacagcgacgataggcggacgagctccgagacctcctagggaacaagatgggagggattagagggagaggggtagttaacggcgagcggattcgccggtcgaaggcggcagccatgggggtactcatcggcgcgcgaggagaagcaagctccggcgacgggattgaccggggaaacggccggacgggtgggcacacaggcttaggagctcggcggtgtcgacggtctggtacggccacggctctagcggtggcggagtgcggccggagcttggcggcaagcggcggatggcgggatga

SEQ ID NO: 9416 - DNA, 1501 bp, Oryza sativa
atataaagctaataggttacaaaaatatgatatacttcctccgtttcgcaatgtaagtcattctagcattttccacattcatattgatgttaatgaatctaaatatctagattcattaacatcaatatgaatgtatatctagattcattaacatcaatataaatgtgggaaatgttagaatgacttacattatattgtgaaacggagtgagtaatatacaagctaagatatgcgtgtatgactgattggtggatgtgtggacacaatctgctcaaaccaatcgaaaacattcatggacagttgcagacatatcatcattcgtttacaacaactagcgtgacgatatgcatagaaagacaagcatagcgagaagttggcccatgaatgtgacctgatatatatatagtcatgtgaaattattaaaacgcatcattattttacccaaccaccaaacatttgaagctttgagcatcaaatatttcagcaaaaaataatagcgtagaatatttctattactaatagaacattttgataataatataattctttagatttggccaatacattatgttacaaataaaacattaaaatttgaacacgagatagaaaccaatagtttttacctgatggagtattagatatatcagagaaagacaaagggtgtgtaaactgacagggaacaacgtactggcctgtaaaaaataacccaagacaaatgctcgaaaaactaaacaattagagttcttgtttagtggctgtagcacgggccggggtgaaaccaaacagcgcggatatatacagacgaataatgtgcatgtcatgtttgttttcacatctgtagcaaaagaaaatcttatttgaaatacaaataataatcgaacatgttagaacacgaataaaaaagatatttgttaaaacgagacaacccgaaccacacacacaaacacaaatgataacacacaaagggaaactagctcatctggtctaattatttctccttctgttcctagttaattaataagtatatgacctaaatttttttaattactttgctacaaaaacccaaagcctaatttgtcattttgccctactataatatcccatctacttgagacctacatataacacttaatatcctaacatccttagggaaatacagtcacatgtagaaaatataatcactgtatactttttttttccacacaatcacaaatgctaatgaaactgaacggaaggagatctggctcgtcggtaaaatataccgatatatagtgcttaattaactcctgttctggaaatcattatctgcatttttatatttgtcatgagattatgggccttgaattagctagatacgttccgtttgttttcttgagcggacataaaatttattatcatctccatttttctcatatgtatagctgttgagctgtcggcaggcaattaataaacgagcaaactggcaagatcgataatggacatacggtagcctcgtgggaca

SEQ ID NO: 9417 - DNA, 1501 bp, Oryza sativa
gaaattgtattgcagatagctattattggaaataaattgtattgcataagaatacatttcaaggaaaagagtgaatgccaaaatctcgcgacgagacaaacgaggcttggcggcacaaagataatttggttttcctccatcgacacaaatcacaccacgtgggcaccctatctccacgctcgcacaataacaaatctactgacagggaagacagagattgtcagttgtcactggcctcctgttcctctcttttaggaagaattgcagcgagcacaaatttagggtttcatccaattgaaagtaacataatcaaataatggtcaaatagttccaggaaaaatcacaaaagctagaaatggcaaacactcagttccctgttgaagtctgtagtctcctgtggtgaaaacctatagtataggatttgctgaccggatcatggcagcggcaactacctacacacggcattccctttttagaggcctttattacagtccaaacattactatgtttgagtataatgataaagattgtttgtggttataactcgctacggcttgatatctttttgtcacatcattcttccttgttttataattatagattgtgtacgttctaactatgtagagcctatatttggtcctagattaattatatcatcgatatcttgatgttgttttctgagattaataaaaaaattcatttataaatacaatggattttcttcaaatgcaaaatacatactatagagtgttgcccggcctacttaatatcaagtctccatccaccgacctctacgtcctgtaataataaaccattgaaagtatgatagatatggttttccattactttatagccttcgcattgtcatccatcaagccttatatatagccagtgtaatctatggatagaggggaactggttggcattgtacaacgagactagaatgtaccacaagtttgtgactcattccacttagcttgataaactgcttcaataatatgtcttggattctagagaactctaaccgacttgattattccaccagctcgaggacttttgaaaagccacaataaacagttagcacattgaggtcagttcattgaaattaattagaagtcaaatatcctaggaatgagaagctcctggaaaagaaatggttactcaagagtgacgagaagtcaccacgaatactagtgctagtgtctttagttcaacttcatctatgtcacaacatgttagtcagcttccaattcatgtcactatagcttggcattctccaatacctacctggaggaactttgttgtactagagtgcagtattagatcatattgtcctctgaaacgatttcgtacacagaaccatacttcatatatatgtgaagccgtacacaaccgtgggatggattttgatctgcatatatttttcaagtcaagataatccatatttcccttcaacaagagaaggcaaatgttatgtgtagtatggaattgtactcatagg

SEQ ID NO: 9418 - DNA, 1141 bp, Oryza sativa
tgacgctccggtgtactttgagatagtcgccgaggttcctccagcagcagagcaaggcaagtcatgcttgtcacttgaacatgttgatcctatattgcaaatgttctaatgttttccatcaaatactgcattgttttcagtaatactatgagatgtttacctactgttacagccatgctattttggtaccatgctcctttgttagcttgggatataacatgactagatattggactagggattgcttagccatgcttagttcaactagcacacaatggggaaaatcctattaatgtatagactgtaggttctaatggtaatgttggattaatgccaccgcttcggtgtgggtcaattaaaataaatcacatggtgggctgtgggtgcatggttttgttggttgtcacgccctaaaaatcaactaaattaaaaatacattgtttaaatcatttttagaaattattttaaaagcctacaagctaaaccctaattatctaggaaaattttcaacataaaattgagctagataaaattttattaaatactttgcttgttcctctattttctagaattttctgggaattgtttgagcaagggaagtatttttaataaatgaaacaacatttcacaaattatttttaagtaaaaagttccaaaactcctccctgaagccgttgggccattttggcccaacatccctcccacatcccgtggccgagccggcccatccggcccaacccgccaccaccgcccctccctcgcgtggaggccgacaggtggggcccacctgtcggtggtgtctcctacctccggccggctgcaagccgagcccgagccggccgagccgccgccttctgcctccgtttccgccccgatctctccacccctagtccggatttttgaggggtttttatccccacatcttcctctatctttcccctcaagaatcggagcaaatggttgagtatcttgcccgaatcgaactcgttttcgagtttatctccaaaaccgagtttttgattttcccgagtcgatttcttgcgggaggagtccgatctcttcaatccaaggctataaataggaccccctagtcctcctctttcgtttgccccaactcccgtcctttcccgtgctccgtagc

SEQ ID NO: 9419 - DNA, 960 bp, Oryza sativa
tttaggcccttctctccctctattagggtgggcgggaggagtatatttttgccaaactttaaaatggtaatttattttttaaatatttttaaaaataaatataaatataaaaaaaaattccttcttgctacaccaagagataactcgtaccactaccaagccaaattgtatatactaatgtccattcgtgtcgattttggtctttctgctagttctagaaaaacacatagcaatcctccgtcaacctaaaagaatggaaaactcactctctctatctatatatatctttattcaagtatcgatcttattttcccataattaaagagttctccatagagcatattaaatatatagaaaagagagaaaccacaaataaaacatgaattatcaacgacgacagctagtgacactactatacaaatgatttttgtgaatgagacccctttaaattgcaagtggaccataattaaccgtgtcatgtacggctccttaaaatgcatgtatgcaaaaatcaattttcgcaagcggacctcttaacttactcacataaaaaaatgagcatattttcacatgtggatcttttaaaggaccgcatgagaaaatatattttggtgggcaggcctcttaaggggatccgctagaattctaacttgccttcttttccctctcaacactacaattttttccaagtcccttattatctcccctcctctccaacctcctctccctcattcacacctcctctctctatctctctcatttctcattcctcccctctctcattccaaagcggcggcgacgactcggtagtgggtagcggctggtggctcggtagcgggcgacgcccgggctcggtggtgtcatcgcccactcggatttggcgacggtggctgtcccccacctagcctcgcacggatccagcggcggtggaaggagcggggccccacgcgaactcggtga

SEQ ID NO: 9420 - DNA, 1501 bp, Oryza sativa
cagtacagatcagtggccgcgggccagccagatgctcgctaattattaccctgcagctacgatcgacgaggccatgtaccggaacggaaaaacgtatttctttctacaggtagtttccaaccggcctagctagatagctacttgtcctgtcaaatgtaacgctagctgctagcggcatccagtacgagagcatataattaacgtgcttttgtataggtgtactttggtttgctgctgatcgatcgcgatcgatctcgtgccgagaactcgttgtcatgtgtgttggcgatcgatgctgcactactgcaccggctagctagatatgtatacgtactggcagtgtcatccgaaactgcgcgtgtattgcgatgccaataatttagccggaatatataccccgagaaaaagcagaggatatatatagtactgtttctttcatacatagggccgcatggtgtaggtgtattggttatttggtttggtgcatgttggaattaatagatggggtaaggcctatttaaagattaattctttggaaaatcacaaaagcctatctcatgagatggcatgcatgtcgagtttagtaccaccttacttattctagaagagggggacctccttaaaagggaggatgccctcctagccacttgaagcatgtgtggtggagagaagagggggaacacgcgctcgctcgctcactcgcctcgcctcgtctagcagggcaggtggcggcgcgcgtgcacgacgtacgcgtcgaatggtccgcaaaattggctcctcacccttgctgcagatgcagcctccttttgcagttttgttttgctgcaggaaaattcggatttgttttgttttggaaacattccgaaaaattcggtgcgtgaaaacgacatggagtccggataagttacgcgcgacttatccggttcggttacacggagtggagatcgtgcgggcgccctgattaagcgacctatctctatataaaccgagccgccgccttcacgcaaaacacacaaaatcaatctagggtttgcctcctcctctgtgctgcgccgtcgctcgtagactactccatcccgctcgtcggcgtgcacctgcgatcgggagagcaggtctccggaacctctgccttcgacgtcctacactgggagaaggcggcaataaggtttttgggaagcgcttcgcgcgactgctccctgttcatccgcgacggctcgccttcctctccgctcacgtgctgcgcgcctttgtcgctgctcgcaaccgcgagtagttcctgccgagcaaccggtctttccgtcacctcggtacgtgttcgacatgttgcgcatatttgatctgttcatgttttactgcttagtttacatgtgtagatctaatgatgcgttaatgctattatacatctgtaatgtcatgatttatttatggaatatattaaatcattatatgcctatattctcaacaatccaaaaaccttattataggcgctgtgattttacta

SEQ ID NO: 9421 - DNA, 1501 bp, Oryza sativa
tgaagtcaaactatgcttataagacacaagtttacaggcaaagctaaatctatctattatattattaaaacagctctgaaaggaggcaccatgttcactgtttgggctagaaatttccacattaatcggagaaaaagaaaaagaaaagaaaaggagagtcgaagtagaagtacaatttaaattagctaaaattcggaattaaaataagagatattgaaagaagtttccatgtatgaacccaatacgagattaatcaaaactcgaaataaaataaaatccaaaattagaaaagaaaaggagagtccaagtagaagtacaatttaaaaatagctgaaactaggaattaaaaataagcaatattgaaagaagtttccatataagaaccaaatacaagattaatcaaattttgaaataaaataaaataaaatccaaaattagaaaaggaaaggagagtccaagtaggaatacaatttaaaaatagctgaaattcggaattaaaaataagaaatattaaaagaagagtccatataagaacccaatataagattaattaaaaatcagaataaaaataaaaataaatccgaaattagcaaaagaaaataaagaagagttcaaagtaggaatacaatttaaaaatagctaaaattcataattaaaaataagcaatattgaaacaagaatctatataagaacccaatacgagattaattaaaattttgaataaaaaatataataatatccaaaattagaaaaattaaaagagagttcaagtaggaatacaattttgaaacaactgaagttgaaaataaaaaaataaaaacattaaaagaacacaatacggtattaactaattttttttaaaaaaaataaattctgaaattagaaaaaaaagatttcaattaggaataaaatttataaataactaattttttgataaaaataaagactattgaaagaaaagaccatctaaaacacgtgacgagataaattaagtaacatgcctataaaggagtagagttggtggcggttgatacgtcatataaaaattgttaataaaacaccaaatagaatcctaatgacgattaaaaggagggacgtcgggcatgccgtgaagcaaacaagtaaggcggttgccgggacttctagaaagtaaaaaaaaaacacattgataatcatattcaaattttaaaatctcaatgacaataaaaaggagaagcagcgggcagggtgtataagagtatagttgcaaagccgccgatggttgacgggacttctagaaaataaaaaatgaattacaacaatagttatgtttgatttttagaatcacaatgataataaagaataggcggcggacggtctgtagaggggcatagtggcatcgtttgctaggacttctaaaaattataaaaaatgaaactacaagtctaatttttgaaggttcgaaaattctaaaaagtaaaaaaaaaaccaatgataatcatgtccgattttaaagtctcaa

SEQ ID NO: 9422 - DNA, 1501 bp, Oryza sativa
ttgtttcctgtttcagtagtcttatagcatgttttgcttgtgtgctttgtttgtcgcgtaggtttcggccgtttcgtcgatccgaagtttctcgaagacgttgctgaggtcccatcagttcgagagcaaggcaagtcatgcaatacgtttgatcatattgtacccaatttacaagtatcccgcatttctattaaatgttgcattcttttacaatgtaatgtgggatgggtcctattcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcatccctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctctttttccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacacccaccacgttcacatgtcaggggtatcactcgattttt

SEQ ID NO: 9423 - DNA, 1501 bp, Oryza sativa
ctgctaacagaacatgcacgtcatctagatcaaccaacttatttctgtcacagatactacacgacttataagttataactaaagaaacactatgcataaactaaatcaatatggcagaaaatatgttttataatcaatcttttaacacacaagaacaagatctgctccacttatcactaaagaacccttatgtataaactaagccaatatggcatacagtaagtcaactagtaaccaatctttaacctatagacacaacaaaagatttcacgattacgatcacataaataaacgccactccatcgatttactgttcccgaacagatctactaacaaactcaccccgaaaacccaacacaagaactagatctaaacagcacgcaactgaaagcacgaacagatggagagaggagaacgacatggagaagaatgctgatggatggatggatccatacccttgtacttgccgcagtaggccgacatggttgcgggcggagcgaacgagggaggaggctacgacgaatagggagatcgaggagaggaaggaggcggcggctgtggggaatgaggcgagaagggagggggaggggggtggccttttgaaggggggcgatgatgagttgatgaccgatccgatctgtgggcgtccggccgccttgtaggaggggtaagaaaccaacaaatcgggtgccagtgtgcgccgcgagtctgcgacccgtccgatccgtgggaagccgaggaggcggctgcggcgcgcggcggcggccgccacctgtggcgtgggccggggtcctgtcctggtaggtgaggtgcccgcaattttgggccgagatagatttgacgagaatttttttcggttttagattattttttttaatatttacagaaataatatatcgaccaaaaaattgcagaaatagcccctaccgcccacctctagggcgacaagctgacgtggcaaacgggggaggaacgggcggtgacagagggagggtttttttttaggaaaaccccgcggcaaggggcccgaatgcaaaaaaagccagtcggggccggctattttgcaggcggccccttgccgccctctggccgggcggcaggcctcgttgcctataaaaggcctgctgcccatcccccagccgtcattcttctctcctcaattccagtgaaaaaaaaagaagagaggggaggagaagagaagaaggggcgaagccctgccggattcagacaccgatttcaggtaatattcatagatcctatatgtgactattgagttaaatagtgtgtattctttaaaaatttgtttgaataaatgcattatatttttagggttttagttgtactaatctagaagtgtgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 9424 - DNA, 1501 bp, Oryza sativa
cccctcgtcggccactccacttggttgaatgcccactggagctactacgcccccgtcctctcgtgcgttgacctcctccacagaagtctcgtttacttcagcacttggtccctcgccatcatccatgttcgtctgcacacctggatcctttgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctgaagcccctcattaaccatccttttatagaaggtacactcctctcagccggtctatcaattcccctttctgatacaataaaatctgacagatctaccccagttggcccgtaacgaacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacacacttctagattagtacaactaaaaccctaaaaatataatgcatttattcaaacaaatttttaaagaatacacactatttaactcaatagtcacatataggatctatgaatattacctgaaatcggtgtctgaatccggcagggcttcgccccttcttctcttctcctcccctctcttctttttttttcactggaattgaggagagaagaatgacggctgggggatgggcagcaggccttttataggcaacgaggcctgccgcccggccagagggcggcaaggggccgcctgcaaaatagccggccccgactggctttttttgcattcgggccccttgccgcggggttttcctaaaaaaaaaccctccctctgtcaccgcccgttcctcccccgtttgccacgtcagcttgtcgccctagaggtgggcggtaggggctatttctgcaattttttggtcgatatattatttctgtaaatattaaaaaaaataatctaaaaccgaaaaaaattctcgtcaaatctatctcggcccaaaattgcgggcacctcacctaccaggacaggaccccggcccacgccacaggtggcggccgccgccgcgcgccgcagccgcctcctcggcttcccacggatcggacgggtcgcagactcgcggcgcacactggcacccgatttgttggtttcttacccctcctacaaggcggccggacgcccacagatcggatcggtcatcaactcatcatcgccccccttcaaaaggccacccccctccccctcccttctcgcctcattccccacagccgccgcctccttcctctcctcgatctccctattcgtcgtagcctcctccctcgttcgctccgcccgcaacca

SEQ ID NO: 9425 - DNA, 1501 bp, Oryza sativa
catttctagtcaaccacagagcccaacatatggcagaagctcctacaagtatgagtttactcttcttcttgtctacccccaagagctaaccatcaaacataaaacatattagatacggtagtaggaaggcataaaccaagagagaactgtactgctctctaaacaaattttgcataatggcactctataaaaagatgttgaatagtttcatttttcataaaaaaacaacatcttaaactgccattccaatttcgtcttgccaaattatccttggttaacacaacccctttaagcaagtaccacataaaaatcttaatcttaagtggcatcttaagcttccaaataatcttgtttatctcaatataaccattattaattaaagctagatacatcgacctaacagaaaatattccattctgatgataattccatctaaagctatcagaggattgattcaattgaatatgtccaatagaagcacacaattcataccaatatgcaagattctgaccaactaatgatctcctaaaggaaacattgagtggaacagatctcataacattagtaatagtagaacttttccttcggacaatagagtataaagatggatatttgtctttaaagccaggtttcctagccatttatcttcccagaaccttatttgtttcctattatttacaatccaagaactcatatctaagaaggtatctttgatcttcatgagacctgaccaaaaatgagaatcatcccgttttttattaacttgggttatattatagactgattgtagagatactttcataaaaccggttcaccgagctgatcctatgtttccctatggtggctcacacgaacgagacctaaaaatgccaagaatctgacactgaaacggacggccgagatgacgcgtggcccgccgaactgggcgtccacgcaaggccatgaccccatagatgacctccccatagaccaggccgcacctccgtgtcgccgtgcatccatcccaaggccacggtgatgacgtgcccgtgcgccgtatcccgcacccgcagcccccgtcctgagccgcgcgcgcgcggtccacacgcgcctcccctcgtaggacgggtcggtcgcagccgccgcccccgccccgcagcgatccgctaagcgaagctgaccggacttcgttaaccgccacctcctccttgtcggatcatcggatcggcgcccgcgcgcccgctaagatgcagccccctcgcgccacgtcacctcccttcccctgggcgccgcgcggtgccggatcaccacagacggatccttcttcctcctgttctttatatgagcgacactaaagaaagcgctacacacacgcgaccccataatctttcctacagatacaccacccacgccagttagaggttagaaacaaggcgtcgaacaccttaacgccattaccgaaaggcttcgagaattcggtggtgggtgtgcgagggagagagagagagggggagagagggtg

SEQ ID NO: 9426 - DNA, 1501 bp, Oryza sativa
atctcataacattagtaatagtagaacttttccttcggacaatagagtataaagatggatatttgtctttaaagccaggtttcctagccatttatcttcccagaaccttatttgtttcctattatttacaatccaagaactcatatctaagaaggtatctttgatcttcatgagacctgaccaaaaatgagaatcatcccgttttttattaacttgggttatattatagactgattgtagagatactttcataaaaccggttcaccgagctgatcctatgtttccctatggtggctcacacgaacgagacctaaaaatgccaagaatctgacactgaaacggacggccgagatgacgcgtggcccgccgaactgggcgtccacgcaaggccatgaccccatagatgacctccccatagaccaggccgcacctccgtgtcgccgtgcatccatcccaaggccacggtgatgacgtgcccgtgcgccgtatcccgcacccgcagcccccgtcctgagccgcgcgcgcgcggtccacacgcgcctcccctcgtaggacgggtcggtcgcagccgccgcccccgccccgcagcgatccgctaagcgaagctgaccggacttcgttaaccgccacctcctccttgtcggatcatcggatcggcgcccgcgcgcccgctaagatgcagccccctcgcgccacgtcacctcccttcccctgggcgccgcgcggtgccggatcaccacagacggatccttcttcctcctgttctttatatgagcgacactaaagaaagcgctacacacacgcgaccccataatctttcctacagatacaccacccacgccagttagaggttagaaacaaggcgtcgaacaccttaacgccattaccgaaaggcttcgagaattcggtggtgggtgtgcgagggagagagagagagggggagagagggtgtgtgcagtgaggaggggccctggcgatcgccggagggatgactacgggcgcggcggcgggggctgctgcggctgcgggggcggcaccggcgtcgccggtggccgccgcggccgcggccgcgcccgaggtggcggcgagggacgccgtgatcgggtggttccgcggcgagttcgcggcggcgaacgcggtgatcgacgcgctgtgcggccacctcgcgcagatcggcggggacgccgagtacgaggccgtgttcgccgcgctccaccgccgccgcatcaactggttccccgtcctccacatgcagaagttctactccgtcgccgacgttgccgccgagctccgccgcgtcgcggacgcccgcgcctccgccgcctactccgaggaggaggcggcgtccacggtgatccacgagcccatggacgagctcgtcgccatggccgccgagccggagccggagcaggagcaggagcccgaccacgaccatgtacctcaggatccggcaccggagccggagcctgacggcgccgtcaacaaccccgtctcccccacc

SEQ ID NO: 9427 - DNA, 1501 bp, Oryza sativa
ggtttatttcaaggagacccaaacaaaacccgaagggcaaattcatttcttccctgtgatttttgtaagtccactaattttactaactttgttgttgtatcatatggaatttgatttggtgttggcgtgttgcaacacagaacggccgacagctttatgatgctatggtggagcgtgctggaccttcggaaactagcggtcctaaatagtgagtgcttccctcagggaggccatgagttgggctccatggatcctgtagatttagttgatacattttagagggacaagacctactactatgatgtacaatattagaacatgcaattaaccttttaagaatgatgtacacagtatatatactctgtacttctgtatgactatgtataaaaaaggctgatttaatgcaacaccaacacggcatattccaatctaagtcaatacgcaggagtttaccttcttatatacttcctccgtttaacactgtaagtcattctagcatttaccacattcatattgatgttaatgaatctatatagatatatatgtctagatttattaaaatcaatatgaatgtggaaaatgttagaatgacttacattgtgaaacgaagggagtagttgcatttattattaactagaaaaaaatatctgtacgttgcaacgggtgaagattattttaatcttattattattattttacggtttagttaaggtaaaattcactgtagtattcgtttagatatatatttttctagaaaatcatgagctataattatgagtccgatcatctcaagttagcatgtgagtttttttaaagaaagttcttatacatctccttctgtattttcaaaaccgaacgaatttaaaacccgactcaaatacagatttgtatttctaaaagcgaacgaacttaaaagttgactcatacatggatgacgtaacaaagtatcggtaaaaacatatttaatttttataatagtagagatagagatagagaagagatatgccagatgttatagtccatcaaatttgtatcggtggaattgtatgcggtaatggatttgggtattgaaccaatgttttgccatacagctgatccgaaaaaaggtttatagcaaatccggaaaaataaacataactactactaaaaacacggcaaagaggtttatttttttatcctatgccatgggtaatttactagcaatataaaaggacaaatatacgtctggttagagaagagtaagagggagcagagcgaccgtcctggaggcagaaacccttgtgcagttctgcccttgtagtatggcgaccagacatggctgtccacgctggcccctcgccttatccggctccagaatcccatccacccaatcacaatccaacccacgccattgcaaccaaatttccaatacacaaaacagcagaaactctagtgatcacaagctcagctcagctcagctccctccttctccccggagaagcagcggccggcacggcagcaa

SEQ ID NO: 9428 - DNA, 1501 bp, Oryza sativa
gtaaaaaggtcagagtttgattagttaaatgactgcttgaaagttgaatcccacaacacactcaagcaacagtgccaacttggtaaagcgccatttatagtgatgaaaatacaggttccaacccacttacagccccttccagtggggcttccatattttaacactacaattcatcggaatattcccgttcaagagcatgaagaggcgtaatcttgtcaccggataatttacactgccgcaccaggatcactgataacgcccaggaagtcatcttttattgtgccaatgcaaaactgcaacaaacatattcaaactgttagagcattgcacatcaccagcttaaacggggttatgagttatgacagcaagaacatggattcagaaatgcctcagggaagaatatagccacatgcattcaacaattatctattatgataccatactagtggctagcttatgagcattcatggtaattacttgcaatttgttgctacaagattacatgtcaaattttcattttgatatacttttcaactaatttacttgacacacatcaaggttgatctttgctgataaaaccacatctgttctttttcacacattaggaaagaaaaacatcatgcaaactactggtatggaaaagtgggttacatcaccaataattgcatatggtggttactctgagagcaatgctacaaaaatctaaaagacagggaacacctggtttttcgtttgtttttttgcacgaaactagatgtcaacaaacttacaatttctgttgcatcaacacgtgtcccaataatcttcaaccgaacctcactatctttctgaattttcacctgcatcggacaaacaagtaaatcctagtaagcaaaagaagatggccaaagcaattagccttcaacagtagtacagtattcacatctattcgtttctaggaaaaacaatgaacatatatgtgtatgcatttcaagcatagttatgacatgctgataccaaaattggatacaatggacattacattacattccccagcatttctttttaagtcagacatatcaccaataagcataaataaacaggaaaaaaaatcataacctgtcaacagttgtcaatgtttatagaggacaagacataagaagtaactgtagaaaagaagcataccgatccatcagaagtagtataatttggcacatccccagattggaactccatatcatcaggaatcaactgcacaacaaaaatagaaacgggaaaatgcaagaacaaaacattagttggttagaaagcacaaattcaactagaaccttatgttgccttccagtcactttaagattgttcaaaccaacatgtttgataaattagtatcagaaatttctatgacaaaaaccatccttcgagttgatggtacagctaaactgggtgtatgaaaatggtactgaaccattatcgtctatcgatcattctagcataaattctgattcttttactccacaaattt

SEQ ID NO: 9429 - DNA, 1501 bp, Oryza sativa
aaaggaagaagtgttattaagttttttcccctagagttgcattttggcaaagtatttttcattgctctcaaatagctacatgatattttgtatcagctagttttttttagaaaataaaaacaaacactgcacttattaaattatatacactgtaagcacccatatattcaatagtcacaaatgtggctttatatcataattattattgataacagtaaagaacaaacaactacagacagctgctcacaaaagaactagtccaaataacaacataattatgctaacaggtaacagctagataacattctcaccaggatatgcatgtagtgcttccatggcagcagcttgactagcaggatctgcaccaagcatgattacatgtccaccaataagttcatcctctttatatatatttgcaaattctgctggaggtttgtctgattcaaaatttgtaacaagtgccgtgccatcgtttgatgaatcccgaagagtagagccaacaatctgtttaactttcccctgaaaatttatattaagaaacagcccatcagataaatgacactgttaatgccagaagtaactgaactcacatggttgcaaaatgacagtagaaatcaatgcataagcctttagttttaatatcacggtgttccaggtgaatcgcatcgcaggaaaatttggagcatacaagctgaaaaaacttctgaaagtactttgcttacaaagttggggtatcaatttacgatcatgttaatgttcagaacacccatgaaacataagaggaagcaagtgttccactcgtacggaccttatgaatatcgatacacggcctgaagataacggcgcacaccacagcacgtcctcctgccaaaacaaacgagcaatcccagtttttcccccaattcgcgacaagcagtaacaaatcgagccatacagagaatcgaatcgaaagggacatcatactcgccacgccggatctcgccggccggacggagaccatcgggacagcccaaccggaccgcgccgccgcgcacggtggagacggaaccctcgatgccatccaatccagtcgctgccacaaccaacaaacaaacacccgcgaagcaaattcagaagcaagcaagcatgcgggagccccccccccccccaacccaggacacgattcggagagaagaagaagaaaccagcgcgtacgtgccgcaccttcgcagccgccgccggcggggaggggagggctccgcggaggcggcgcaagggcggcggcgagtcggagtcggggtcggagtcggagtcggtgcgaggcccaagccgaactaggtaaagagatttattggacggccaggatatgcacaggggcgttgatccgacggctcgaacgcctcgtcagggctaataatattgcctctcgcgagagagaagccaagccagttgagtcgaactgttgaggaatcgctcgctcgctcgctcgctcgccggcggcgcggacgaggagggggcgaga

SEQ ID NO: 9430 - DNA, 1501 bp, Oryza sativa
atcgagaaggtaaagaaaagaaggaagaagattagaatgaagggtgggatgaagaaagagaagagatagaagaagatggtggatccataaagataatagaatatctgtgttataggaaacataatattttatagacatttggttacaatgtttactatatgaattcgaatgatgtgaccactcattacaagtagtagctactctagctctctttttttttattacacggcagaccatagttattagaaccggaccagaccgatgatccgactggaaaaaaaaggaaccagggcgccggctggtccggtccagctaaaagatcggtgtgcaatcaaaccggtagaaccgggcggtttaccaaaaaaccggataaaaaccggagctggttggaccgctggaacggcgtcacatggaggaaacagaagtgcgcaggttgcagccttacaggtgcatcacgcggagttagaaaatagggaaaaatgctatagaacttgtgaatcgaacccaaaacttccatctttccgcatagagtcttaaccaccaggctgtgaaacttgtgataatattataacacatatctatttgaactgcaataaaccggtggttggaccggtccaaccaataaaccagtgaaccgagtgtcttaccggtttgatcaccggtccggtcttaataactatgtggcagacgcatatgcacacatcactacacgcgtaacacttacacctcgcaaatgcacaccggcaatacatccctgatctctttaaatttctattgaaagcctatctgtatgtgcgtaatattcacgagcaccagaatttaaaccttggtaggtaaagtcaatcatcaatgacttcatcacttcacagcaggtgttttccaagctttgctctagttaggacgcaattgaacatgagaacctgaaccttggcttggtcgcaaactccattcaatttgccacttgtttgggtattctcccaatttcaccaatcttgtggttttatagctaaagcctgaagaagaaaaatactccctccgtttctgaatataaaaacactgttgaatttttaaataatcattcgtcttattcaaaaatttttatgaaatatgtaaaactatatgtatacataaaagtatatttaaccatgaatcaaatgataggaaaagaattaataattacttaaattttttaaacaaaacgaacagtcaaacatgtttataaaaataacggcgtcaaatatttagaaacggaggggtacaaaataggatgtacaattgcacaactcgaaaaaaaaaaaaactgttccttaatttccataccacgacccagcgccagcggcacgaatctcaaaagatggatcggaccgcttggcgcgcccgcctaacgtggggagtcgacgcctctagaaagcgagaggacgccacacgccgagccatctctcgctttgcccccaacgaatccctcccccataccaaactccgccgccgccgccgccgcccg

SEQ ID NO: 9431 - DNA, 1501 bp, Oryza sativa
aataccttgattagcgtttaattgatagttaattaatcactaatcaaggtaattaaacaaaattgaatcagccgcacggtctcgctcgctgctaatgcgagaccgaccggtctcgctatttcgtcccgcgacacctcgcgacactcgtgcggtctcccggtatatatcgtcccacgagaccgcccgtgtcgtcacatccatatcattttcgcataatgtttgtgtcagaccgacggttcccggtatcgtcgcacgagaccgttcgtgtcgtcacgtccacatcattttcgcacaatgtttgtgtgagacggacggtataattctgcaaaaaaaatttatccctaatatttttgagaaaaaaccaaatcaacagtatattttcaaatttaattccgtgaaggggcacctttctcatttgtcctttcatcctcagcgtagaatagtgagtctcctcttatatatatagctatatttcatatatggaatgctaggtttgggacaataaatatatatgtgcaagatcatcatgggcccaaacccatagttttttaatactctatgtcggggcagcatcgatctactgagagtcgcagggagtgtggccaccggaggccctgttcattttctttttcagtggattgggtctaaccacgggaattttttatggggattcctaatgggtgagtctgtgccagcacgctcccccacgcaggttgctcgactaacggcgctcttagcactgtcaggattatggataccacatacctaatagtagttgactaaatctcggcaggacccaccacataccatgtcctatacggaagcaaccttgggatataagaggagttccggataaggaaagacaaccagagttctacatggaaacgacgaggactacttggattgtattcatattgggttccctagttcaacttggacaaggagatacctacgggtataaatacaagcccccctaggaggagaggggacacgagacaatcaacacccaacacaatcagcatagaagcctacatacgccaagacacgccgccggatatcgacttcagggataagcacggctagtaccctacggtgtctccggatactgtcaggagaaacgaaagcgccatctctgatctcgccgggcacggattcgaggagaaaggctaccctattgtcgactacgagtcagatcgtcagaccgccatgttgacaacagttagataggctaccccaaatagtgtattggtgtgattatcatgaataagagcaatatcggctccggccaacaggatgtagggttattacctgacaattcaggggtccgaacttgtataaaaatcctcgtctccgtctcttttacctcagtctcgcgtatatcctagtaccaacgatccctatactgtccaaataccatagtcgtgacatcaaacgtcgacagtggcgcgccaggtagggggactttggtgcttcaggatttcgacgagatgggttcaagaga

SEQ ID NO: 9432 - DNA, 1501 bp, Oryza sativa
taccactgagtttgttcaagttcaacgatttgccatcgacattgtctctctctacaatataccgacgactttatcaattattctatattacactattgggctgaaccttcctttcaaaaatacccaaaatacccttagacattcaaggttaacatccttacataacacgaaaatttgtatagaagttttaagttttctttgcattcctatttttttagaagaaatataacttatatgttatatgctatataaaatatttttatcattgtttttaatataaacaatctttcataccctacatacgatatttttgtgctattatatattgtataagcaaattctctttcatataccacacaaatatatatttttataaaaccaaaatataccagaaaaaaattgaaacttgtatacaaacttccatgcatgttgtgtaaggaggccacacaatttttttatatttttttgaaacttataatgaaataaatcaattcttaatcttatatgtcactaagggtattttgggtaattttgaaaagaaggcccagaccaatggcgtattgtagaacaattaataaagtcaccgatatattatagaaagagacattgtcgatggcaaattgttgaactcaaacaaactcagtggtatagaatagattctctcattatattttgggtaaatttcataaaacccctcattttaggtcaatgtttaagaaaaaacataagtattatatatgacttttggcatataactatttataggttttatgatctaaatgttttattaatccccacctttatttgaattttcaattgattttagcatatctgaaatatttttttttgaaagtagtgaagagttaaacgaacaaccttaatcaagaaatcaacaactaaagatttcatatacattctctgttctgaaatttttaagtaaagatttgtcaaatatgtatagaggtggggttttgtgaaactttaaaaccataattgttagggttatatgccactagtcataatgccttagggtttgctaaattttgctcttatattttacaagaatggcattagagggtttgtttggcagcaaggttgctgcagccagctgcttccgcagttgtgtgaaataatgttggcgttggcggcaaccctgcaaccaagcagctgaacagatgcagaatgactggcatcgattttgcggcaggtttgtaatagcttatttataaaacggtttcatatttacagtgttgccctaaagtttggcacttttgccgtgggatcaaccatctcaaatttgaggaatcagagtaatttcccaaccgttggtcttgcgttgagattcgtgctccggtggatgttgacggaggcaaaggcagccccaaaacgggatcgtagatatataaaggcgtcaagcgagcgcacaccccttgggggcttgggcagcgcgcgcgcaaaaccgagttcgccgcccacctcgccgccatggccatggagctcg

SEQ ID NO: 9433 - DNA, 1501 bp, Oryza sativa
attttttcatcataatataatcaagtatgatcttgttgtgaagatttaattgttgtgaacacaatggtgtaatcggataagtaatttgagagaaaactttatatttaaagaggaagaagacatacatgtctattaaaaaaatgcatgcatgtagtagacttctccacgtgcatgagacggttcggatgtcgctcgttaaggcaaaagcgagatgcctcttcaaatagattttaccaaagaagcctccacgtttgctctcatggcctaaaaattcctacgttaatcggagaaaaggaaaagtagagtctatataggaatacaatttaaaaatagctgaaatacagaattaaaaataaggaatatggaaagaggagactagggtccatacaagtatataatgtagaattaattaaaattcggaattaaaaaatatgaaaaactaaaagtataaggtagagtccatatagaaatataatttagaaataactaaaattcaaaatgaaaaaaagtaagattgggagaaaagtctagagtccatatataaatacaatttataaatatctgaaattcaaaattttttaaaaaaaatattagaaaaaaaagtctagagtccatataggaatacaatttataaataacttaaattcaaaatcaaagaaatacaaaatattgaaaaataaatttagagtccatataaaaataaaattagaaataacagattgggaattagaaaagtagaaatattggaagaaaagtatattgtccataaaggaatttagaactagctgaaagtcggatctaaaaaataagaaaattaaaagtagagtttagactccatatagaaatacaatttataattaaaaaaattgaaaattgaaaaaataaacaagattgggagaagagtttagcgtccatataggaatacaatttataaataactgaaattcgaaattaacaaataagtaatattgggaaaaaaattctagagtccatataggaatacaatttataaataactagagtaaaatttttaaaataagaaatattggaaaaaaatgtcaagagtcaatataggaatacaatttaccaataattcaaattcaaaatttaaaaaataagaaatattgaaagaagagtttagactccatatagaaatacaatttataaacaactaaaattcagagttaacagaaatgaatattggaagagtagtctagaatccatataagaataaaatttatgaataaaggaaacatgaaatttaaaaaataaggaatatagaaagatgagtcttgagtccatatacaaatacaatttataaataactataatatacaatacaataaaaatatcacacatttgttaattagttcaaccaagaatttaaaattatgttgccattttaatatattttaataataaaatgtaaaaatatttaagctattatatgagaaaatataacaatgctagccgcacaatctacgcggatcaccatgctagt

SEQ ID NO: 9434 - DNA, 1501 bp, Oryza sativa
gaacctatccgaaccaggttcatccctagctgcaacgcataatcaactgcttaagagacattgtctgacactagctagtacctgccgtgcataagtatacgcgcatatgctttatttcaataatgcttgctgagtactccctccgttttttcttcggggactatactttttatatggcgttattaaatttggtatttgtccatttgatatacaacgatgttgatatttagatatgatagtttgttatttgtcttattcaaataaaggattaagtccgatttacccctcaactaacgtgatacaaggatttaccccttgaactgtaatatcaaacatttgatgctcctaaaataattgattaagtttgtgaattatttttatttactgaagtaagtatataattaattatatattagtgaaagataaattcactacttcaattgtcaacccgttgtgcgatgattttgtcaaccccatgcaattatatcatagaggatttaactagaatattatgtgttagcttgtccttgattgctatctatcttatattcgaaggaagttatcgatctttttgtttgacctcgtcgttcaataaatatattggtttttaatagagatgttaatttgatccgttgtgcaaaatgcatggatgtgcaactagctagaggtaaaaaaaatatcagtgaaaaggaggaggaagaagaactacggtgacccatccggttattgctctgtacaagctagctactttttataaccatactctatacaatcttgtgtatggagctagctaaatactagataatttaaggccatttgtaggttgattgatccgccacgcaagctttgctacctaaccatttcaatgaaatagtaataattaaactcacatcttaactgcagagcacaaaaggtgtttgggagagacttagtttgacttgcattccctgactagctagctagctcgctcgctctggaaagcatgcttatgtccatcactacgctttttgtccagttaattgcccgttataagctcggattagaggaacgattccgaatagcacgtggtttagcgagccaaccaacgtcgcgggtcaaaccgcagagttgtacacacttgtgctgcaacaaacaaacgtacgcgcatattgcgcggtctcctgccaccaccttaccctttgccaacatgcatccgctccaagattaaaaaagcttgcgatccagaagctatctatcaaccgaacgctcccctgatctcatcttacctggaggctggagctcatcttcacctataaatactcgtgcacatcagcatcacttcatcacctcaaccatcgcaatccatcaagcaaatctcactagctagctagctatctcagctcactctctcagtagccactgatcagaagaagagcaagagaagccaattaagctagctagctaagctggttaattgccatgggtagtggtaataagctcgctgccaccgtggtcgtcgtca

SEQ ID NO: 9435 - DNA, 1501 bp, Oryza sativa
ttagcttataggaatatactcgctccatttacaaatagatcgcttttgattttgagttatcttgcttaatttgaccaactatttttaaaataatctaactatttagcctcaaactataattgaaactaacttactaatgcatattatgttgaaatctattcactttcatatgacttaaaaagtagcgctcaaagtttgtctacctcttatcaaaaccaacaattataagtgatgaaagggatcggagtgaaaaatcttagctacattgtaacattattatttccagtagttattctttatcatcccgttgccattaattataattcagtattattttatctatcacatccacccctcacaatcctcattgctgtatgttgacttttttttgcccgggtcgtctcttgtataattgatggtacattctctctttaccctctatatgccatctaggatcttatatgatatggcaatttgcaaagtgacagcctagctatgtatatattgttgaacatgccctaacattcagctaagaacaataaactgacctgctctgcgtacagatcgattaattgaacctcatatcagcccagcaactcatgcaatgaccaccgaaaaaaaaaacaaaaaaaactcatgcaatgaaactttataaccatttagttaactagatgagaatgtgcattgtgggaggtatgtatatatgtgaagggttaattgtagagtattcccgcacaaagcctggtagagtattttcagctaaatatctcgagtgaagtactcacttcgtccaaaatataagggattttgagtggatatgacatatcctaatacaataaatctagacagactccctctccagattcattgcgctaggaagtaggaagtgtcacatacaccaaaaatcttttatatttagggacagaaggagtattaaagaattcatcagcagttttgttgattgttttactggagtatttatgcccataaagaatattgtagtatctagctgcacaatcactgttcaaagcaggacacaattaaaatggagtagctggcttaattagtctgttgatttcttttaaactgtcttaaaaaaaaggttctactcctccacatatttatgtagtgacggacctccagaagaaaaagaaaataaaacagtaggggagagcaatatctagctaggtacactttactccaaagcatatatactctgctcaatgctttacccagtttgtagttggattatggcttccatgttcataaacacagctattatctcccatataataattatactccatcattcattgatgagttcaattaagtaactatgaatgccccaagacttagtccggataatgcatataaccatcatgcacatgcatcacacctataaatacccatcattactacatactaacacaccatcaccctcatcttagcgagctagctctttaattagcagattaagcagcagcagcaagaactgattacc

SEQ ID NO: 9436 - DNA, 1501 bp, Oryza sativa
agaattcaagaaaaaataaaaataaataaaaatttcatgcaaaataatatcatatcagagggtacgaaatgaccgaaatttcgaaaatttcagttcgaaatgtcgaagccttaattgtataccactccgcccgtttcatactattataattcgttttgattttataaattaaatattcttaaaagtttatcaaatttatagaaaaatgtagtactatttttaatataaaacaaatacattattaaaatatattcgatggttagtactttcgtgctttacaaattgtcgaatttttctataaattataatataaaataaaacaagtatagtacacatgcatatatatatatatatatatatatatatatatatatatatatatatatatataggaatgtacctcaacgaagcagtcatggaagagcatgcggatgaggccagcgccgacgccggggttgtggaggatggcggcgccgacgacgttcttgacgatttcctcggcatgcgggcacttggcgtagtagtaaccgaccttgagcccgcacgaagcagggttgggtggcccgtaagctgcttggcacgtcgtcgtcaccgccgccatgagcaccgcgaaggtgacgacgaccacggtggcagcgagcttattaccactacccatggcaattaaccagcttagctagctagcttaattggcttctcttgctcttcttctgatcagtggctactgagagagtgagctgagatagctagctagctagtgagatttgcttgatggattgcgatggttgaggtgatgaagtgatgctgatgtgcacgagtatttataggtgaagatgagctccagcctccaggtaagatgagatcaggggagcgttcggttgatagatagcttctggatcgcaagcttttttaatcttggagcggatgcatgttggcaaagggtaaggtggtggcaggagaccgcgcaatatgcgcgtacgtttgtttgttgcagcacaagtgtgtacaactctgcggtttgacccgcgacgttggttggctcgctaaaccacgtgctattcggaatcgttcctctaatccgagcttataacgggcaattaactggacaaaaagcgtagtgatggacataagcatgctttccagagcgagcgagctagctagctagtcagggaatgcaagtcaaactaagtctctcccaaacaccttttgtgctctgcagttaagatgtgagtttaattattactatttcattgaaatggttaggtagcaaagcttgcgtggcggatcaatcaacctacaaatggccttaaattatctagtatttagctagctccatacacaagattgtatagagtatggttataaaaagtagctagcttgtacagagcaataaccggatgggtcaccgtagttcttcttcctcctccttttcactgatattttttttacctctagctagttgcacatccatgcattttgcacaacggatcaaattaacatc

SEQ ID NO: 9437 - DNA, 1501 bp, Oryza sativa
cctcctcctcgtcctcatcggtggggctggctgccgccgcagctcgtcgtcttcgtagccgtcgccaccgccgctcgtctcgttgccgccgtcacgcgggggagggcgggagaggggtgccgccgctagatccaggcgggggagggcgggagacgggcgccgccgccggatccgggcagcggagaggtcgcggggacagccgccgtccgcctccgctccggccacctcctccttgtcggcgggggcggcgcggattcgcgcggggccaacagcgccactcccggccacctcgtcggcggtggtgggggcgattagggccccgctcctcccgtcgggcaccgtcactgagccatcgcgcccgcctgccaccgcatgagaggagaggagagagaggtggggtgatggggtgaggaaaaaggatgagggtaaggataaggataagaggtgagagagttggaggggatggatggaattttttgaaatgttgagagggaaaagggagggagggtatttacgcatgcggtagtcttaacatgcccgcatgcgaaatcgattttcgtgtgcgatcctattaagggtccgcacggaaaaatgggaggacaattttttccagacgggtcagttatggaccgtctgaaatttaacgaggggctcgtccacaaaaatgaattctgtactagtgctactataaggttttgttctcaactcgaggctcccaaccttcgcttcttcgtttctcgcatgcacacttttcgaactagtaaacaatgtggtttaaaaacaattctattagaaagttgttgtaaaaaatcatattaatctatttttaaagttttttttaagctaatacttaattaatcatgtgctaaaaaataaccccgttttacttgcatagggaacctctcctcccgaatattgactgagaggtggcaaaagaaaactattgatcatatggatattttgactttatgaatccaacattgagcaatgctacagctccattctaaaaaaaaattaaagagtatatgactattttgactcaatttataatcaaatcaaataatgagcaatgctacacagctcaattctaagaaaacaacaagcaagtggacttccctgcaacaaatcatgcgatggcactttctctggaagaggcaaaggaaaatcagtacagttcacaaagagagaataggctccatccatgcagaatatcaaatcaagaagccgcgcgcgcgcagctagctagctagttcgttaactgtgggcacagccatgttcatgccagctaagatttctcatcaccaatgattgatcgatttctctccatacgccgtgtgccaatctaacgaatcgcagtagcaacatcgaatccgccatcgttccttagctacgccatataattaaatcgatctctccatctataaatatccattcgatttagcgtgtcaacttcatccatctcacgccaacaatcacatcatcatctcagagcaaaagcagc

SEQ ID NO: 9438 - DNA, 986 bp, Oryza sativa
tacatgcatatgatgatctgtcacgctcacattgatctcatctcactgccgccatggattgcaaatgtgtgattcagaaatgcaatgcgacatacctcgacgaagcagtcgtggaagacgaggcggatgagtccggcgccgatgccggcgtccttgtagacgaacttcttcacctcgtccctcacgatggcctccacgcgggggcacgactgcttgtagtagcccagctgcaggccgtggcacgccgacgcgagcgccagcgcgcacgccaccgccacggcgagcttcatgcccgatgctgccattgctcgtttcagctcctgctgcttttgctctgagatgatgatgtgattgttggcgtgagatggatgaagttgacacgctaaatcgaatggatatttatagatggagagatcgatttaattatatggcgtagctaaggaacgatggcggattcgatgttgctactgcgattcgttagattggcacacggcgtatggagagaaatcgatcaatcattggtgatgagaaatcttagctggcatgaacatggctgtgcccacagttaacgaactagctagctagctgcgcgcgcgcggcttcttgatttgatattctgcatggatggagcctattctctctttgtgaactgtactgattttcctttgcctcttccagagaaagtgccatcgcatgatttgttgcagggaagtccacttgcttgttgttttcttagaattgagctgtgtagcattgctcattatttgatttgattataaattgagtcaaaatagtcatatactctttaatttttttttagaatggagctgtagcattgctcaatgttggattcataaagtcaaaatatccatatgatcaatagttttcttttgccacctctcagtcaatattcgggaggagaggttccctatgcaagtaaaacggggttattttttagcacatgattaattaagtattagcttaaa

SEQ ID NO: 9439 - DNA, 1501 bp, Oryza sativa
gggcgccgcggaggaggtcgtcgtcggcgtagatgttgcagtcctggaacgagaagccggtggtgcgggattgggtggtgatggtgttctgctggccgcggagggaaggcgcgtgacaatgtcgcagtgttggaagacggcggtgatgcgcgtcgccgaagatgagttagatactgataaattacaataataccttacgcgaattattatccctggacgaatatacccttccacatttctactaccactaattttggtgggagtagaaataaatcataaccctacaattaaatatgatcaacggctcagattactttctactccaagtagaaagcaccggagcgggactcttcttttaattatcgcagaagtatatttcactgcaaagaacccgtcaattgaaagatcgcattgctctagaggaacatggcaacgtgccaaagtagttgattaggcaaccgcctggattaagatgctaaaaccatttgcgcgacggcgcaacaagaagcaaaacagcatcaccaagcccaagaatcccagccagtaatgttatcgttggagtctttgccagctaaatacagtgtttctagcacttacagcctttcacgacttattgatcatacatatatgttaatccattatgtaaaagaaatatatgttaatcccaacttggtactaataatcccaattggaccatacctaggaggaaacagcaatgcagctgcctgtagagacaatagttttccattgtcccataacaaataaataataaatatagttaattaaaggaacagagtgaagtcagaaaatcagaatatgaggcgaatgttggctggcgatagccgttaccgggtttggttattagcaatttggcagccgtcaaacactgatgtgtcacacacatggttttcttatagattagtaccgtgtggtttactcagtaaaatttggtcctatacaacttttttttggctgtgtgcccacggggcagaggcagtagatgtaatcaattttcattattaaaaaaaaaacaattttcgtttgcagcggtcgacatttttcttcagtaatcaaaaccggggagcatggttcagtttttgtttgtttcagcatgagcagactgaagctaagttgatcactttacgaatccaatagagatggcagatggtcagcaagcacagcagctgaactgattggtcaggaggtagttaccaacgactgaaatcatggaagcttctgcagaggagagataagaactgagcaaagtcaaatgctaggacacacataattgcgtcgtcgaccatgttccatcttccatgacagctagattaatttctgagcccctgattagttgctccttctccatgatcgttagttgttcgaatccaccatggatcatcccatgcatcaacataatctcaatctataaatagccatctctgtatacgatcagcagacagcagaagcagaagcaggcagtccatcgatcatctcttctctt

SEQ ID NO: 9440 - DNA, 1501 bp, Oryza sativa
gttgacgtccaggcggcggcggcgttgatggcgtcgatccaggcgtcagcgacccagatcgaactcgcggcgccggaggaggaagacgcggcgacggcgggagtgaggaagcacagcgtcgacagggcgaaagcacgtcggcggcgggggtgaggaagcacgtcggcgggggtgagaggcacggaagaagacggcggcggcgggggcaggaagcacggcgggtaggggcgggacggcacggcccgattcaatctagggttcccatagcgaagttacatttttgcctacgggcgggccaacggttagtagaattgggtaccgttcggtaccagtaccgctggacggtaaaaaggctcccattatttagagtttgttggattgtccacccttttcctctcactttgtttgtatgggcctcatcctatcctaacccaatccacatggataatccaggattaatcaatatccaaatacatggatggaccaggattagggcccattcaaacaagcctgagcggtttgccattctccagcagaataacttcacctgcaacaatcttcagacaagcccgtttcccattcctcctacacgatatatgtacagcaagcatctccatctttgaccagcaaagactgtagatttgtagtcagccatcacaagcagaagcagtatttcactgaacatagctacagctacacgagtacacatgcatatggagatgcaagcagatcgatcaggccacgaatttcaggcagcgggtatcgttgtgaatgacctggcagcggcacgagcagaacctcgtcccgcacctgacgcacgtgtagttcgccgtgctgccgcagaccgagcagtaatggcgccgggacgaggtgctcgggggaccaacggcggccctggagtacgttgggacatggggaggcagcgactccaggtttgcctggcgaacacagttcaggagtaagagatctcttgatcttggtcatcctactgacgcgaggtgcacggtggatgagaaatttgcgaaataggatcatgaatcttggttgagaatatgagctataatgagctgttccgcgtacctcctgtaacacgtccatgaaagatctcgccgccttcttctccaatgccttcccttgcctcgtcttgcgcttcatattctttgactgcttcctctgcatgagaactgtagaaaggcagatgacaagagaaaagaagattttcacattaacactagatcaatacatcatcatttttttctggggaaacttaaactctctagacaacggtgcattctaattgcacacacaaccacagtccaaacagcctaacacttctgcaaccttccaatttgtcgatattatcctaaataggaaaatgagtgcattgtttgacgaaatggtgaaaccttgactgctataggctacatgagaccacaaaaagtaaatccttgaccaaaaccaaaaaaatggtgggaatattatagcagcacatgcgaaagac

SEQ ID NO: 9441 - DNA, 1501 bp, Oryza sativa
tgtagaatggagatccaaagggcccgacggcagggggttttcgatactggattcatcgaccctcggaaagtaaacgttgcaatgctcgaccaatatccgcaagccacagaggacaatctcgtccatctcctgaaggcgcaacattacaagacgttcatactgttgccgtacaacacagagttagttcaattttactgtcttcctataccaaatttcattcccgtatgaacatgctaagtatttcatatgtaatgcatcccacgcacattgcagattccactatgtgcttttactcttcgacctggaggcctgcaccgtcaacgtatatgactcaatggataaaaaagagtctacatttgacaaggttttcgaacttatagacaggtactgtcataagttcctatattaattaagaatcttgttatagttaattgctactacgaatcatagctttaaactgcatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatatctcgtcgtttgtcatttatttatagtgcgcaaagcaaaagcaaggaactaacttgtgcggctactatgtgtgcgagtattgccactgccttgcagaccaaatcatcaccacaaaagagctcgatgtacgtacaaataaattcaaaatttcattacgtatcgatttgttgtttaattactaatcaatttcatacattcatatagtttattggcatgagggataacctgatcacacacaaggaatttatcgcggcggttcaagaacaactcatgggattcatcaacgaacaaatccttgatcctaagagtgaattctactacgacggaaacacaattcataagtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatatatatatatatatatatatatatatatatgtatgtataaatacatatatattatgcatgtacatatgtattgaaacatatatatgcatggtttatatatatatatatatatatatatataaaccatgcagcaacagggccatgaaaaaaaaaggtcagctcgatctttagtcccggttggtgtcacgcccagaaattctcgaatagaattccaagcagaatgtgcattaaaatccctgtccaggaccggccggggtacacaagcgacaaagttgacatacagatccacgtcttacaaacattataaaagtcttacataaatgcagcggaaaacttaaaggataactggagctaagccttgacttggactgcagcgggaacaccactcc

SEQ ID NO: 9442 - DNA, 1501 bp, Oryza sativa
  unsure (1)..(1501): unsure at all n locations
gacaggacccttcgcataaccccctctaaccaagcacaccacacctcaggtttcacccccactcctcgcaaggcagcgggcagtcccctcttgtgcctaggtgaatccggaggccgcataggcagtcgggggcccatccaaactccatcacgcccacccttgcctggatgcgtcggctagaggaaagctacactacaagcccagccgttgcccacgctggcttgtggtaagtacgaggaattcgtccagggtttcccgcgaaccggtccttaattgccatgggcgcgaccatccaaaccatgcacccacggcccaccatttaatatattttaattaaccaacaccggagcggtgagtattaaccaacatcattactagaatgtgattaatgtagtccctcattgtgtgctagttgaactaagcaaagttaagcattccctagtccaatctctagtcatgttatatcccaagttaacaaaggaacatggtacaagatagcatggccatgacagtaggtaaacatcccatagtaatattataaaacaatgcagaatttaaaggaaaacaatagagcatttgcaatataggatcaacatgttcaagtgactagcatgacttgccttgctctgcagctggaggaacttcggcgactaattcaaggtaaaccggagtgtcgggagagccggaatctaagcgacatacaaagcaaacaatacaaacaggctataagactactgaaacagagaacaaaaccatttttaatggattctacacatttttcttgatttactgagacttgaatgggcttaaacggagctcggatgaattagttaagaattttagaagattcactatgtttttactataaacggaaaaatccttaattaaattattgcgcaataaataaatcccggggagagagagggggcggcgctgacatgcgggccccacatggcagtgacccgaggagggcgctccacggcggaccaggtccacggaccgggggagaagcggcgtaccacgtggcgcacacgtggcaccgacgcggcggtcacgcggcagccgaaccgacggccccgatctacccaagggtagatcggacggcgggtgtggctcgcggccggcgcgcgcaggcacggctcaagctggcccggcggccatggcgcatggcggcgcggcgcgcatgcggcggtggcgcgagacggcgaccgacggcggagagcggcgtcgtgggtggctaagcggcggcgcggcggctagcggcacgggagagagagagggaggggaaggggaggcctcaccgacggcgagcaacggagggcggcggcgacggcgggacgatctccggaatcacctaagaaatcgaaatggagggattagagggagggaggcaaaagggagagggcgagggcgccggccgaaggtnnnnnnnnnnnnnnnnnnnnnnngcgcacggcgcggagtggattccgacggcggattccggtggggaaggggtgga

SEQ ID NO: 9443 - DNA, 584 bp, Oryza sativa
tgttaaaaaaatgcatccaacgtttttcctacatagcagttcaaaaagcacatagaactataaccctcgtccaatatggtccctcgtgtaatatgcatccttctctctcatttagtactctttctacacctcagagacaagggcatccttctctctaggactatatataacctgatgcaggccatgtattggttttgcttccatattaagatagtaatatttttttaaaagaaatatatagttcttgacgttttggataaggttgaggtcaaacttttgtaactttaacaatcaataactttaaaagtatttagtttaaaagatctagaacaacatatatggatttgtcttttaaagttatataattaaagtaaacatgtatttatttgtgcatcatccaaaacgtcaagaattatgaaactggattgagtaatctttgattccattttctgtttatgtttcagttctgcctatgttcgtttgtattttactagacttcatatataggcactaattaattattgacaagccaatctacatacatttcaggcaacaaagagattaccagacaagctcgtgcacca

SEQ ID NO: 9444 - DNA, 1501 bp, Oryza sativa
ggtctattcggttacccgaggagactaaccgaattgaccgaacaaaattcggtctttcactacataggaccgaattgatgaccgaatttctcggtctcggtcttttcggttcggtctttttctgcccacccctagcagaaggcaacaccgacgtcctagatctgctcgcctctgctcttcagcctagatccatccgtctctcctcgccgcgaggagtcttgggcgatgatgatgccaaagcagcaaggaccgaggaaagaacgggcgtttctcctctttgacaagctcgtgcacctccctaacagcctccctcatcgcactcgcagctgcttgacgtgtcttcaccgcctccgagtagttgcccggtgatccacctcgccaccgatggccaccttggcacccaacacagtgaggacaactttcgtgaggagccccaggtggagctgcccgacgtcccgagctcccacagcggagcggacgggttaaagtcggggagcagtgagtaggcactgccggtagtgagattcggatggagcatgcagccaagagaaaggggagaatgagggaagagtgaggtagaaatgagggctattttgtcgaatacatataaaatacacatgttagtggcaccattgagttctcaactcatcaccctcgttttccacatgcacacttcttaaattgctaaacggtacgcgttttggaaaaattttatatatgaaagttgctttagaaaatcatatgaatccatttttcaagtttttttagctaataattaattagtcacgtgttaatctatcgttccgttttccgtgcgaaggggagggaatccctccaaaagatcataggctgagagtacaaacaagtatagacctaattaagacaactccattgtttgggttattcgtggaataagccaaatgacatattcgcaaacgagaagtaatttatgaataaaatttttatatacatgtttttagcgacctaaaagcaaagacagaaagataaatttcgatgaaaaaacttaaaatcggttttaaatttaaggttgaaaatttaaattttggctgataagcaaaagcataagtgaaaagatgagtcacacacagatgaaaaaaaaaagaagagaaaaagctaaccaaatcttcctcggccggcgtcccgactcccgagcgcgccagtgcggggcggggcgtcgttgctggccgcgccgcctcctcctcctcctcctccccccaccaccagtccaccacctccctgatcgaatcgaatcgaatcggaatcgaagcgggcgcccacttgaccaaaaaaattatccgttcgaatcgcgcggagctcgtgcttctcttctcgagtcgaagccttgcctaccttaacctcgcgacggctgcgctgcctgccacccccaccacccccagatccggagatcccgcgcggcgcggagcacactggagcggagcgagctggtgctgcaatggcggcccgcccctgatccgatcca

SEQ ID NO: 9445 - DNA, 1501 bp, Oryza sativa
ctacgcgtatcccaacactctgatcagagtataacctatttgaatagccataccctcggttatgggcaagcctagcaatgtacccaagttagtggtttcactcttaaaacttgttaatcaactaaaacctggaatggttttcctaggttggcttgggacgagctggggcccggctttaaggctgccagttcggtctgacttatcgtaggccttgggttaaggcaggttcgtgtaggttcacggccgtggataattgtaatattgtgtagacctaggtttgaatttattaaatggctttgagcaactaagtggtttaaaaggttgttttactgcaaaacctaactaattattattacacctttgtaccccttatatttattgtgcatttgtcagtgtgacttgttgattacggtggttgtactcaatcttgctcaatttttcccccatcccagaagaggaattcttggaggatgatggcttcggtgtctagctcatgcctgccatcaagtgcatatggtcttcgccctagtcttccgcgcttcttcttttatctctgtgtgttgggcctttggtcgcccatgtaataaaaatactatttacgcttcctcttgttaaactctaatattgtatcaacctttgtgtacctcgtctcctgggacaaggaataatgcacgcacgaatggaaaacctgtcacctgtcgggttatttccggtcgtgacacatgacaagtctcatgtgttgggcacgtcacgaagtgcatgtaaagcatacatccactgcaatgtaaataaataaatctattcaaatagccaagctcatggttaaaagagcaatggaattttcaatactcttgacaagcctcataatatttgaacttgcttagaataggttggataatgatgttggacaaccccggaaggcgggactggtcgttggttaagagaaatggtgattaattgaatggtgaagttaaactgaaccaaggtgggggtttggggaggtggatgaaccctctactattaactacaacttcaacaatatcattgatttaagttaaaaataggtaagtcgtaggtttgcaaactatttaaagaaaactagttttatgcaaaataaacccaggccgctccttaattccatgtgtgcattgtagtagtggcttgagagtacgttcgtactcatcgtggattatgcaatcataaacatgtaatccttaattcaatctttctcttagatgcaagcaatattatagatcgaacctaatcgagacagcatggattgctcgtaatttagacaagatgaattaaagtttacatgagtttatatcacaacctatgatacaatacttaggttaaaatatatatagtatcagctattactctgatacagccttatataagaatatcaatctaggaaatatagtttaaataaagtgatatacttatataaaggacaaatataacatgaaaaacatgattaaagaaattaaacatagcataa

SEQ ID NO: 9446 - DNA, 1501 bp, Oryza sativa
gtgacagtggttcttgtctgactagaagagacctcaatcaactgatctatagtgaggataagctgcttactgcgtattcagatcatggcaagcctagcaaagattgtacaaataaatttgcatcccaagaaatggaagccaacactcctactagttctgttccccaaaaggaccactcaaagctgtcaagttggcttccccctgagctctgtgctatatacatgaaaaagggtattccagagctgtatccttggcaggttagttttttcagtttttgctcatgtccaatgtcgtgcttttgctagtcatctgtcgccagcagaataaaacattgctctaaagcacaactgtgcaagttaaaaaatttgtatttgctgctattctcacaaaatatgactatatgctactacctccgtcccaaaatataagaagtttcggggttggacatgggtattaagaaagtaggtgaaattaaatgggggtttgttgtgattgattgagaagaggaagtaggtggagaaattaaaaggtggaaggttgtgattggttgagaaaacaatgtaggtgcaggagttgttatattttgggatggagggaatatttcatttatgctagtaaagtaataaatatattctactcaccagattgaattaataacaaatcctaagaacctgttccaacttgtaagtacttgtgtcctgtcaaactactccatatttcctaaacattctgtgaattaagggtatgcatgccaaaaagctacttctcttctttatttgaagggatccacgcagaaaagtccaagctactatcttatcatatgtctaccacttccatttgtacttagcaacgcgtggacctggctttctacaatctgctttctgaggcaaaccactcaatttctctttaatttatctatttcactgacctgatgttacttgactatcttagtttttgccaaagctaagtgtttccacatttgtcttctattttttcaaagaagtataattgttctccatcattttcttgtagaacatatctgaacatcataagcaattaaagatgttgccttgattacaaactcagtttaaaagtaaccctcacatactgtctgtttcaagtgcttctccacagaggcatgctcaattgtattccttatccatagggttatgttcccatgtctactgcaggtggaatgtttacttgtggaaggtgtcttggagaaacgcaatcttgtttattgtgcatctacaaggtactgggagatcttgcactcttccctgttgattgataatctcagtatccccatgattcagccctttttgtataagttatttttaaacttgtttcttttgtttgaaatgcatacttctccagataccaccttcgagtttttattagtatattcataaaaataattcctatttcatatattacagtgctggtaaaagttttgttgctgaaattctaatgttgagacggatattgttcagtggaaaga

SEQ ID NO: 9447 - DNA, 1501 bp, Oryza sativa; identical to SEQ ID NO: 1282

SEQ ID NO: 9448 - DNA, 1501 bp, Oryza sativa
aaggaattgtttgaggctaaaaggaaatttaggtgacaaggatataatttattttcttagcacaagagcaattattcacaatatttgtaataatattattcttgtgccgagaaggaaatcaagccacgggaattaaattagcggctagatcaaaaggaagaatttagatatttggcgataaataagaatatgtttggaatcaaaggataggtttaaaatcaaaggatgggtcgacaattaaatccaattggaatcgtttggtttaggttctaggacaatagtggagaatttcttggaccataattcataaaaaatagaaaggggttttcaaactaaatttgaataaaagaatttttgtcaaaagaaggttttaaaccaaatcaagaaatacctcaatttaaccaaatatatattttaaaataaaaaacattttagagattaaataccgcataaggattctgtgcaagttagttttaggaggtccctctaattatattgtcctaagtttaagaagttattaagaacataagaatcggcatgatgcaggattggaaaatgacacattttcaagatgttacattagaactccagagagactgcaagctgcaagaaagctcgagcgatgtggcatctctttctttgttacatgtgtatttatttatttatttttcgcatatgactccataatctattttaaaagctagttctgccaattgcaccaactttagaagtattgaatattgattgattaaaaacattttctacccctaactcgaacgacaataatatttgaagctagagagatggtactagttaaaaaagtttggagtttgaattaaacaaacatggccaacatgaagatgaagacaatgacactagcattctcattagccaaaccagcgttaagtccttaagtatatgtcgatttccataaggaatgacacacaaattcaatgaacaaaaataaaattacctaatgtggtataaaaaaatcaatagatgctccaagccagcgatagcagtccaccctgtcttaaaaaatgagttgaaagcaaaattggaagagagaaagagctgtagccggcgactaaattagcgccaactcctcacgagttacaagatagtcagggccggtcctgggtttttgggccccaggacgaaaacttatattgaggcccttatatatctatataaactaatacatatatttatataatcttataaacacaacatttaatattcgatttgataaaatattatctatatataacattttaaaacttcaaagagaaataacataatcataaacacttactagttggcactttcaaaattttggctcattgatgcattagcattacttgtgaaaaattctgtcaatagttcctcgttgtgtttcaatgaaatcatccgaacgctttttccgtttccttttttcgctaccggatgcatattttctcgaccacatgattaatgttgtgctgaaaaaataatcatcatg

SEQ ID NO: 9449 - DNA, 1501 bp, Oryza sativa
taagatatttgtatccctgttttacgacaggccagacctatataattaggaatcggctaggggagtagattgaggaagaaacagactgtgcccatataattaggcatttgttggaggggtgaattgagaagaaagtactagtagagcttgttcactttactgttaaaatcaatcttaccaaaatttgttagcgttggttttgattggtttgaagccttactaaaatttaatagagttttttttagagaactttcggaattatcaatgtttgtttgatttgatacgatagcaatgataaagttatgtttggttagttacctctaccaaatttcggtaacgttaaaacctgataatttcataaatagcagtaagcgaagagcaataccaatatatactacttcctccttttagcttataagacgttttgactttgatcaaagtcaaactattttaaatttaactgagtttatatataaatatagtaatatttactaaattagtgtcatcaagttaataattaaatgttactatttcttctataaatttaattaaatttaaaataatttaactttgatcaaagttaaaacgttaacctgaaacggagacggagggagtacctcttgtcggctgcgcatgggagtgtgggactcttgtgcggacgccagcttcgcacagtaattaatgtgggtcaactaatcaactgtctacgctggtgtgtgtcgtcagttttattttggcgagaagttggcgtaggtaggagagaatctcatgtcccaccgtgctgcccgatattaaaaaatagtacgtacgaaaggacacgtaatttggtggttataatagcctcagtagcaccttaatttctgggttcgactctccatgaaagttaattttttaggatttagcggtattgttctttcggtggtagacaacgtacccatcgacagcgagacgtctgtggtgacttcgttaatccccatgatttgccggtccaatcttcaaagagtactcataggggtagggtttgcgtacgtgcgtttatagagggtgagtgtatgtgcgttgtgagtgtttgtgttgtactgtataatttaaaaaaacgcattgaaatttgcaaaaaaaaaaaaggtcttccaaaacatttgaaaaaaagagagtgttttcacatataggagtaaatgtattagggatgaatcggtcggaacatgtacaacaagctgaaccatttccttgatcatactttttctttgaaacataataaaagtagtaagatggaaaaattagtatcagaaatggagacatgagccgcatgtactagcctactaggggtatttataaatacgacaatttatcacactgtgaaaaagtaatttccaaaataattaaaaactcggcaaaccaaaggaaatggacagtaaaaataacaaaattatttccattttgtttcatatctttttatcatttttgtcgacgtttgatgtcacgactacggtatttgcatagt

SEQ ID NO: 9450 - DNA, 1501 bp, Oryza sativa
gaccgccaagtcgacaacagatagataggttaccccaaatattgtactggtgtgattatgatgaataagagcaacaccggcttcggccaacaggatgtagggctattacctgtaataaggggcccgaacctgtataaaaatcctcatccccatctcttttacctcaatctcgcatatatcctagtaccaactgtcagggttatggataccacatacctaatagtagttgactaaatctcgacaggacccaccacttaccatgtcctatacgaaaacaaactgcagatataggaggagttccagataaggaaagacaacagagttctacatggaaacaacaagtactactcggattgtatccatattggtttccctagttctacttggacaaggggacacctatgagtataaatacaaggccttctacgagataggggagacagacaatcaatacccaccatagaagacacgaacaatagatcaagacagaagatcaacatacaagccaacatacgtcaagacaagatgccagatattgactttagagataggcacggctagtcccctacggtgtcccggatactatcaggagagacgaaagcgctatctctgatctcgccgggtacgaactcgaggaggaagactactctgttgtcgactacgagtcagacctttagaccgccatgtcgacaacagttagataggctaccccaaatattgtactggtgtgattatggtgaataagagcaataccggcttcggccaacaggatgtagggttattacctaacaattcaggggcccgaacctgtataaaaatcctcgtctctgtctcttttacctcagtctcgcgtatatcctagtaccaacgatccccatactatgcaaataccggaatcgcgacatcaaacgtcgacaccaacgatccccatactatgcaaataccgtagtcgtgacatcaaacgtcgacaaaaatgataaaaagatatgaaacaaaatggaaataattttgttatttttactgtccatttcctttggtttgccgagtttttaattattttggaaattactttttcacagtgtgataaattgtcgtatttataaatacccctagtaggctagtacatgcggctcatgtctccatttctgatactaatttttccatcttactacttttattatgtttcaaagaaaaagtatgatcaaggaaatggttcagcttgttgtacatgttccgaccgattcatccctaatacatttactcctatatgtgaaaacactctctttttttcaaatgttttggaagaccttttttttttttgcaaatttcaatgcgtttttttaaattatacagtacaacacaaacactcacaacgcacatacactcaccctctataaacgcacgtacgcaaaccctacccctatgagtactctttgaagattggaccggcaaatcatggggattaacgaagtcaccacagacgtctcgctgtcgatgggta

SEQ ID NO: 9451 - DNA, 1501 bp, Oryza sativa
ggtcggcaattcgatccaacccaaaaccacgcacctttcccgaaatagctcctcccaactggcagtccaacttgccccaaaaaggcaaatgcaaagagttattctccccttgaccaaagacgtttccaaacttttccatcgatcgatcaagctaagagagaatcagcagcagctacagagataacaaaaattatttcatccaagttgcccatgcaaatgcaagtagtatgtgcctttttccggtttgttctactgttgctgtcgattcggattaggccggcgagctgcaagttgcgcctcatccgtcgccgtcgccgtcgccggcgacgcaggccggcgccaccaccaccaccaccaccaccaccaccacctgcgtgcgatcggaattaaaattgttcaggtcgagagacttcggtacggtcagatggagaagtatttgtttgtactatctgccctgaaactggtcctgcgcccaagttgctcccgaaaagttgccgcatgtatgcatgcgcataattttttctatgtgccgacaacagctaaaaataattttgggatttcatagtttatttttcgacatacattttaaaatcactaagaataaatataaaagttttaccttaatattattggtaaacagtttacgacatatataagctctaggacaaataaatgatatggcgggtaatttcataatgcaacggatttattatagccgcactacttcgcattcaatggatttgaatcattctattatattgcatatcatagtgtgtggaaaaaaatgttagtaaaaaaatatcaaagaaaagagatattaataaaaaaatgggattaagatatataatggtatagtaaaattcacatgtaatatggcatatgttacatcaaataaatggttaaaattacacttaataaaatgatgaataattttttattctctttaaaccagaggttatatttatgcagtactactgttgaaattatggttaaaattacacttgctaaaatgacgaataggttttatttatcgctagtagtagaagatactgttaagaatagcttttggccgttgctaccaggcaactgcttgagtgattgtttggttttacaagtgtatctagatagagatctctgggtccatttcagagatagagatactgcttgctgggagtcaccgcatatcacatccactgcgttcagcaacttgtgcaactccactcgtgggagatgcccgcagacaaagatgcatatatgcttggatttttgccaggagtgcttgaaaaggtattatcttaacgttatatccactattagttgggaggaaaagtctactgattataagtacaatggaggaaaaattagagaaggtatataaagaaacacacattatttagaaaaatgaaaatttcttgacagaccaatcaaccgtacttctatgtgtaaccaaaccatgcaaatcattcaaaatacatatctagattgttgtttttcgccaggt

SEQ ID NO: 9452 - DNA, 1501 bp, Oryza sativa
ttttttttctgaatttgattcaaagggggaaaatataggatatgatacatgataagtaataagttatcaaatactatctccgtcgtaaaataactttatttttcacccattccgcacgtaccaatgtaaaagcaaaatgataagaacaccctccactattaaatcccaatacaattgtttttcacttaattcagttctagtatttgttccattctttcacaaacttcaatacaatgattgctcaaagataaatttagtatgggataaagattaccttattttgagatgggggagtactatatattctctattccaactccgagcaagtgagcaacaaatatgggagaggatacataataagtaattatttcacgggtactattcgtttatgagaaatgacagagtcagtgttacagaaaagtatacttcttatacctatatttatgactaccgggaataacgtatacctggtcctttatggaagagtatgttcaaaaatagatgtcagactctgatccgtatgctacaaagtcttatctgttcatagcctatttgaatcacgagttctatttagacaagaggttgtttgtccgtataaatacaaagcccctagggaggagagtgcattggatcataaaccgtaaccacaagccatatcccatatcgaatatcaatcgggaggaaaccctaaatctagtctttgattacaagttgctagtttagtcctcaccgaaggtaagctggtaggccaaattagctagcttgctcttcctttataatcggtgtaacacatctcatagcagctgtacatataaactagattatggctattaccccatttcggatgcttgaccgcttgaaccaaccagtataaaattcattatcttccgttttcttttttccaatattagatataccctcatacgccttttaaaatatcgtcattgagcttaacctttcttaatttttaggggcaattgtaaattcaccactattttgaatcgttattgtaagactgctactaaaaaattgcaaaaatgctattagaactgccattaaaatggcatccttgcaaaatttttatggataaaaaaaaatgacgtacgtgatccgacagtatccatcctgtaccgctcgaaaaaaattattgagcttgccgagccgagccgagccgagccgtggagccaggaaagaggtgaaaatccacacaaccacctgttattatctcccctatttctaaattacaccaagccccctaatatctcggcggaatcctctccaactcccctcccctcacctctctcctctataaaaaccctcccctccccatccacccatcctcctccaactccaacggatcactcaccttgcctcgccctcgccctggccaccatccaacgacgtcgactcgtcgccggcgacgactccgggccgcgcacatacgcctggtaatacgtactacgcgggaaccaaatcttacgcacgcgcgcacgaacgccca

SEQ ID NO: 9453 - DNA, 1501 bp, Oryza sativa
cccggagctgaccaaaggagggaggaggaagaagatgacgatgcctgttggtgttcagagtaatattgtgcatttcctttgggttggaaatgggttgagaatgggttgaatccatttgtctgcacttggtttggatttgtttgggcttgctctgtgagtggattggattggtttggtttctgcaaactatgaattgaattggattggtttagaagtgtactatagagacaagtgaactggggcggttttggtctggatctcagtccattagcaggcttaatgacagtatagcactgcctcctttttccctctgcaagtctgaaaatctgaatggaacaatctgcaagcaacacgcatgctgttgttactgcaaacatttcgattgatcaagaattgaagcgaccttggcctgaaacaaatgatctgccggtaggtacagatgactagatgagagtacgtaggtcaagaaacaggttcttggcgacacggacagagacggcacgagaggcgagagggtgagacaggaaggtacaccaggtttgcctacaggtatccggcaccaacctttcccaggcaagaacctactacctctcacatggaatgttccaagagccaatttgatgcagagaaaactagcgcccacatggaactaatcgagattcgagagtggattcagtactctctgcctctctcgagcagataataccaaactagttggaagatcatgtttccagctcatcgagaggttcatcaggttgcagcaccaacttttgttctgttttcaattcctcagtgtcttgctttggttaaactcatccggtttgccatggatgattggatggagggtaccatcacttctcgttttttgacctggttggtccagtggctaatctgtttcctctgatcctaccatggctacttctcaagaacgagtaacataataagctagagcctttcagatcagatgtcgtcttcagtattttttttctttttcctaagaacctatcgatttgattttgacctcatgaatatgattaatgaataaagctatctctatttcctttcctatatttttttagaccgatgggttcagggttctgacgggacagataggaatatagaataagatcgtagagcatcatttatttgtccacacaaagggatccatccaattgggatcttggtatatttgttttctctagaaaagcaaatccatatacttgcaagttgacaagcataaagagtttgcagccatatagaaccgagcgagagctatttcctgctgggaatcactagattcaggtctacagagaaagcaaaaaaaatgaccagagattgttcagagttcagactgatgaagacaaaatggaacccctctctagattgaagaatcttgttcctccagctagtatcaccagttatcatgtttcttgagcaattcagttcaggaaaatttacatacagtcgccttgcatgttgaagcaagatttatacacgagct

SEQ ID NO: 9454 - DNA, 1501 bp, Oryza sativa
agcgcgttcaccgactcaccgtcgcgaggctcgtgagcactacagccgtgaccaccgcggctgcaccgccgtaggacttctcccccaagtccgcaccaccgcaccaccattgtccgccacaagccccacgttgccccgcccttctcccccatgatggcggccgcggccacggccttcgatgccgtcgctgttgccgcgggcagccagaagatccggagccatggttgattttttggggactttgtgaagggagaaggtttgccggaggagggagaggaaggtagcaagccaccggcgacgaagtcgagctagcgatggcggcgatgtggttgtcgacttctcagggagacgatgggattggggccaatccagtggatacccatgggttgaatccaatctgggaccaaacttttgcagccaaaactaaaccaatccaaaccatttcccatctccatccaaaccagtccagtccatcaggtgcagcaacccatttccacccgcccaaagctaacccacactgaaatccaacccactatatccacttaaacccagtccattagcaggcttaactgtcatagtgaggtcgtcagtgatgggggcaaggcaatgatcaaggtgaagggtggttaggatcgatggagatgcatggcgtgaggtttgttcgtttgcttgctagctggagcctctatctggctaccgttgccgagctgtgaggctggggatggtgtcagattggtcgatcttgtgcagactgaaatcgttgggcattttgctttcagggaactgaacatgcgttttcagggtaaactgacactgactgtcgtttattgaaaatgatcaatataatcaatacaggggataccgtttgcatcaatggggacgtagctcatatggtagagcgctcgcttcgcatgcgagaggcacggggttcgattccccgcgtctccattttgtcattctttttgctgtcctagaaatctagaatctctggagaatttgttgcttgcagttgcagttctttcctgcaggaaatgcaaccgacgacccaaaagacagcaggtaaaacgccttcgatccacctcctgttgatacacaggtcaccaggtgagtgcgaatttgactgccattgatatcagatgatgtgtgtacatattgactatgtatctgaacagtatatgttttgtggactcaccaatggttggtactgtgcttgtcgcatgctcctgctctcgtgacttagtcagccgccaagccgcagtgttcaccagctgatcgcgctctagctctacccaggagggggctaggtcaattggcaatacgaaagcagggggacaccacaagcacgagttttctcttggaaccatagcgtggttgacgtgtttgaatagacacaaaatgtgttcttccatttatttggagtttgggcaaatggacaggccgctgacggtggcggcccatcgaaacaaagccttcccagttagtaggaataagttcactttga

SEQ ID NO: 9455 - DNA, 1501 bp, Oryza sativa
ttattgcttcagttcaattgattcctgacagatgatgtctactagctagtactccatcatcatggaagggaacaataatatcctagcactgtttgtccttaatatcttttgcagtttaatttctagctagccgtcaatggagactcaaaaattataaacagtgtagtggcgtagatcgacaagtacagtctagtcgccggcaggctaagattgtcaatgcatgtgtcagtggagaacgtccacaaaaacaagtagtgtttcaatgtttcattagttaataatcttagtgttcacatacaaatcatggcaacaactaattaacttgcagaaacaacctaccctagctggtttttgcactctgaagtctaaactgaaaaggtcttcagttcttgatatatatgcagatattgtcaactactagctgatgaaggccttgactctagctaaatactaagcctcatgtgtcaatttcttcatgatttctccacccatattgcggctggataatgtacacttaggcatcagtccatatggtgtgtgaatgtgcaagaacggatccaacacgctaggtagagtcgtagagatatatatagatccggccgtgaaaatgccatcaaacctttctcatgaaactacgcttatgaagaaagagagtttaccacatgtttatctttttgaatttcatgcatattgatttcgattggctacaagtgcatgcgcattaatccgcaagtggttgacactggtttattactttctttacatagcaaaaaaaaaaataatgaaactatggttgtgtttagttccctttaagcttccaaaaattccgtcacatcaaatgtttggatacatgcatagagcattaaatgtggacgaaaaaaaccaattacacagtttgcatgtaaattacgagacgaatcttttgagcctaattacgccgtgatttgacaatgtggtgctacagtaaacatttgctaatggcaaattaattagacttaataaattcgtctcacagtttacaggcggaatctgtaatttgttttattattagtatatatttaatacttcaaatgtgtgtccgtattcttcaaaaaaaaatttggaggaggaactaaacacagcctatatttaaaaaatgtattttgcaagataaatctaatcaatatgattaattcttgtgtaattaatgatatcaagtcaagtaaaagagagatgattagaagaagcgaatattagggaagaacctaatatcagataattagaagaagcgagactttaaacttagatcatctagcacacaactttatagatgctagccgaaaaaatcatggacgtttgagagagagagagatcgtactgaatggagttaattgtttgctgcagagcgtggcatatcctctcatgcacgcaccatcactcctaggctatagcttatctcgatcgatcaacttggtgatcgaaagggagtctacatcgcgttgactccgttgacccggcccat

SEQ ID NO: 9456 - DNA, 1501 bp, Oryza sativa
ggaatgtaagaacatgatggattagatatgatcgactgcatatatatgcacaactgcaagtatacaaaattaatcgaaattaatttttgacgacttgcaattagctagctgtaaataggatcgcgacctgttgcgacattgcctgttaaaaacatactccctccgttccaaaaaaaaaaaaactagtacaacaaatctgaatagagagttatcggtcaaatctcctactaggttgagctttttttggacggaaagagtacgatgctagtactaatcttattgcgtaactcacctctttcaggaccaaattttcttttgatcgatatatatatgcatgtttgtttgccggggctctaacttttaaatttattttcaagagctggatctggaatgaagttgtaacacaaactaaacccattgatcagctagctcgactctcatttttaattgaagctgaaataatttggctagactagagaagagataaagctgtaggttgaagctctgcttatgtacaacaaagtaaagttataaagttgttggttttctattgatgtgtggaggacaaagatatgtccttggttgtagtaatgtaatgtagtgtgcggtcaaaagcaattgaggttttctatggccaaattagtaattaataagaacttggttagtaccgaagttagacaacatagtattctagacatacgttaaaaccaatgactaagttgaagtggtttagcttagttggttacttactacctctgttcagaaatatacatctaaattatccaaaaacataaatcacacacttctcatatcaatcaatcacaaaccatccattatagtttttctacctactgaagttgtgttcaggagggaaggaggggttcggaaccctcctctttcgtacgcaaaacgatacatgccttaacacacgattaattaagtattaactaaaccattaaaaaaatatattaatatgattttttaagtaactttcctataatttttttaaaaaactaccgtttagcagtttggaaaacgtgcatgtgaacaaccaggaatgcaaagttaagaaggtagacttaagaacccaaccttattcgtcttaaagaatcacaaccaactcttacctcaaccttaatctcttacaaaatgtctacatgttcttacattccaggactggtggagtacagaataattattttgtgttgaatatctgaatgactgaatagttacatgattgtgataattagtatagatgatacaaatgaataaattaacgatcataaagttaaaaattacttttaaaactaaaaaccaaagaagcatgcgcattcgtccatcctttgattagaaaagaacaggccattaagtgggctgattaatatatatgcactccggcccaaccatatccggcaaggcctcctcttctgccctctctcacctcaccggagtgagcagagcaatggccggcgccggcgaggacggaaagagagagagtagc

SEQ ID NO: 9457 - DNA, 1501 bp, Oryza sativa
tccatctcctccccctagctttcggtagtagctcgagtagactccccgtagttagccggcgccgccccgaccgttgccgtcgctcgccgtgtgctcgccgccgtcgccgctcgagctccgtagcacccacacgtcgccagcctcgctcggcgtagctccgtccaatccgacgctagcatcgagttcccgaaaccgcgtagatgctctcaccgccgggaatcggtccctcgtgacctcgtcggcgtttccctcttccctccccgccggttgtcgccgccgcgattcgccgccgtcgaactccctctggcgaatccgagccgttggctcgtctcccctcatcacgaacaaccgcccggtgtgctagcttttgcccgtgtcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgagccgaccccggtcagtccctccccgtgcgcgcgttccaccgcgagccgtgaggctgcgcgtgggcccgctgcatccgcgtccaccgcgaaccgcgcgcgtgcaccgcgtccctccgccgcccgcgcgcatgagccgcgtactccctccgcacggtgagccgagccgctgacaagcgggtcccacccgggaccgcgcatggtgagcccggtccaccggctctctctctcctccctcccgcgcgcgcgcgtcttgggccgctctgggccaccttcttgggccggccggcccgttaagctcggccgagccgccctttctctcgggccgcgccctagccgcccgagggaagtctatattccctccctctccccttttcttttcttttcttttccaaaaaaaggggatttaattaaatccttttcctttagaccaaaaatccaataatcttagaagttcaatatctttccaaccgtaaatccgtttgactccgttcaaattccaaaatttctcaaatgtcgagatctatccaatggcacgcttagaggtcattaatagggctttattttcgccgtttgttgagttgccccattttgcgtgtagtttcggagcccgaagacccgcagtgcgaggatttcgaggatcaagctccagatctcgagcaaggcaagccacctttgaacatcttgagcctatatttgaaatctaattatattgcttgcaaaatattatgcattgataggattacacttaatctgttgttccgtctgcaaggcagattggcagacctacctaacttgttgcatttgatccttccattgttaattgctataccatgtccccttgtaaccatccagttgcgcctcgatattcgtgcaccctatgccagtatcgacggtcgccttcaaacttaaaatctgagtaacaacttgggtaaaactggagttttacaaaagacttggaaaacccgacacctgggtcggtgcttgtgaac

SEQ ID NO: 9458 - DNA, 1501 bp, Oryza sativa
ggtgcttgtgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctcttgttggtctgggacccctctcgtcggcatatggtaaacctgtgttggctttggaaatgccttgtcatgaaagcttggaggtctcccgacgtggctgatccccacgggctgggtgatctgggttagtaatgtcgtgtgggtaaagtgtaccccctctgcagaggttaacaaactgttcgaacagccgtgcccacggtcatgggcggatgtgaggtgattcctagcgtagtttggtttgactactgcttgtgaaattgctgtgtgaaaaggggttcggtgtttgaaaaatctgcagctgatgggattagctaggcccgggtggccgtttgaaaagttgttggcccgggtggccgttgaaaaagctgttggccgggtgccaaccttgtttaaattctaaagactgatacattgcacatactccgaccggacgagacgcactgtctcatccgtgtcgtttgagaagcactcacttagttgtttcagaaaagagttcaaataaaattaattgcaaaaacaccagcctttccttgaagcctgcattaaacacttacttcccatggcttgctgagtactcccgtactcacccttgctctatataaataatccccccagttgctgaagaagatgaagcggatccagctgatgaggagttcttccaggagcaagccggctacgatgagttttagggtttcggcctagttcccaagtcgcgcctgtgttgattggtccaagtcctggcttccgctttccttttgtaatgcagttgtgagctcgggatctgtccgcagcccaacatgactgtacatctactctataataaagagacctctgttgctgtgatattatgtctccctgtgataccagcactgtttcctgggactggtatcgattaacaggttaatttagagcgtcacgggctagttccggtcgggactagttcggggcgcgacaggggaggagcggcgggcgggctcctccaccagccgccgcccacgaggcaaaggagcaacgcgcgggcggacagcgggggcgggcggcgcgcgggcgggcggcggggggaggagcgacgcgcaggctcccccgccgggtgccgcccacccggcagaggaacggcgacgacgacacagcatcggcctcgtcggaggcaagcgcggcggccccaccctcctcgaccgcgaggcgggaaaagtgcatagcctccacgggaaaagagcccaggacattttcctctg

SEQ ID NO: 9459 - DNA, 1501 bp, Oryza sativa
aatgtccaattttgtagcgtcatgattgcaattgaagttttactgtgttcaatcattggcgtagtacttgtaggtataggcaagattgatgtttcagtgctgtaggagttgtgtggatttaggacagtgctagggataaagatgcgattgatgattggtcgagcttctttggcatgcatcctgaattggagtggtgcgaggacatgaccgcgtgagctaccggcatgagtgaagcagtgtgcccatgcaaataatttttgcatgctgttcttccatgctattctgtttagtctagtgcagactttgaagtggttatgaacttgtcacatttaatcagttgcctcacattctgcccttgtgttcataggatacatgtttgatttacaaatatggcatccaattaataatgcaatgttctaaccactggaagggtggctgaatgaataatttaataaaatttccatctgatgtgtattattggtgtctagggctaatgtggtatgtaaccctgtaggaaattggtaattattaacgatgccactgcagaatgagctgtcttctcatcagctctaataggaaaaggtggttattagttctggccttaggcagatttcaatcctacctgggcatcctttgcttagtttgtttccagcatatcagtatatttggttccagtgaacttgccgtgctgatcaagaattgtagtggttaagtttgtctggtgaaagaagcagtgttacctgaaaaatgtggccaattgttttttgccgaattgagcaccccaaatctaaaacgtactcggattcagcaaccttgtcgtcttctgagtagtatcttgcatgccgtttctctttccgaaatcacacacatgagccaactcgcttgtccgtttccgataatactgggaagaagagacaaatgagataactcatatgtggttttagtagctcagcactaccattataccattcaccatgcattgatacgtggtaccttcaagtagttcatcgggcatttgtggacataattcatttgattgtcctggttgggttgagaaaatgcacaaaaagttacataaaaagaataaggaaatgatgggaacaaaatggcttgtggagaaattactgatagatcttttagcacctcctttatttattccacatatgtcatgttctatgcattccactctctgcaaggtaagtgtgaaccctgagttttcgaagttaatttatttcattcactttcctattatctccacactttcatcaggttatttgtccatctacatagtattaactagttcaatcatgtgtctgtttgaatgtcttatggtggtgtatttgtgtttgcacttctgcttgtgtttttcaatttgtgctcattcaatttctctctctttgaccgtctgtctgatgctacttttctgtaaactaaatgcatgttgctggtttctaataaaaatctgcatgattctgttccagggtttgtttctagtagaata

SEQ ID NO: 9460 - DNA, 1501 bp, Oryza sativa
tctcacaatgtgagagctgattttggagtatttcaacatagttctcttttttaattagcttttaagttgctactaagaaaaactattgcttcaataggcagcttgaagtatcatgcattagtttggtgctatatacctaaggttagccacaatgtggccataaggggctataacctaatacattgtggagattttaagataggctcaggttagaggcaatttatagaccagtcatacaaaacttctctctcctacactctggcttctctctatgttgggaggttgaaaagggtaaacattttattttgttatgggacctaccttaacaccaactttagcgttatacattgtagagatcacaacatatttagtgtggaccaccttgtggtcatgttaggccatatacgttgagaattctctaagaaataataaatctcaaaatgttactttgtgcaaagaacggaacaacacacatgcatcgataagagcatcatgagcttagccgtccaaattcaacaacttgactcaggataataaggggacctacgagttcaataggctaacgaagtggtcatgctaggctcgatcaagatacatcaagagtcatgacacaaactaaatgtgtagtatttgttagaattttaggtaatttcttagctaaatatatgagtgttaagaaaaaaaaaatagaaaaacgtctcaattgtaagctcactatctaacaattttcaccatgtcaagtggcttggcatatctgctcatgtattaataacaagattcttatcccaccatcgctaaagccgttatgacggttgagcatgttttgtcattcacatcatatttatagaatgtaagcttcgatctctcgtatgccgagaacttttccacgaagagatcaatgttgcgtaacgacaaattagttgttgacttatcacaccctaccccatctcactacaagataagagcgcagagtgcatgtatcgtcggcttatatggatttattacactttcaataaatataatttatttcaattcataacatccatgacgtcatggtcaaaaatttaaaccaatagagacatctcgcgccatttactattgtatgtgaaatttatattctatacccacgatggtatccccataggcccatactccatacaatactgtatattttcacacactctttgttttagttgattttgtactcctaaaatttacagtcattctttacatcataataaactcttaatttagaagcagctattatctctaaaacagaaaagtgataaattcgatatatatatttattattttcagtttttgttgtcccatttttccttagaggagaaaataggggaaaaagaaaagaaaatccatcctcattgagattgagagccgtttggtggcctcctcggaaaccctaattcttctcctcttctcccctctcgatgccgccaccgccgccgatgatgcccaccggcggctaccccggccaccgcgg

SEQ ID NO: 9461 - DNA, 261 bp, Oryza sativa
agtcaacggcatcgaataactagggacggagggagtatatactgatacacatacattattccataaaatccacttaattaattaactaaagatataagatatagtatagctcgagctagctagcctatatatacacatggcactggctcttgcatctccacacacacacacacattcaattcacatacaaaaactaagctagctaagctaagctaagcgagattatcacagtagctagctagctagctgaattaattagca

SEQ ID NO: 9462 - DNA, 1501 bp, Oryza sativa
tcgtcgccgctcatcctcgtcgccgtcgtcgtccggtcaccgtccgcagccgttcgtgcctcggtaaggatcgccgcgtcgcccgcatcgcgtagatgctcttcatttgtgccgccgcgccgtcgttcgccggcgagcgtgcgaggccgagtcgccgctggtgatgacgtcatcgatgccgttccccgtggaccgcggtggatcgtttaggtcttggccgtccgttttagataggatagatctcggccgtttgtttccgtagaccgccgccgtgcacccggtccaccatgagccgagtccgctgacgcaataaatcccttttccttttcaaaaataattcattattgcgtcataattcaattaaaatctatataaaggatttaatccaatttaatctttgaaaattcataactaattctctgtaactcagtttaatgtggttcaagttgcaaaagttgtataaaataaagatccacatattaaaattatccataaattgaattaaatttatttaatcctttttaaataggctttaattagatttaatctagtaaaattcgtaataaattcatatgaagtcagaatgaggccgttcaagtctcataattcatctaaaattatgatctacatgtttgtttactttatatgtattgtttatttggtttttattagtctttttccttgttttgcgtgttagcttgtcgtttccgtcgtttcgaaggttcgcgagtgcgccggaagtgttcaagaagattaattgaagacccgttattgcaaggcaagtcacacagatcccaaacacaattcctttaagcatgttgatcctatatttaaattctctatttatttcaactgtgcatttattttcgaatgccaccgggtggtgtgaacttattcctttgtaatggcctgtttgcattgattactctattccttgataccttaggttattataatttgactagttgagctttatatattggttcagctagatgttagacataattgcttagccatgcttagaaacattagcacacaattgggataactaatgcttcactgttatttaatgatggcttaatgatagctcacgatggtcaatcgtgattggttgattaattaatgtgccaactaaaatttgataatggtgggttgtgagcacatggttttgatggtagtgctcatgacaattaaggacctgttcacgattttcgattgtgaaacatttaccgtgccaaccataagccagaatgggcaacggctggacactttgtataacaaggctcactgcggagcaccagactgagaagtggtggagataagcccatgggggtcgctagggagtccatgcctctggtttttgagggggtgactatgatccgggaatggtgcactgctttgagttgagttatgcgaggggtcttgtcacaatcactcgccatggtgacgtgtctgcgcggacacggtgacatgacggtgggttgtatcttatgggtacagt

SEQ ID NO: 9463 - DNA, 1501 bp, Oryza sativa
aaatccatgtgcgagaaggcaactgtgcttggcctcgtggcaatctgtcatgtggtgatgacaacaacatgggcggtgctagccggcgaggtcgatagcaaaggacaaactacactatggggagagcgttgtgctcggcccttgcggtggtttgtcttgtggtgacaaaaatgacatgttgatttggggtgatgcatgaggtgggtggagggtggcctgtagagggacaatgggtcatgattgcaggggttggtaggctgtagcctgcatgtgtaaacctatcctagtggtttgttgcgtcagtaacaccgacacttttgagtgtcttgttacctgatgagggcattgttgaggcacctccccctgccgctggtgggacactctaggtaaaaaccatatccagttcattagatgggcagttgcggcactatggcatcacatcctccctggaggcatcatctaggaggtctcgttcctgcctttcccacctccaaatagtttagccaacgcttttgaatggcggtgggttatacgagggatgcacggatcatcgtctctctcgctctctcgcccttcttcacaggtggtgtccatgaggccattttgtttcttgctgtttggaggtggtgaacggtataggggtgggtacgttataggtttggtggcgttgttatgcatagtggcaggcgggcggttctaattaaatttaggtgtgcgtaatgccgtcggtgcgtggtggtcctattttttttttcttttgcccgattataacatcgtagggctatagtcttgtgattttttttctgctatatcaatacaaaacaccatactctcaggtgatgttcattcaaaaaaaaaagaactaaggtgcaaatttgcaacatcaatcagccttgtggcaattgtgagtacactcttcgactttgtagcataagagcaatttttattttctgatattaatcgaaaaaaaatgtgagcatgcacctgtactaagtaactttaaatctaggtgggccagtttcacaatagcctaatcatgagatgcccatttgatcgaattaataacagaaatggccattttagacaccccagaaaaaaaaaagataaagaaagataaataaacttgccaactataggttgttgcatatccaatgaaaatatattgtgacaatatgtactttcgtagaagtatagttttatatatatttatgctaccatactataaaaataatatcataaaaactattccctccgtctcaacatatagcaagtaggatgggctcgtcttagctatatattgggacagagggagtgctgtcaaatggacaactgcgtcacgtcgaaggacgtggttgctcaacagtgttggaaaagcaataagtgtattgattgataaaatttcttgggatcccccattacatggccctaggggtctatttatagccttagcacaggcttacacctcctagggtttaggtttacaggggattttacatggttg

SEQ ID NO: 9464 - DNA, 1501 bp, Oryza sativa
gattatttcccctcaatcaattcgggcggagaaggaaagaggcgacggaattggaagggcggcggcggcgcggctcggctagggttcgggcgagcgacggcgcgaggtagacgacgggcctgacaggtgggccccacctgtcagcggctgagagagaggagggagggcgcggcgaattgggctggcttgggccgggcgcaagcaggccgaggagagggagagagagagacttgggccgactttcggcccaaagccaaaaagagagatttaaaaatctttttctatttaaattattcatgaaatgatattccattgattaaaaaaatacttccttggctcaaataaatcctagaaaaatctaggaactatagaatcaagagaagtgtttaaaaaaattttatctagcccacttttatattgagatttaacaaattaaaaatagatcttctcttttaggtttttaagattatttctaataattccttttaaacaacaatttataacttaaggatttttaagcaagcaaaacatttaacataattataattagatcattaattgattaattcattgattaactaattactgaaatattctttgtatcatttaagaattgagctctgaaaaatccgagaaaatttcaaagagtatacttaatcatggagaatttaataaaaattaaatccagccatgctttatatttagaaaattttatttcccacatttaacttcacttgtaaattaatgaacatttaatataaattctattaataatttattaaataatttataaatccttaaatggaaaatcaggctgtgacaattgggtaaactctattcgtgtgaaatctagaatttatgggacaagttttaataggaaataggcccctaaaattggataaataggaaaaagtcactgttcattagcccctaggtgttcgatttggttccctagccctgccccctcctctgccacgccgtcctcgcaccccgcgcgccgcgcgccgtcaccgtcaccgcggccgctcgcccgccgctcgcccgtcgcgtcaccgcctcgcgccccgcgcggtcacgctatcacccgtcggccccgagccccgctccgccgtcgccatcaccgcgcgccgcgcgccgtcaccgtcgcgctgccgcaccctcaagccccacgccccgtcactgccgcgccgctcgtctgtcatcgtcggcctcgcgccccgagccgccgcgcgcccatcccatcgccgctgccacgccgcgcgccgtcgccgcacgccgcttgaccgtcgccgtcgccgcgcgcttctcgccgtcccgcccatcgcgtcgcgtcgagcctcgtgccgagctgcgcctagccccgcgccgcgctgcccacccgtcgcatcgccgctccgagccccgcaccgccgtgccgtcgcgtcgccgcgcgtcaccgtcgcctcgcgccccgcgcgctgcgccgtcccctcaccatcaagccggccgcccctcctcgagc

SEQ ID NO: 9465 - DNA, 1501 bp, Oryza sativa
ggcgatacgaaccggccgaagcactgctcgccgaacgttgaaaccgcgacagctcgttttcggaaaacataccgatcgtcgttatactcgacttatgcaaatacttaagcgtttctggacgcgtatgccaaaagtcgagagcgaatgatgagggctgaaaagtcgacaaatcttttcgctaaattacgcaaaggggccgacatgtttcgacctaacgaaagcacgaaagtgactatgcgaacattagcaaaaagaaatttgaaacacacataagctccatcaggcgaaagcacatactttaaaaaaaaagaagaaaaggagctacagcttcgccataaaaaggcgaaaacgaatcggccaaggcatcgctcgccgaacgttgaaatcacgaacgttggaataaagataccgaacgccgttacatttgacttacgcaaaacacaagcgtttttcctagcgcaaaatgctacgagtcaaaaacggaagtcgaaagctgaaaagtcaacaaatcttttcgccaatcctcaaaagggggctgaacgcatgactttcggcgaaacccccgctaaagcaatagggaaaaggggaaggaaaaaatacaagtcaagaatcgcgcaaagcagacaaacttggcaaaatataatcacccagtgtcataataaagcttcaccattctcgaaaggcgaacgccagtattcatattttttctgcaggagtctaaaaagagttttcggcaggaacgtcggccgaaagggggcgcctcatgccatactgtatagtttgcacggtctcggccgaagctccttactcacccttgcccatgaggggcttgttggaggcattccatgaagcctttcggccggacctaccaaaaccatagtaccagcaaggattcaagtcaaagacgtcaagaccattcgggcgaagccctatggcgaaagccataagcgaaggtggcgaaggctggaaagccgcgtcggtactccgcaagtaaaggcatctcgggtgaaggcatctcgggcgaagggcatacggcgaactacaaagacttcgccatgacgagttcggcattaaggaggcccagcaggctgcccccgacctttaaggccccttcaccatagaccaggcccagcctatcggcccattaaaggcccatatatgcaaatgacactgtgtacccatgtaaatatcccttttataagggcaaccatgtaaaatcccctgtaaacctaaaccctaggaggtgtaagcctgtgctaaggctataaatagacccctagggccatgtaatgggggatcccaagaaattttatcaatcaatacacttattgcttttccaacactgttgagcaaccacgtccttcgacgtgacgcagttgtccatttgacagcactccctctgtcccaatatatagctaagacgagcccatcctacttgctatatgttgagacggagggaatagtttttatgatattatttttatagtatggtagcataaat

SEQ ID NO: 9466 - DNA, 1501 bp, Oryza sativa; identical to SEQ ID NO: 1429

SEQ ID NO: 9467 - DNA, 702 bp, Oryza sativa
ataggggaatgttgtgattggatgagaagtgaaggtaaatgggaaaattaaatggtggagggttgtgattgatcaagaagaaaatattggtggatacgtaattatattttgtgacaaattctaaatcgtaaaagtgttatattttgggacgaagagagaagttgttattggtcgaatagctattgaatttgaatatataagttccaataggttatagatggttttaaagctgtaattatatgcaaaagattgatgtcccaatctctgcaacgcagactaccccataaatataaatatagatggtgtgcaccatcactgctacaaattcggtcatccttgacaggccatctgtaattaggggtggacaaaaagtttggccttgtgagctcggctcaagcttggttcaggctcgcataggtcggctcggctcgaaagccaaacaagccaagcccaagactgcttcctagctcgtttccgaaacaagccaagcccgagctggctcacgagccgctcgtgagctcttttgactcaatagaataggtcatatacaaaaaaattgcacatttttgaactatttattggttgaaaatgataactttgattgtcatattatctatttatcgtgttgtgatgatatattaaagaaaaatataactttattacgcattctatatggtattatgttgctcgatttctcttaga

SEQ ID NO: 9468 - DNA, 1501 bp, Oryza sativa
ttggcctaatttttccatttttttctttcaaaagtcaatggtggagcgtgtatgtgtcgatcggtataatagcatgcttaacccctgtcaattaatccaactttatgtaggttaaatggtaggatttattggaaaaataccactttcctagtttaaactattttgccacagtactaattattatatcaacaccatgcatgaaattgttcgcttttctgtataatattatttttcaataattttctcgcttcgcattacacgagtcttattttaaggtgaattttttttagtgaaaaggcgtttttttaaggtgaaatttgtggagtgaatgatagtaacattatacttcgagtttttcaggatgtttaatttaattattatttgcataggacgtaagattggtttagaacaccaatatttaaaatcatatacaaattaccatgaaaaaataaattttcttttacataggttatcttgttggatatggtttttttttttaaaaaagctgattttagttgggtgcgggcgttgtttaattgtttgagtgaaaaatggagttacttggagctttacctttatacaattagaaattaatttttatagtaaaattgtgtttggcgaacatgaaccataccttgttttttcacagcaagatataccgacaaacacatcaccttaatcacaaactctctagtacaccgtgtttgaacacgcttaatagtcgttagctaagtataaatcctaacttcttcaaaaaaatcagtactccctcagtttcatatatattacttaccattctagcatttcattttttttatcaaattacttatatggttctcacaattcaaagcctttttagaggtgatcttatctccaccttttcatcaatatagtcatgcattaatacagtcataaactcccaataactcccattggtttatatgctttgaaaacaaaaaaaattgagatgtatttaatggggcaactatgtaatcttcgatatccttttgatttgtatgagatttgctagaaccacaagtaatttgaaacagatatacttccagctatgcataattgtgtgtgccaggagttaaagcggtggctggttggattgatgcacctcttttgagaaaataaaagagaaaccaaattaaaatctcaacctatagcttcaagaaaacaaaatatttaatcccttgttggtctcctccctatcatatctacaagatatatatatatatatatatatatatatatatatatatatatatatatatatatatatatatatatatatatatatatatatatatatatatatatatatatatatatccagctaatctctctcctcatgccatctctatataaacccatcaacttgcctcacttgaagctacaatcaagaaatccacatttctcctcggaaagtcaaaggcaagaaacaccatggatgccactgccatcggcaacggcgccctgcactccaatggcgccggcg

SEQ ID NO: 9469 - DNA, 1501 bp, Oryza sativa
ttttagaacaatatatatttacgtatatatataagcagtcaaatgcatcttgcacctaacattttctatttatcatagagaaagtcccgcagcaacgcgcgcggagtctctcactagtatagcagatgagctaggcataaaacaacaatccgttttcccctcttcatcatagtctattatattggcaggcaaaagttctagaatttccatggtttttctttcacacatttaatttagaaattcgtaaaaaacgtagtaactactacctccgtttaggttataagactttgcccacattcatatagatgttaatgaatctagatacacatatatatatttctagattcattgacatatatataaataaatatgggtaatgctagaaattaagtcctataatataaaatataaaatagaggaagtatatacgtctcaatctcatcatcactaacgctgcatgataatcatcgttggagggggccgggccgcttcgcccctgctgtctcccatctcctatctctgtcggtgacggtggcagaggttgcggaggagaagcgcgcggacatgctgaggcagatgaccaccccgggcagaatctcctcgttgctcgatcgcctccggccgctgcatcagccagcccccgcacccgtatctttaccgaggccatcaagtgctctctaacatcatgctcttcatcaattatacagtatatatcgctgcatcacctgaagctagaaaacgaagctgaagcagcagtcagcagagatgaagtactcgctcacctgaagctgaggctgagcccgtaggacagagagcgaattgaagaagcgagcacgagaatggaggaaaggaaaagaaaggaaaggaagaagtaggaattgcacgagaagcccaagcaacaagaattgaaattgaagtgcctagtaaataggaattgcatttgctcaaaaggaatgcatatttatgcatttagattgaaccaatccatttccatataagacagcctagtgctatgctaaagtagtacaaataaataaataaagggaatatatccatacatacacaaaaaaaagggattaagtgctgacctagttgtgttgcttaactaaacacaataaatttgaatctttaaaatctggcctccttatttgttcgacctacacaaaggggaccaaccgattagctcaccaacatactatcacaaaaatgttcaggataagtaagaacttaactgggtttgcaagataaacactggtcattgattcatggcgtaagtcaagaagtaattaacatattttttatttagaacccacaatcgataaactgtgaaatggaagagaaaaaattatgcattccctgtaaaatcaaaggtgtttttgattattattctgtgatgaactaaaatcaaatgtgtttttgattattattctgtgatgaacaattggtgtcggagattattggttttgttatttggaatttattcacgaagtggtttcggaga

SEQ ID NO: 9470 - DNA, 1501 bp, Oryza sativa
tcctcaaaatatatctagtttcccgaccaccgtggatcatttaataattaatatcacacttaggtttatttatttgatcatgtttcgatgatttagaattaagcatccaacaagtgctctatttttctttaaaaaaaaagattgtcaagaaatgtgggtagcataattgaactagcattgccacgcttggcatgattagttaatgtcacgacatatatttacccacgcctatattaaaagagtactaccagtttgccttgcggtcgggtcactgcctcactggccacataaattagttttataaaatagcaagctgtcaaagagtatcttataataatgttctagaaacaattataaacatgccacacctatcttgcacaccatcatttcgaaaagatatcttatacttcctccgtttcatattataaaactttttagcattgttcatatttatatatatgttaattaatctagacatatatgtgtgtctagattcattaacatctatatgaatgtgagtaatactagaaagtcttacaacctgaaacagaatgagtaattgtgatgacgatgaatctttcacctaaagaactgtattataaatacattttcatttactaattctttatttattttaatattataaaacagtcctttctttattatttcatcactaaaatacagcttattatgtaaagacatatctacatagacggattgattaaaaacctcacaattatttcttttcaaacattattctccctctattgtaaaatataacaaattttagctatgtatatgtatataattttttaaggaagcgtaaaagaatttatctaatcatatttatttggacaacgatatgtccagatacataattagaaattgctatattagagagtaattcatatgtatcaaagcaaaggtattgagataagtaaattggacacataaaaatagtaagggacccttttaaatcaacaaaggattaacgaaggaatttcataggattaaattaaatcatatatgatctttttctatttggacctttgattcaaaagattagagttttctaaatcctatagaattccaacgaaatggttcattgcatgtaggagagagtttaggaagaggttcaacatcttgaaaaatttagttgagtctaactctcattcaattcttgtgtttttcctatgacctaatctaacgatcattcatatatttctcctctctttttcaatattttgttttacacttacatttctatcagaatcatgtgtttttttaattcttttatttttttttatttgtacgattcaaaagacactggaaggatgtacactggtaaaagattaaacaacagtgaacaacgagcaacagaagcatcaagtaggcagcacagcagcagcaacctctccactgtccactctactctagcctcttccaccaccaccaccaccaccaccactacacactttgctcatctcatctccctccttcc

SEQ ID NO: 9471 - DNA, 1501 bp, Oryza sativa; identical to SEQ ID NO: 8688

SEQ ID NO: 9472 - DNA, 786 bp, Oryza sativa
tatgctatgtcacccaatctgaatcccaattttattgggttgcagtgtttgccactaacacgtgggccgctttgattgggctggaacatgataacggattgatggtggtgagaaatcacccattcaagatggtttgtgttagagggcgcggtccagcctgaaggttatattatacttgctttaccataggtctaatcgtagttataacttttggtaatacacctatacaactaaaaaaaatagtctaatggatgaggatcaactctatctttaagtcgtgcccctggtaacaattactatgtaggacttaggggctgtttggttgctagtcaaaatttgcctcaatttaccacaagtatggcaaataggtttgaccaagttagtatagtgtttggttctagccacaagttagtcatgccaaactttcctttaacttgaccccacatttcatagatacaataatgtgtggtaaggaggctaagatgtggcttcaattttcttggccacaactttggcaacttagccacaaatgtttggctggcttaggtagtgttacacaaccaatcaaacagcccctaaacccaacagtttcattcttcaaatcaaacagcatgaacgttcctttgtcagactttcgatgagtttgaatcttatacaacaatgctgatttcatgtatgaaaaaagagcgacggcccgctcttcttcccccaactatatacatagccaacatggagaggtcatgcgtcatggccggtcgcagagtgcgccatagcagtgtgtgtcga

SEQ ID NO: 9473 - DNA, 1501 bp, Oryza sativa
aaacaaatctacgcaacggaaaccacctcacatccgcccatgaccgtgggcacggctgttcgaacagttagttaacctccgcagaggggtacactttacccacaagatacgaccttattccgaacacccgtcggtgtcggaggttcgcaacaaggcctttcctaagccggcccagggttacctcatgccacatagaaggatcaaatcctcacataaatataggccattttagttttcacaaatcaaactccaaccacctcgatcggtaattcagcaagcttctcttccttgcttaccaggaacccggtttggctccaaccgaccccgccccggcgttccccaactattggcatgcgaggtttccctgaaccgactaattacttagccagggtgtcccattccaccttgtggttgcactttgattatgctcgatgagtttcccacaggaatcggtccttatatgcgaatacaggacagtgccacgcaggcacaacccccgcatcgtgagttttcacaattcattttatgtttaaacacaccgacaccacatgtcgggttttcaaggcttctcaaacccatttcccaagttttcgacaatcaacggtgcatgtgagatatttggtatacgcgctcagagagcacgaataccaaagtaccacaagggtggagcgacaaggaatcatgatagtacagcctacaggaattagtgcgactactgggtaggtccgtcggtttggcacgcaaaccgaggccaagtaagttatgtgtgtgactctaataatgcaagttgtaaacaaaataataatgattttctaattataggagcaattgatcaaagggtgacttgccttgctcaaggtcttcacggagcttcacgaatcttcgagaaaacccgcgatcggcgaaaatccgataaccgcaactatacgcaaacaaacaaaaaccaaaacaaaagaccaagaaaaagaccctatttagactaaataatagtgcgattaaatagatctcaattttatggaaatactggaagttgaacggaatcaatcagagctacggattgagagatatgaattttggaagtttaattggaatttttgggcaaaggaagatatttgtggaacaaggggaaattgatttatgaaatttatagaaataatattctcaagaatattattgtcaatttatagaaataatattctcaagaatattattgacagtcacggacgtgcgggaccaagggaaatgattcatggaattttggaataaggaattgatttatggaaaaggaaatggacgagggatgtatattagactttttcgggcggcaagggcgcggcctaagggttgaaggaggctcggccgagccatttaggccggcgcgggcgcgggaaaggcggtccattagggcgcgcggaagggagagggagcggtccggtggactgagtgcacctcgcgggttccaggtggggcccgcttgtcggtgacatggcccacggtggga

SEQ ID NO: 9474 - DNA, 1501 bp, Oryza sativa
cgacggaatccgcaggagcaaagggcacctacttcgcagccggctgcggcggcgcggcgaccttcttgtcctcctcctcagcccccacctcctccccctccctcgccgccttgcccttcccggcggcggcagtgggcggcgtcagcgcggcctcgtcggggaacacgcgcttggcacccttggcgggcagcagctcaagggtggtggcagtggcagcggcagcggcaatagccgcagggcggcggtccggcgactcggagccagggaggccgaggcggagctcggtgcccttcaggtcgacgtcgtccgcgcgggcggcggcggcggaggaggaggagggcggcggcggcggaggcgagaggcctatgtagtcgagctcgaggggcggcgacatggggagcggcaggacatgaaccgggatgcggcgggtttggattcctataggagggaaggagggagatgagatgagcaaagtgtgtagtggtggtggtggtggtggtggtggaagaggctagagtagagtggacagtggagaggttgctgctgctgtgctgcctacttgatgcttctgttgctcgttgttcactgttgtttaatcttttaccagtgtacatccttccagtgtcttttgaatcgtacaaataaaaaaaaataaaagaattaaaaaaacacatgattctgatagaaatgtaagtgtaaaacaaaatattgaaaaagagaggagaaatatatgaatgatcgttagattaggtcataggaaaaacacaagaattgaatgagagttagactcaactaaatttttcaagatgttgaacctcttcctaaactctctcctacatgcaatgaaccatttcgttggaattctataggatttagaaaactctaatcttttgaatcaaaggtccaaatagaaaaagatcatatatgatttaatttaatcctatgaaattccttcgttaatcctttgttgatttaaaagggtcccttactatttttatgtgtccaatttacttatctcaatacctttgctttgatacatatgaattactctctaatatagcaatttctaattatgtatctggacatatcgttgtccaaataaatatgattagataaattcttttacgcttccttaaaaaattatatacatatacatagctaaaatttgttatattttacaatagagggagaataatgtttgaaaagaaataattgtgaggtttttaatcaatccgtctatgtagatatgtctttacataataagctgtattttagtgatgaaataataaagaaaggactgttttataatattaaaataaataaagaattagtaaatgaaaatgtatttataatacagttctttaggtgaaagattcatcgtcatcacaattactcattctgtttcaggttgtaagactttctagtattactcacattcatatagatgttaatgaatctagacacacatatatgtctagattaattaacatatatataaata

SEQ ID NO: 9475 - DNA, 1501 bp, Oryza sativa
ccaaacaacccctaacatgcctaacatgtggctaacaaaattgaagccacacttcaactataggagagcaaacttgccacacttttatgtgtcaatgatatgtgggacccacgtcatggtgaagaaatcttatcataagtgtggcacgaaccaaacgaatgcctaacttaattaaacctggctaatttgagttgtgtcacagtgaagcaaattgtggcattgagcctcacagcccctcaattctgctgcgggtcgcgactttgcgaattgcgagtagttggcgcacgtactactcctactacacgtccactgcgtgtgtctgcgttcccggacaaaattgccagccagtgcacaagtgcaggcgtgcggccacttcccaaagaaacccaagtagtggaatttccggaaattaaaacagcataaagtgctcctaccactcctactagtagtactactacttctacccaacaatcattccaaccagtctccaaacaaaaataaaactattgcaaccagcctccaaaaaaaaaaaaaaaccttaccccaaccgccaactcacgggctttggcccctggcacggcagccttaacaccctgtttaattccatctccatgcctcatacctacccactaggctagcacccacgacacacataaaccgagcaacctgtgagcagatggccccatttgtcactggcaaatcgtggaggcgacaccggtgtgaaacaacaagccgcacgaccccccagaaatctcctcctttgcctcggcccctcccacggcgagagagcgtccacccgacgctcagcaactggagcaagcacgggcaacgagtcgcagtaaaacagcagtgcggactcggagacagtacggggaaaacgcacatcgagcggtggagagtggagtggagtcgaatgcagcgcgagtgagtccaaaacgactcgtctcgtaacaccgaagcgaccgagagcgcctactgccgcctactgcgcctgcgctgccgccgcgcaagcccaagcgcaacgcatccgcctctgcctcatcctctcctccacttgctggtcgctgccattgcctgcgcctccactccacttctcgcggctcgagaggctgacggcggggcgcctcgaatttcgccctctccgacgagcggaggcggaggagggagcccaggaagaggatgcgaaagcagtgaagtttgtagaattttcagttgcattttgctgtttctgcttgggagttgctttggggcgataagaattctcttgttgatttgttcctcgcaggagaggaggagaagaggggggaacggaaatctcagctgctgcgtcagtctcgcagatctgctccgttgagctgctgtttcacggaatcaccatgggtggaaatcatcgccatgggtggtaggattggttgggtgtcgccgatcttctcgcttcacgccaactaatcgagtgaattgtgggaagaagaagaagaagaagaagccgagtagacgacgg

SEQ ID NO: 9476 - DNA, 1501 bp, Oryza sativa; identical to SEQ ID NO: 2496

SEQ ID NO: 9477 - DNA, 1501 bp, Oryza sativa
ttcttttccgcaaataatgcatgaataggatttacacaagtaattcggccgtggcttgcgagataacctgccggccccccaatcctaattgctgcaattaccctccttgaattattgaacacttaaaccccctttgtcgactgttgtgcttcgatgcacgggccttcaagcacgcgcatcgggacacctctcctcaaatttaaaaatatccaatgatgggtaaaacttgggttttacaaaagacttggaaaaacccgacacctgggtcggctcttgcgaactaaatgaattttcaaattcgcggaccggggaacgtaccgggagtacggtttcccgctcttgcacttaaggaccgtttccttggaattacatccgaacataagacaagtgcgaccacatgggtgaaatgggacacccctagctgagtaaattgctaatcgggggagccttgatgccaagagacatgtggattcaacggggtggtgtcggggagaacccccgggcttcctggcacagtatggtctgggacctaatctggtgttagtctgggacccctctcgttggcatacggtgaacctgtgtcggctttcgaaatgccttgtcgtgaaagccccaaagtcaccagacgtggctgttatgcacgggctgggtgaccaaggctagtaacgtcgtgtgggtaaggtgtaccccctctgcagaggttaacaaactgttcgaacagccgtgctcacagtcatgggcggatgtgaggtgattcctagcgtagttttgtttgactactgcttgtgaaattactgctgtggaatgggttcgatgtttggaaaatcggcggctgatgggatcagccaggcccgggtggccgtttgaaagctgttggccgggtgctaaccttgatcaattcaaagactgatacattgcacatactccgaccggacgagacgcactgtctcatccgtgtcatttgagaagcactcacctagtcgtttcaaaaaagagtttaaataaaatcaattgcaaaaacaatagcctttcctttgaagcctgcattaaacacttaattcccatggctagctgagtactcatgtactcacccttgctctatataaataaccccccccagttgctgaagaagatgatgtggcccccgctgacgaggagttcttctaggagcaagtcggctacgatgagttttagggtttcgacctagttcccaagtcgcgcctgtgatgtttggcccaagtcttggtttccgctttcccttttgtaatgcagttgtgagctcgggatctgtccgcagcccaacatgactgtactcctactctataataaagagacctctgttgctgtgatattctgtctccctgtgataccaacactgtttcctgggactggtatcgattaacaggttaatttggagcgtcacgggctagttccggtcgggactagttcggggcgtgacacccaggcacaaacaaccggccacccttgcgcccagagccca

SEQ ID NO: 9478 - DNA, 1501 bp, Oryza sativa
attaatttgataatgagagtgcaaacaaataaattaactaatactcatataaaatataacataatcgatttataagtataaaatttaaaataattcttaaaaaatcatctatatatttttttatgaaaactacaccgtcataaattcaagaagtctcactagtcaatctataaggtttcataaaggttgagctttttcatggtacacaaaacaagaaaattcatcaacacggggttaattgagtattatttattattttaatcttaaaaaatattttttaagatacatatggacaaatcattcctagaaattgattgtttctttaaggaaggatggcagttacctccgtcccaaaatcatttcatttttcactcatcctacacatactaatacaaaattaaaagattaagatacccttcactttactaagggcctgtttgggagcgtaagattctaaaaaacagctggttggtagtcagcttctgagaatctagaaaaactaggtttcctagcttctggcttctacttcattctctggattttacaactatagtttctcacaatccggaccaaaagctagactgtttggagagcttctgattctagaagaagctgcagcagctagaagttcctccaaacatgccctaaattccaatagaattgtcccccactttatttatttatagtatatttatcttctactttctaaaactctaattctaatacaatgaacgcttaaaaagcaaacttatttgaaataaataagagtgacatagatgaacttattttgtgagtatgaatagtagtactacttttctccatcccaaaatgcgaggaattttagttgaattgaacacattctaatactacgaatctaaataacgaatgttcaatttatagtaatggtatgtgtcctattcaactaaaatcctttgctccctccgttccacttaaaacgcagtggtaggtttccttgttcaatgttttaccattcgttttatttaaaaattttatgaaaacttaaaagcaagacacatgtaaagtatatttatttattttttattatctaataataaaaaatactaattataaaaaataaataaggtgggagtagttagtactacaggctgtataattaatttttttttcatatttaatgctccatgtatatattaaaaaaattgttgctgattggaaagtaaacatgacctacattgcgcttcctcattcatggccgtagccgacactactaattattttgcgcctccctatgaaaaagctgtgctgcttgtagccgctgcagcgaagaagcgcaagcgaggaagtgaccagcctgcctacggccgctgctcagctcagctcccagctgtcacttgctccaatggagacgagtacgcccaccaaaaaagcagtaattgcacttcacagttttccccaccctttcgccgccctcccctggattccgtagttccgtcatcaccaccaccacgttccgggcgac

SEQ ID NO: 9479 - DNA, 596 bp, Oryza sativa
attcctgcagccctgcacacatttctgggaactcaatttctttgcatacactgatcaattctgtagcagatcctctgcgggctctttcttgctcaattaattcttgtgtattactataacccatcaaaacagacacctgcaatcataaataatccagacaatgttcactgttcacagcaagtacagatgaatagttgtgtgacattattagtgaagagtggcatcaagcagagagccgtgcaaatcaaatccagacgtcattaagtagagctattgcataggcttaaactataaaggtcataacatcaaggaagttaatgtacaagtatatgcgcattgtatttaaacaaggttactatgcactagtttgaactcacaacaataattagaggacttgggaaatataaatagctttcacttggtagagcccaaatggtggaacgattgaacagatgaaacatacagaactaaactcattactgatgcctgcaaaatcgaaggctaacactaacaagtgaacacaaccagttgctggcagggcacatactttgttcaggagttttgatctctctgacgtgccatccacctccaacagc

SEQ ID NO: 9480 - DNA, 1501 bp, Oryza sativa
tgaatgttgtggtccagaagtggttaaagttataagatattttatatattaaaaacgagttgacttataaccattagagttaagaagaccaagttgtaagtcgtattctgaaacaacaatagtgaaaagcattgttaacagctgctttggtgaaaggcataccttccatatgatggccgtgcaatcacttgaagatgatgccagatagtttccatcatttgagaaccttacaaaccaaacttcattgttatgaccacataatatctgcaaacaggcatggatgtgtcaaatatccatcttcggactatagtccccgcccccaagcatgaaacttgtctagtgctatagatccctgaaagaatacataaatgagtttacctgaatagtaatcccctcttggctaaaaaagaatctaataacattattatcattggttttgaagtatctcaagttatgatcatttcttttagaatataacagaatttgaaaaatcagaactccacagaagacctctacacaagcagataaaacatagtttgaaagcagagtagaaaagaaaggtttgaagtggtgctgtttacagtgtttctatctttcaaaacaaaaccgagatttcaagtgcaaagactcttaaataatgcaaatccctgcctcactggggctagagaatatgcagtacttttgaagagtagtgtctcccggtagcatgataattttatgcttccaaacattggcacggaaaggataaaagctgcatatatattgaaaaaattacagtgaatattcgagttactgagttagataaccatacagaagtacgttctgaaaactagtcagaacaattgccagcataaaaattgtacattgtcggctctagtttttgaaattgatctgatttcacatacttataaaccttataactggggtgtttgtgcaaaactggtaatacaaatcaacaatttaaactcgcacctgcgaacacttggaaggaatctgctcttcagggcacttatgatcctcaaacaaagtgacctcgtccggtaaattgtgatatacacaagacgaaacctgcttaacaactgcattctccaccagaagctctagccgaccgcttggcacatggaaccatggcgggaaagcatcaaccagatccaagaaaagcccaatcctccacccgaccacggcatccggcgcgaccgccccctcgcacgagaccattgcgcgtgccagccagtgcacacactccctgtcaacgccgaggggcgcaatccggcgccagagcacctccctggcgcgcggcagcccagcgtcgccgatccccagaagctccaggaagtgccccctccacaccaagaactccgccgccgcgcgctcccggtccccgaggcccgccacggcgcggatcgccgccacgcacgcgtcccaccggccagacattacgtcgaacaggaggcggtcgtgctccgccgggtacagcggcatgccggactccgcctccagc

SEQ ID NO: 9481 - DNA, 1501 bp, Oryza sativa
atgttgttgtacagcaataagttaatgcaattttttttatgtgttgacaggacgaatcagatgtctttactatgattatatgggcattagaattgtgcatctcagtaggagaacttttgtgggcgcgagatggagttggagaagatgacttgcggagaagactcccgcaatgatcacgatcgatcattccgttttgatgagccaattaattctacacttattgcaatatcaatggctatagccgtctgatggcacataatgtttgtggcagtgcagaaggagattgcttttataatagtgatagagatctgagtgatagtttcatgagtgacatagatatgagttctgagatacaaggttccatgactgatgccatgttgtttgatcgtttagcatacggcacgcttcctagttacaatatatatatatatatatatatatatatatatatatatatatatatatatatatatatatatatatatatatatatatatatatcactcaaaaataaactacatgataaaactggtgtgctcactaatttaaaatatgtatatacttcttttcttatttgaaattttatacttttcataaaatattatagaaagaaaattgtgaaccactattttagtattgacaaatgaatatatatattaaaaaacatttatggatgtatgtataaatgatttatttattatgtatagaagtgaaaaacatatttgttatataaaatttagaacttgtatgtcatgtgaagcaaaaatactaaaatttaatgtgtcattttatacataaattttaatgaaatccaaacaaataaaataaattttgagattcatcaaaattaattggttcaaatatatttgcttgtggattttaattttttaaagattaatcatttaatatattcagagttttttaaacatatcccatacaacaaaaaaacacaatcatttttttagctgaggagatattaatgatcttatttcgtgatagatgaaatcaagattgttttctttatttatttgttttggatttttttttgcataataattttgggtttactatatattctatatatagagttatatgagtaggcgtaggatatttaaagaaagataatggatgcaaattcgttgttttagatttgtttttttccctaatagttttgggtttccctctgtctccccgaggggtcggaccgctcccgtttcggccccgagggctggggcgcccccgtttcggccccgagggctggggcgccccgaccccctgtggttttggcgccacgcgtgtgggttaggtgagcacagcggggctcacctaaccgcatttatagcaggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaa

SEQ ID NO: 9482 - DNA, 1501 bp, Oryza sativa
aaaaaaagatttccaccaagccatgcgccgcatcctccaagcggatgcccaccttctctcggcagattccagcatcaattcttgcgccgctaccaccatccgccaaggcttcttggctgcagccacagctgcctatcaccccgacccaactgctcaagcaagcttcctcgcatcctgcaagtcgatgattggatcatcgtctgatttggcacgacgtctgcagagcggtaataaccagctctcctcgcaagatgttgagtgaattgcgatgttggtatgtcctggatcatcccgtagttgtgaagagccactcccttcactctcctttgctaggtactactccctccgtcctaaaaaatatcaattcctataatcccataaaaaaatagtggagagtaaaaatgaccaaaatacccctcattattagaaaaagtagtgatagtgatagataggtaaagggtatttaagggataaaacttctttgttttatgtgctgagagtatgtagagtggtagaagttgattttttgtggggacaaaattcaaactctaagtcttctgaggacggagggagtattactattttggagagctcacacgcactcgtgcaatgatgtgctgaatgcatacgagcagacggtgcctgggtatgtaaggttttttcattgttttttgttggttgctgataatctctaatgttgcttaccaaactgtattttgtctaatttttacaggtcttggagctctatctaatatgtggtgtcaataacgaggagtgcccatactgtttcgaaggtctctatggtcatcattaccaataatcgcacccacctcaactttctagcgactcatgatagagccatgttttttttttttgctaaaattcataatgatgacaatggtgcatccttttgttgcccggtgtctctgccgacaccatgcactggtaagctatcgacttgaaaagtaatttttccattgttaaaaaaaagcaccagaagataatatattttaactctctgaatttattttataagtagcataaaatttctcatgtacttgcacgcccctcccccaatcaaaaaaagtcttaaaccacatggttcaatgttgttgtacagcaataagttaatgcaattttttttatgtgttgacaggacgaatcagatgtctttactatgattatatgggcattagaattgtgcatctcagtaggagaacttttgtgggcgcgagatggagttggagaagatgacttgcggagaagactcccgcaatgatcacgatcgatcattccgttttgatgagccaattaattctacacttattgcaatatcaatggctatagccgtctgatggcacataatgtttgtggcagtgcagaaggagattgcttttataatagtgatagagatctgagtgatagtttcatgagtgacatagatatgagttctgagatacaaggttccatgactgatgccatgttgtttgatcgtttagca

SEQ ID NO: 9483 - DNA, 1501 bp, Oryza sativa
tccagaaatttgagcacacaaactttagcaaggacaaacagataatatcggcgagttgcttatgggctaccttggtgtgcccccgcagaacaacttcgttgctgagaggaatccgattgtaacgctcgccgtcatcctccatctcgtcgtcgctgtcatccccatcgtcgtcgtcgtcatcctcgtcctcctcgtcatcatccttcaccggtggcggccgaggcggcccaatcatgccgccatccgcgtcctccccctcaccgcgagaggacgaccgcggcggcggccgaggtggcccaatcatcaccccgccgccctcctcgtcgtcctccccctcgccgccgccagcgggctggggcgggggccgagggggcccgaccatgggcccttcgtcgtcgtcgtcgtcgtcgtcgtcgtcgtcgtcgcccgcggcggcggcggcggcagcggaggaggtggagggcttggcgctagggttttggggcggcttgcggagggtggaggcgtgcgcggaggcggcggcgccggcgcgcgtgggcgccttgccgaaggacatcgggaagaaggcccgcatggcctcctcgtccatctccccgccgtccgccatcggccgctcgccgctcgccgccgccgcgccgacgtcctgtgcgctgtgcgcgagacgcgcgctctgtttttcttttctttttttttttccgagcgggtcggtgcgtgttccagcacgggcggggagaggcgtggtgcctttcggagaaactggtcgagtcggttcgtcgcgttaacttagggcccactagaaaaactgcgtggcagccacgtatggtaaagtgaacccagctcattcgactttagtggagtatctaattaggaccccttaacttgaaagaaaaatatagaaacttttattctgtatagaataatattttttttctatatgattatttgaaccaaaggattattgaaaactatcgaatcttatcaaatttctaaggaatgcccaaattcatataagttttggagtatttttaacatgaggtccaatatcatgcaaagtcttttatgagtttatctctatcatccaattcttgcatttttcgtacggtccaatcaaatggtgatttcatatattttttatgtgttttataattctttgttttgcgcttgattttttgttagaattgtatgtttttcctattcatccctcgatcttccttccaaagtagcccttacaagacatatataggttgcatttgactgagggagaaaagagaaaggggcaattttgtttgtacccctactttaatatccaataccgattttaccctatattttagggttgttgttttttgcccaatttttttaaaacggatgaggcatttacctttttttttacggaaatgagtgggatcggacttaatgcggtaaagaattagagaaagaaagagataacgatatttaaattattgattgacccttttacccctagaaaatatccaagtaa

SEQ ID NO: 9484 - DNA, 1501 bp, Oryza sativa
gcggaggcggcggcgccggcgcgcgtgggcgccttgccgaaggacatcgggaagaaggcccgcatggcctcctcgtccatctccccgccgtccgccatcggccgctcgccgctcgccgccgccgcgccgacgtcctgtgcgctgtgcgcgagacgcgcgctctgtttttcttttctttttttttttccgagcgggtcggtgcgtgttccagcacgggcggggagaggcgtggtgcctttcggagaaactggtcgagtcggttcgtcgcgttaacttagggcccactagaaaaactgcgtggcagccacgtatggtaaagtgaacccagctcattcgactttagtggagtatctaattaggaccccttaacttgaaagaaaaatatagaaacttttattctgtatagaataatattttttttctatatgattatttgaaccaaaggattattgaaaactatcgaatcttatcaaatttctaaggaatgcccaaattcatataagttttggagtatttttaacatgaggtccaatatcatgcaaagtcttttatgagtttatctctatcatccaattcttgcatttttcgtacggtccaatcaaatggtgatttcatatattttttatgtgttttataattctttgttttgcgcttgattttttgttagaattgtatgtttttcctattcatccctcgatcttccttccaaagtagcccttacaagacatatataggttgcatttgactgagggagaaaagagaaaggggcaattttgtttgtacccctactttaatatccaataccgattttaccctatattttagggttgttgttttttgcccaatttttttaaaacggatgaggcatttacctttttttttacggaaatgagtgggatcggacttaatgcggtaaagaattagagaaagaaagagataacgatatttaaattattgattgacccttttacccctagaaaatatccaagtaacgcttgggctgtgtttgaaaccatgagttcccaacccctctccctcgttttccgcacgcacgcttttcaaactgctaaacggtacgttttttgcaaaaagtttctatacgaaagttgcttaaaaaaatcaaattaatccattttttaaaaaaatagctaatatttaattaatcatgcactaatagatcgctccgttttccgtgtgggagggtaacgttccaatccatggctagcgaacacagccttggtgtactttcaggcttgggcacttggcatcgactattcccttcccaaacccgaatctccgttgtgaaacagtggcggcagtgttcgtgggccggccaggcaacggggatgactcggccagatgcaggccacccaacccagttgcagcgtgcaggagggggctaggcattgcgcaagaggacgtgatagggaggaggacaatggcggctgctgtagttcagcgcagggagaaggcgtagctgctcgacgtgtcgaggagacga

SEQ ID NO: 9485 - DNA, 1501 bp, Oryza sativa
ggtgacggcacactgtttcttagcccttttactcgtactttgatgatgtctgggttctttaagatggagcaacataaatttctcatatattttgtttgaaaataaatcgagttgaccttctgttcatcacagtaagcgccgttccttaagcttggtcgtatgctatatggaagtggccagccagatcatgcatataacatgacatcgcgttaacttctttttcaaaacaaaggctgataatattaaatagaagaaacaattataaccttacatgcaaacaagacattaagcatgtcaacacacaacaaaggcgattcacattctataatgctacaagagattcgagcaaacgagcgcaactacaacgctgactaaattatatatacatctaacgggagaaaggctttaaaattgaatattgaatgattatagaaaattgatttatactgggtaagcatccaatgcttggatcctcacatgcagacctcggagaagttcatgctataattaccttggacaacttccaatacacaaagtgaaaattgctaaactccttgcaaaagagagcactgagaggttgacaccaccggcaaccctgtcttagcttgctccgccgccgacaggtccggtgcgccgccttctctccttccgcgccaccgcacgccgccgcggcttaccaccggtatgtctgtgttcttatcttcttattgacatgtcatatattgtttttgttatacatatataggttacagcatgtgtatatcatacatacctcatcttagagttccttgacttcagagttaattaaaaagcgatattgttcttgtgctgaaaagtttcaagttgaaagcaaaagcatattggatgcaataaactcaggtttacaccaaatgttaccctttttattttgtcacgtgtaactgtgtaagcaacgacacgaagtttcatgagattgttggtaaattaagttgcaatctgttgcaactctgcttttagtggacgattacttttggaatagaaatattgttgatgctatgcacctgcgggcaggggccaacacatgatttttacaatgagggtaggaagtttattaagaaaccaatgctatataatactagagtactgaagatttatgtagaaaagcttaaacaaaaatagttgtctcatatgctttaagtaggctaataattagtgttttggttgaaaaggcaattttttgtaccctactatagtataaatacctaattggcatactatctaatgaatattttaccaaaacatatataaaaaagagtgtgcatctgtacacctcttgtcccatactagctctgcctctgcccgagggattaaaatctacaattcatttagatggatctttaacatacagttttcatatgaccaggcgatcatcaatttatttggagcaaggacaatcatattgtctaatggatcttcaaaaaaacaagcataatgaattcatcgaaaagccaaaatggataga

SEQ ID NO: 9486 - DNA, 1056 bp, Oryza sativa
tatttgtagagaggggagaagcggcggggcttggggcggcgcgcggctcggtgtgacggcgatggcgacgcgatgatgacgcgatgcggcagcggcgcggggcgcgaggcggcgacgcgatggcgagcggggcgcgagacggcgcgcggggcgcaaggcgacgggacggggcgacagcggcgatacgataggcgcgcggcgtggcgacgggacagtcgcgcggcgatggaatgggcgggcgacgcgacgcgggacggcgatgcgcggtgacggctatgcgtcggatggcgtggcaacgggacgggcgcgcggcggccggtgatggcgacgagcgggcggcgcggcgcggggctcggcgcggctcggcacggggctcggtgtggcgacgacggcgacgcgacgggcgagcggtgcggcagcgggatggcgatggggacggcttggcagcggcggcgcgcggctcggagcgacgaggggacgcgcgcggcgacgggacgggtggtgacggggcggcagcggtggcgcgcggcacgaggagggatgcgatggtgacggcgcggcagcggcgatgagatggcgatggcgacaggcggcgaggcgatggaacgggcggcgcggcgcggtagcagcggcggcacggggctcgggggagcggcgcggcacggggcgcgaggcgatgacggcgacggctcggcagcacgcgcggcctaggggtggtgatgtcggcgcgggctcggggtggctcggcgacgtcggcgcggcggcaggcggcggcggcacgcgcggtgatggcgacgacagaggagaggcagagcggcgcgcggcgcgcggggcgcgggggcacgcggcagaggaggggctagggctagggaacgcgatcgaacacctagggggcaatgaatagtgccgttttctaattaacccgattttagtttatttcccatataaatttaatttcataatttctaaatcttgtataaatgaagtttatcccatatttgtgttatcctaactaaaattctccttaatttgatatcactcatattttgtttatat

SEQ ID NO: 9487 - DNA, 1501 bp, Oryza sativa
agaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtgggggatgggatattgcatgatgaattttatgctgatggagccacttcccgagaggagggaaggtggacatcctcagaaaaccatgacgaatcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatgcaaaagaacctgaagccattccttgaaataccctctatcatatgcattgttattgtggtggcttgctgagtacggttggtactcacccttgctatttatatatcttttaggagagtgttgaagagaagcccttgtcggtacgcttgcgtatcccacaagatgatcggagtgcggtcttgttctaggtctcgttccccagtcgactgcttgtggcatgttaaccgggcccttatattattttgtcttccgctgttgttctctgatagttgttggcctacctggccctaatgtaagtatttaactcttttagcctaaattcattcgtgatatgttgtgatccaactatgtatgtgtgtaccaactactgatccagggattggtacggataaacacagaagatttccgatttccaaaatcgggggtctacagtaagagttgacacaaatttgtaagagactgttttaacaatgaccttgttatttctaacacaaagtcggcgtgggggcagtttgtcaagtcaagaaaaaaaaatatatcatggaccccatgctggcgtatccaccctagctggcttacacacatgtataaacaaattgtccattaactagtgttagatgaacatgacatatatgtatgttaagacttgaacaagtccacaagagcacagtcaaggaaaatatatgattacaagttaatttcctgtatgataaaatgttgccgctgttaccggtcgcacttaattagttatatactactacgtatgtgcttatatatattggatacgcgggggagtttcaaatcactcaaatccacctctgatctctcgcttggtccgcatttgtgtgtaagtgagtagatagagagagagagagaa

SEQ ID NO: 9488 - DNA, 1501 bp, Oryza sativa
ttattatcattctttttcccttagatgttttataatttttctataataatgatttttgtttgagctaataacacatactagcacttcaatatttttgtcattggataattcttgcttcagtaactctgcatctctcgctgaaatcctgcgtccgctactgaatcggagccaagcctgtgcggcccagctcgtcacaacgcttgaagatgatgaacctcgtgacgcgaaactcgtacgtcacgaggagaaggctgctggaggcgtaggttgaggcgtcaaggtcggaggcagcagcgatcgacatgtcatggtccagtaaacataaattgatggatggatgtgaggtatcgtactatcctacaaaaccaaaataacagaaacgatactgatcttatcctactatagaaagggtttttgcgtgtggaccgaaaagcatcttcctgtgcggaaggccggcacgcccgcccgagaaggtctgcgataatcaaattttcgcatgcgattgacccaaccgcacgggaagatgtattatcccgtgcggcactatatacaataacctaggcgtttgggagtatctcgtcctatctcaaccggtagcaataccggattatcaaatggtacgcgttctacatatcagggttgtcattagtcgcacgaattaagaaatcacattatgatataaataagaaagtagaatgcacacattcacataaaatatgtaatagacatatacacatacacacatatatatataattattgtcttggaatttacaataattcaaaaccaaatacaatttatgtctctaaattgttttttcacgtaaattctttctcccactctcttaggcgtttgaaagcgtcattctttgcaaggtcgctctccggatcgtagaattcgcccaaatggttacaaacatcgtggcggatgtaacgacaaatatctgcacacaagttgagaatggttttttttgtcgaacaggtttgctacccatggaattgacatgatctgtttaagaaaaatacatattgaaagttagggaaattaaattattgaatatgttaatgtgtacacgatattttctagactcatatctgcaaactctattgtgtacctcccattaatttgaagcatctcgcacatgtagtatccacataagttagtgcctggtggttgcttgcaacactgtgttgaaaattctgtatacgtcaatatttcaatctaacaagtataaaaaatgttactatagcggacataccattcattaccggccatcgtgtcttcacgagaagcttactcttactggcatcctttactcgtccgctttggtctttgtaatacttgtgtgctctatgtagccaaaaattttgtttgagtcaattgtgagtacaagagccaatagttattgcgtagtgtataacaatacttacaagttcaacaacacaaggaattccgtgaatgtcttctcggcataatgtgccggatcaagcacgacgaccaa

SEQ ID NO: 9489 - DNA, 1501 bp, Oryza sativa
gattccaaacccagcagcagctcgctcgctcgcctgcctctcgcccggcaacctccgccgcccgcgtctcccggcggccgcagccgcagccgcggcggcgcgtgggtgggtgggtgggtggggtggtggttgggggcggcgcggccggcggcgaagcggaggcgagtggtggtgtgctttttcgcgtcgcgttcgttcgaaacaaagagaatttcggggatccggcgtgaaattggaaaagaaaaaaagcggtgtggtcgagtagtctgcgtgggcgggaatgagggcccaatggttggattttgcggcccatgtataagggtatggaggcccaataaagcgaatgcgagtagatcactcgtttggccctatgctccgtttttttttactagtttacatgtccgtcaggttaatataactagatgaatttcccgccatgttgctgcggaaaattaagttatattattatatgtacaaataagatgtaatatgattatcaaaactaaaacaaattgatagtacaattttgagactaaaaataattgagattgcatggttttatgacagaataaagaagagacaatttgaatcatatatctatcatccaaaggctaaaaataattagggtgatgtggattaatgagagaagagagaaatttcattaactacatttagtgggaatgaactatataagtatataggattagtgatagacaggaaatccgtatattgatgggagaagtccatgtgataaggatggacagtgattacttttaggtatacggacgtgctgcgcacgttgagacttgagaggaggggatgaaaagaggacgaatttttaagatagtagagataccatgacattgtgtagcaatggaattataattggttcagttttttaatatatattttttatttttgcatgaaaataatattttctttggtttagtatttttagggagttgttttcttacacgaggaaactacgatggtggggggaggactactccaatataaaatagcagaaaaaaaatatttttgagttgttatttactttttttttcaagtagtactacttgcatattcatccgccttcctctcctcccaccacccagaaaatcggtcgcatatcaatcctcctcctatccgcgaggagctgaatttcaattcatacttttgatattgccgggccggtcaagataggccaacctgatttacttaagactgaggaatataaacaaatatataaagttttgacttcaacaataaactgtcgaagtaaatagaagttgtcacaagagcaacctcccaaaagaaaacagattacactaagggattgctctcctatatttctaaaaaccacaacttcctttcaaatcgccacttcctctttaattgaaccaaacaggaaacctgccgagcgctgctgattctaaaatacacacgcgtatttctttccttccaaaccatccaacaaacaagcagtataaggctgtcaatg

SEQ ID NO: 9490 - DNA, 1501 bp, Oryza sativa; identical to SEQ ID NO: 9489

SEQ ID NO: 9491 - DNA, 1501 bp, Oryza sativa
tgtgtgcttactgttaggtcgattgctggtttgtgaaactactgtacgatgtttcacattgcaaaggtaaaaataaatatatctagggggattaaccattggtctcgtagttagatagtgtcagagaataagggtgacggtggtggtggctgatttcatagaaggtgctgttgaagtgagatggcatagaggttgtgcattggtggtggtggttgtttttttttttttttgggcgggggaggaggggatataaggcccgtttagttggcaaaaaaaaattgttttggggtgtcatatcgaatatacggacacacatttgaagtattaaacgttgtctaataacaaaataaattatagattctgtctgaaaactacgagatgaatttattaggcctaattaatctgttattagcaaatgtttattgtagcaccacattgtcaaatcatgacgcaattagacttgaaatatttgtctcgcaatttacatgcaatctgtgtaattggttttttttgtctacatttaatactccattccatctatgtgtccaaacatttgatgtgatagggtggaaatttttgttttgagaactacacagagcctgaataggagaatgtaatccgacaactacatggatctcaaaataattacaatcatctcaagataactaagagttaacccaaaaaagaataattagcacataaaaaatcttttatttgagaaatcatgtcagtccaaaggtaggaacacatgtaccaaagaaattaacaataacagtttgatataaataagttcacggaattcctatatttcttttaacagattgtcttaagaaaatctgtcagattttggatcctgattggatctaagatttgtgcatgaggtggaaaaaaaaaagcacacatgactacgggagtcaaatcctattccctagaccgaggtcccgtcacgctaccaccgtaaggcatattttttattagttacacaccatttatatgcaagtaatattgtaacttacaatacattacacaataattatacatttgctgtatttgacatattttaaggggattttctgtcaaatgttatatagacagttccgtacgtttacatgtttttcatttccctcaaacaagcaacataaaaaaaaaaaactccagcgaagtaagctcaatacaatttggaccataattccatgataaacaaaactagcccaggtttgacacctaaatggcagctgcatatgagatcaatcaccaacccatgtacatgtacacatgtccaacactacaaccccttatccagattgcaaagtcaaacatttggcgccaaattgaaaatccctttctacagcagttaggcctcccgcctttttttcttgcttcctcctctccagcttctacctcccctctccttcttcttcctctataaaaaccatggcattgtagcacacgttgctatcaaatgatcacctcacccacctccacgccaccgccctttcgg

SEQ ID NO: 9492 - DNA, 1501 bp, Oryza sativa
tgcgtgcatggtcgaccctggacagcacgaagtacagcttggccaatgcggacgccacgaacgtgtccgccgcgtagcccgcagccacagcgagcgcgtgcagcgcgcgcgccgcggaagacgacgcggcgccgcctccacgggagcacaaggcggcgagcgaggtggcggcgaacgcgaaggagaaggagtcggggcaggggaagaggaggcgggggcggagcgacgggagggagcggaggagcgcgttgcggaggaaccggtcggggcgggggaagccgcggaagaggcggaggaggtggccggtgggggcgcggagcgaggcgtagcggaggaggagggaggtggccggggcggggtcgagcgggtagtggccggaggcgagggagacggcgaggatctggtcgaggtggcggagcgtggaggagagcgcgacgaggcggaggtaggggcggcggagggcggcggcgtcggcggcggagggcgggcggcggcgcggaggaggcatcgacacgcgcggcggtgagggagggagacgatgggtggtctcgtcaggttcaaacttcagtgtaacatggatgatcgaccgtccgatcggagatggatggtcaagatgaatgtggacttgtagaggggttcgatccagcgtttcgggctgagttgatagacgtacggattaatcaagttactccctcgatccctcagtttcatattgaagtgttttttaaaaaaaaattgttaagtttaaacaaatttaaaaatatttagcaacttctaaaatattaaattagttctgttaaattttaacattgaaatatgtttgttttgatagcatggagtactatatttttctataaattaggtcaactggaaaaaaaagtcaaacgacttataaagttataatataaagtggaaaggggagtattagatatacaaatttaaaaaatagatttgttttttaaaaaatacactgttaaacggtttgaaaacgaaaaatgaaaaagtagctcgtactgctatttggaccctagtagaatggataccatttggataagtacgaacaaagccactaaaaaaacaatttgcttttcagaaactaacgctgaaaaatagactatgttaataaaaatcataaaatcctttaaaactaagtttcaaaaaattattagtgtctctagctgataaaccaacaagcacacgttaagtgaaagctcgcatgcgtcttaaaaaaagatgttgaccttcttataaacctcctacaaaatggtttatggggtaccctccaaactatcacattccaaaggattaagcagtccagagcgacggcaaacgaaccatgtgccaccacaaaaaatgggcaaaaaataaaagggaaaaagaaaacagtagtactacagctccaggggccttaataaatgcaagactctggacgttgcaacgaagcggataaggcgtgggactaaaacttttcaagtccctatcacatcagatgtttggactc

SEQ ID NO: 9493 - DNA, 1501 bp, Oryza sativa
tggcccgttacaacatatgagtacatgatgtaactagtaaagcagaagaattttgtttttcaaaaggaataagttcactttgactcccttaaatgtgacccgaatctaattcataaccctgaacggcaaaaccagatatcttgacccctaaactgttaaaaccggtgcaatttgactccctcagcggttttggagggcggttttgctgacgtggcgcctacgtagcaatattgaccgagtctttgttccacgtggtgttgatgtggcaattacgtggcattagaattaaaaaaatgcgtgggacccattagtcattcacacaataaaaaattgagcccactgacatgtgggacctccctgtctccttccttcttcctcctgcctctcccttctctctctctctctctcccccaatgcgctgcagcgcctcgccgcatccgtgctcgtcgtcggcgccagcctcgccgcaccgcccgccagctgctccgcttcggcatccgcgtgctcatcctagagggtcacgcccgcccaagcggccacgtctacaccactcatctcggcgggggtcaggccgccatagagctcggcggcagcatcatcacgcatttttttgtgtgaatatttctttttgtatgaatgactaatgggtccacgcatttttttaattctaatgccacgtaagtgccacgtcatcgccatgtggaatgaagactcggtcaatatcgccacgtaggcgccacgtcagcaaaaccgctgagggagtcaaattgcaccggttttaacagtttaggggtaaagatatctggttttgcggtttagagttatgaattagattcgggtcacatttaagggagtcaaagtgaacttattcctttccaaaatgaaattcccaaccactgatcaatgattaatgggccttagatcaccattgggcctagcccgtcgcacggctaatccattggattccacattcgaagtcccaaattggatgcgctcgtgcaacgaggaaacccagagtccgagactccaatgcacccgccggccgcgcattccgtcgagcacctggcgcgcgcctccgctccccgcgacgcctccgctctcgtcctcctcctcccggcatgcgggaccctccgctccctgcgcgcgctccacgggcgcctcctcctcctcacgagcggcctcctccgcggcatccgcgcccgcaccaagctgctcagctgctacgcggcgctcggcgacctcgcctccgcgcgcggggtgctcgacgggacgccccgcccggacgcgtacgcctacagggtcatgctcgggtggctcgtcgacgcggggagccacgccgacgccgtcgcgctccaccgggacatgaggcggcggtgccccgcggcggcgcaggccgacgtcgtgctgtccctcgcgctcaaggcctgcgtcaggtcggcggacttccggtacgggaggaggctgcactgcgacgtcgtcaaagccggcggcgcggatggat

SEQ ID NO: 9494 - DNA, 1501 bp, Oryza sativa
gtcatacacacacaacttttcagtcacatcatctcaaatttcaaccaaaattcaaactttggatccaactaaagacagccttacaaggataactaacaaaactactttattttccttttcaggtcccactagcgactctttactagttttcacatccactttattgaaaacattcagcttgaacgttagacacgatgttggtaatttttgctcttagctcaccattagctacgtggtgacgaagtttgtggagattctaaagaaaacgtgtgcgctcagttcaacctgattatattagctagtccaccaaacgtccaaaaccgagtgaaaacaacttagtttttctcagcactaatctttacttgattcaaacctagctacaaaactatagatgctatgaaaaagtagaattaacatgcagagcagaaacacgcaaaggggagcaatgagcataacacaaacagttactctactgtacgtatgattaactgcagtgaaacttctacgagaatcatatgatgcgagattcgcacgttttccgaatactctcgaatctcaatgggaaaacctcgacagtctcaactcaatacagtaatttaaggacgaaccatttgcccattttcacatgatgtttagtacagattcaacatacaagtacatacatacagaaaaaaaaatcagtttgtaacccctacaatttgttgtttcttcttacaagtacatatatacagaaaaaaaatatcagtttgtaacccctacaatttgttgtttattctcatatattatccatttccacatgatgttaagtacatattcaacatacaagtacatatatacagaaaaaaaatattagtttgtaacccctacaatttgttgtttcttcttacaaattatactacttttgagccatggacaaaaagaaaggagatttctttcattcaccgcgtgcatgtttctgaaccgttaaacggtgtatatatttgtaaaaaaattctacaggaaagttgttctaaaatttatattaatccatttttaaatttaaaataattaatacttaattaataattctgatcctaagtatcaaagtgacactgatagaagagatacctcgttattcttaaaccccttatacacctactacgcatctactagtaccactattaagtatggctggcctagtgtgacttgcatctccggtcaaaaacaaatggactcgttctacgtgacagtagtcttattgatcttttttctgcaatttgactgcagagacttcactgcctttgctgcacacccatcgtgccaaccatttcatacacccaacccaactcaccaacccacaccactgcatgcacacatgcctcgctctctctatataaaccaacccaaaatggccacgaaaaaccaccaaaaaaacgtagcgcgcggcacacggatcaacgtgaacgtgaacgagaccgagacctcgccgccggcgaccaaaaatttgtactaactgtgatgg

SEQ ID NO: 9495 - DNA, 1501 bp, Oryza sativa
atcaaaaatgagatacatgtgaactatggtaatttgttcaaggggcaattacatccatgcccttactttgaaagccaattacggttttacccccactttttagggtttgcatttttatcctcaccttttaaatttgaatcagccgtgtaccatcacttctaacagttagttttaacagtgttagttgtagagaaaaggacatttatacccttggtggttattgtattttggcctctatttttttcagccttgtgtgattttgcccctattttgtgatttcagctggtgtgattgttataaataattcaaatatgagcatttcttgtgatgtttttgtactttaaaaaaaatcacaaatactaggcaattacaaaatttgaccaaaatttgaataaaattttgacaacatttcgacagaattttgacacaactagcacaagtcacatatatagcaagcattacaaagtgtcctatacaaataagtcacgatacgtataagtcatctgttggaattaatgaatgggccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagaggggaaacacacgcgcgcgctcgctcgcctcgcctggcagggcaggcggcgcgcgtgcacgacgtacgcgtcgaatggtccaaaaaattggctcctcacccttgcgcaaatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcgtcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttacgcatatttgatatgttcatgttattctgcgtagtttacatgtgtagatctaatgatgcgttcatgctagttttcatctgtaatgtcataatttatttatggaataaattaaatcattatatgcccataatctcaacaatccaaaaaaccttattataggcactgtgattttacta

SEQ ID NO: 9496 - DNA, 661 bp, Oryza sativa
tcgtcacgagtttggtgctcctttcctgtcgtcatgctagcatgaatctcaaagtacattcaacatctgaaaaaaaatctgcacgagcatgtgctatatatatattttttaaaaaaactcgtcacgagtttgatgctcctttcttgtcgtcgtgctagcatgaatctcaaagtacattcaacatctgaaaaaaaaaatctcacgagcatgtactatagtttgatgcttatttcctgtcttcgtgctagaatgaatctcaaagtacattcaataacttcaaaaaaaaatctgcatctgcatgtactgtatttttttttaaaaaaacacacgagtttaatgctccttttctctctttgtgctagcaatggatctcaaagtacattcaacaacttggaaaaagaatctgcacgagcatgaatctcaaagggcatccgatgactgaaaaatcggaaattttctcactattttctatcgacagtagtttttgttcttttatatactgtatgtatttatattgtgaaacggaagaagtatatatataacaagtgatagaggctaatcgattgtttgtagtgattattagtgcatgtgaaagccatgggaagtgattggaactctctggtgagaaacccacaggtgccaccaccgttcaccggcgtca

SEQ ID NO: 9497 - DNA, 1501 bp, Oryza sativa
aaaattttttgtttggaaactaaacaagaccttaatttgtctaagcttgtcataatttgttttgactgacctgccaaagggcttggctaacaaaactgaatccatactttagttagttttaggcaagtttgccttctctctctctctctcttttcaattgcatatgggacgaaaaaaggaaatttatcataaatgtggctacaaatcaaacgtgtgtctatcttgatcaatttatctaacttaagctatggtaaacttagataaattgtgtctatcaagcaagcaacccttagtagtagtaacatataaagagcgatatatgattgtattgtgatgagacaacaacattacaaaatgttcactagggttctctctctagatgatggaaaaacctgatctttattttaacaaaagaaataagtaattattactataaagtttgcagcaccaacaactacatcccacattcaatgtgaagacaagaaccaactaacacaggatgaaaaaacattattcacgaaatcctatcgctaattaaatctccatccatgatgataaatttttgtatgactattgtcagcggaattcctgcatacaagctgaacattgtccttatccttctcacatttttatagttgggttcaaaaccaaagtcagtatgtgaccaaaactacactaaggaagcagtataaattagagaaaaatgtaattggcaaaaataaaagacatactaagatatatggtttgagttatgcagtgattttgtttgacaacagaggagctctaaaacattgaattaactaaagatttatcaacaaaggctgcattttgattggattctcggctaggctactccatcattgtccgtgagtacgtttcctgaagacccaaactactaaacggtgtatttgtacaaaaactttttatatagaagttccataaaaattcaaataaaacaaaaatatccacatttataatagtttctgaatgaatcacatgctaatgacccatcttatttcgcatgccggtataagcccaccaacaaaaaaaccgttccgaacgaagccaaccaattagaatttggttcatttccaaaatttcaaataaagagtttaaaaatatagatagctatgcatttacccaatttttcagccactgctaggcctgccttttcttctccccctttggggtgcataagtgcaggggatgccactctaacaagagacaaaaagaatgctctaccttggcctacccagccaagttggcttctccaaagcagcacctcctcctgctgctgacgctgcagcagcgccaacctctaggatttcaccaaaactcttttgctgaaaccatctgtgtgtgctactttcttcttccttttttttttctcttggtgtgctgttgtagttttgttggtcaattgcattctactttctctcttttcttttggtttcttgtggatgttttttccctttggaaaaagttttcgtactcctctgaa

SEQ ID NO: 9498 - DNA, 916 bp, Oryza sativa
acgtctatgcatcgcacgtacgtgcactgtcgttctgcagatatataggtacatccttcctcccaaaataaaacactaatatagaacatgatacattccagtataggaatctagatgaatacgttactttgcatatgaacatgaatatgtttatttaggatgaatatttttatgtcacttacatattagaattagggcccctttgaatcacatggatgaaaaaacagaggaataggaaaaacataggattctgacaggaatgtaagtgtaaaacaaaggattacaaaacacaggaataacataggaataaccgtttgattggaccataggaaaaacacaggaatttaaggagagataaagagagataaagactcagggcccattcatagaaattttagaggattttttcctatatagccctttgaatcaaaggaattgatcctatagaatcctatgaaattcctatggattgtcttttcccatgcaagttttggaggaaatttaacatgaggtagaacctcatggaaagaatcctttgagggcccctttgaatcgcaggattgagaaaacgtaggattttgataggaatgtaagtgtaaaacagatgattgcaaaatgcaggaaaaatataggaatgaccgtttgattgaaccataggaaaaacacaggaattggattagagagatagactcaaaagaaagttagcaaaaggtcgaagctcttgctaaatttcctccaaaatctctataggattgtccattccataggaatttcaaaggattggataggatgtaatcctttatttcaaagagcttcataggaaattttcctataggattgaaatcctctaagggcccctttgaatcgcagggtagaaaaaacggaggaataggaaaaacacaagaattgaagtgta

SEQ ID NO: 9499 - DNA, 1228 bp, Oryza sativa
aaaaggaggttcaccaaccaccacctactagaaaaatgcaaggggattattaacaacattaaaacaaatgagttaggaatatgcgaattgcgctcatctaaaccaatattctctttccatgaaccacccaaaatgcctctggaatcattcttttgattcattgttcttcgctgcaccgttctgttgtgactgctgcagttgatagaatggtatctgcgtagcctgctgctgctgcagttgaaacatctgattctgagcattgagttggatctgctgagctagactgctggacgagcaagaatcgccgagctcagcggtggcgagttttaggcgttggacttcggttgtcagggcctcattcagcgctgttgaacataagataatggcgaagcagtgaggaactgagcatcaaaaccagaactaacaagtgaacaattcctgaactctattcgtggcatactttcatggtgcagtgtttaacagtatattgcaataggatgaattcatcttggtaaaaatacagctactcataacattaatagatagattaacccttaaggatgaagtcatcatgtaaaaggcagtagacatcctagatcagtgtagattcttgaaacgaaagactccttgtgagagaaggaaatgtggcaatcacatggcaatatggcatccaaggagaaacatttgatacgtgaaagccctgaaaactagggtggcaatctggagaagtcaccgcagaatattgaatactccaaaacattcttctcctacacgggactgcaggctcctaacatgctagcaactaacggattcagacttcagagacgccatagggcatactatatattttatctttgattgggggaaaaggcacgcacaatagcaaatcttcgttcttggatgattgctaaggcatgtcctcctccctaccagtagtaggagtacatactaacgaccaccggcttcccgagagaaaaatatatgcataaagaaaagctaactaccaacctccaagcgcaaaaacacgagattatggcaacagttgacaagcactaggacaaacaagcatgtcaacgtcaataacttacacaagactgttcatcatagtgccgagcacatctaaagtatcttatgacgttggcgagcacaaacatgggaggagcgagtgatcgaggaggtttaggggaggcacgtaccgtcgcgcagctgcgcctgctgctccatggca

SEQ ID NO: 9500 - DNA, 1501 bp, Oryza sativa
tggttggtgcggtgcctctccacgaacatcttcgacgcccccgccaccgtcttcctccatgtctgagcatcgcgcagagtgaaaccaattcagcattggagagttggaaacgaggcattggagagttgagagcttagcttacccgctccaacgcggcgaggaggaggccgatcccggcggcgtcatcgaggcgcgcggccccgccccggtgggagtggctcgcggcggatcccttgcgggcggaggccgtggtggtcgtcggcagcagcagcccggccttccactcggtggacccgccgatgctccgcctccgcttgggcgccgcgagctccgcccccgactccaaatccctcgcggagagccccgacgccaccctcctggacgaccgcttccgccgcagcgcgaggctgcgccgcggcggcgtgatctgcttggcgtgcgcgtccgggtcggcgaacttgcgcaggagctcgtccgacgacgccctcgccacgtgctgcacggacaccgccccgccgccgccctgcgccgttgctgccattgcagagatcggaggtttgacacagtgaatccgttggtgaatgggaggagcgggagatgggggaggcgagggggatttaagcgcgggatttaaggggaagacgagacgaggcgaagaagaagaggaggttgatggggaatatagccgttggggagcgcgggtgaggatctcacgtgccgcgcgcgcgcgcgacgctggcgcggtcggtcgctgatctggtgcggcgcaggctggtcccgggagggagacgcctttctgactctgtggctcgtgtcggtcgtagtagtggtgctgtggtggtggggggggggggggggggatttattttctcccgtgagcaagaacgggcaggaaatctgacagggactatagaatgatgtggattcaggatttcaggccgttaggattcagatccatggtgattgatgatgaccgtagcaatggcgtagtaatgctgtactgatatgagcattaacgaaaagcagtttggtactacaccgggattgcgttgcaggagttgagttcaccttcatatgaggtcatagcatgacaggcatgatgatacagggggggcctcaacctcaacagtcaccactcatcacacgttcacagtcgcactgatgcctgggaggggagcagactgaactgaatgccaagacatcatggcatggcatatactcctattcagcagtcagagaacggtatgattgtactgtccatagcaaagcattataagatcacaatgcactgatacaacaagctcaaaaggcaacttgtatggagtttcagttcgattaggtgcgtgtacactgttagggggaatgcgaatgtttatcagagactgatgaatgaaacacacaagcctgcattttcaggagacccgtatgttaaattttttactataaattccactctcagggattcatacaaaagaacagaaccaaaccactgtttccacct

SEQ ID NO: 9501 - DNA, 1501 bp, Oryza sativa
ttgctttgtgcattgcaaattggctgttcattttaagtaatttgtcgatgaataatgtaatgcatcctccaaggtgtcgctcctaactgtgttgacatacaggcttcctgatccagctgcaagaaaatttctctgtttcgaggattcaataggcttgcagacggagcaccagaagccagattctactagcactggtgcaaaacagaacagctcaagtgatgataactcaagctcaacagatggcccacccgtcctaactattttggctggtatcattgtgttccttctagtcttgtgggttatcggatcgctcttcacctggattgctggtttggtctttggcgctgcaaaatcttagaagttcaaattttaggataattctgcacctttttagttgtacatacttcggtccaattgtatgccaatcttggataaattgcacttgatggtttcattcttaagtgttgaacaactgcttcatggtgttgtaccattgtttccagctgtgccttgggtattgccttttcatatgtcatttcgaggtggaaacagtggtttggttctgttcttttgtatgaatccctgagagtggaatttatagtaaaaaatttaacatacgggtctcctgaaaatgcaggcttgtgtgtttcattcatcagtctctgataaacattcgcattccccctaacagtgtacacgcacctaatcgaactgaaactccatacaagttgccttttgagcttgttgtatcagtgcattgtgatcttataatgctttgctatggacagtacaatcataccgttctctgactgctgaataggagtatatgccatgccatgatgtcttggcattcagttcagtctgctcccctcccaggcatcagtgcgactgtgaacgtgtgatgagtggtgactgttgaggttgaggccccccctgtatcatcatgcctgtcatgctatgacctcatatgaaggtgaactcaactcctgcaacgcaatcccggtgtagtaccaaactgcttttcgttaatgctcatatcagtacagcattactacgccattgctacggtcatcatcaatcaccatggatctgaatcctaacggcctgaaatcctgaatccacatcattctatagtccctgtcagatttcctgcccgttcttgctcacgggagaaaataaatccccccccccccccccccaccaccacagcaccactactacgaccgacacgagccacagagtcagaaaggcgtctccctcccgggaccagcctgcgccgcaccagatcagcgaccgaccgcgccagcgtcgcgcgcgcgcgcggcacgtgagatcctcacccgcgctccccaacggctatattccccatcaacctcctcttcttcttcgcctcgtctcgtcttccccttaaatcccgcgcttaaatccccctcgcctcccccatctcccgctcctcccattcaccaacggattcactgtgtcaaacctccgatctctgcaa

SEQ ID NO: 9502 - DNA, 1501 bp, Oryza sativa
tgtgttttgcaatcctctgttttacacttcaattcctgtcagaatcctgtgtttttcctattcctccgttttttcatccatgtgattcaaaggggccctaattctaatatgtaagtgacataaaaatattcatcctaaataaacatattcatgttcatatgcaaagtaacgtattcatctagattcctatactggaatgtatcatgttctatattagtgttttattttgggaggaaggatgtacctatatatctgcagaacgacagtgcacgtacgtgcgatgcatagacgtacctcagtaggagtacgtactaggagtagattggaaaagaagcgaagcaagacgtggcttgcttggagatgacgcggatctctccgccttttgatgagcgcgcctccgccgccgcaaccgccggactcgcgcacggccgcacccactagtccacgccttcttccacttccgtcttcccagtggcacgtccccgtaataatccccagtttccggcccaactacgtcaaaaacagtttccagcttctcctcttccactgtctctccttcccaaatcctcctccctccctccttcccactcaaaaaaaaaaaaaaaaacccgcatcctctcctcctctccaactccaatccccaccacctcgcgtcacgccgatcacctcctcctccccttccggtggatccccgcggcggtttcgacaagtcccgcgtcgccgtccggtgtggagcgccgtcgcggccggtggcctgtaaggtgcggtgttgttgctggtgagaggttactgggttttgccgcgagcgaggtgcgtagccgctcgcctgcgtttcgcgcgctgggtcttatcactttggaggcttctagaaggttctagccttctccgagttatcgcgccgattgctcgcccattgtccttttgggcgaggaactaatgaaatcctccttttgatcaccttcttacagaaggtttctggagttttctggaaactgcgctgtgatgcccccgcgactgcgagaaagtgtctccaagtttgtgacacaggcgtgattctgcttgtaggctggggttttgcattttggagccgcggtggtctcggcggaaggtaatcgtctccacctctgcttccacctcgttgttctagaaggttctagtagcatagcacttcatgttttgacttgtgtggggacgaacgctgtttaaaagtatcttactgtctcttgtgcggttaggttcctaagctctgcatgttcgtattctgaactttctgaaattttggaaattccaggcatgggctaggcccccagcacggtttccaggtgattgattggtggatagaattgttgcctgagagcagcaaggtagtgctaacatctctgccttctagaagctcctaccactttctagattcgtctcgatactcaacttaccttcagttcgtgtgcgcaggtttgggcgtggtgactggaagcaatcacgatgacgtcattgtcacgaa

SEQ ID NO: 9503 - DNA, 1501 bp, Oryza sativa
gtgttctctctcatcatgtaacccttaaaaaaagacttgctggtttagttcccaactttttcttcaaacttccaacttttctatcacattaaaatttttctacacacaaattttcaacttttccgtcatatcgtttcaatttcaattaaactttcaattttaacgtgaactaaacacttctttctcggtgaagccctctaggccatatggcaaactgggccacccgacacgacccgacccaggcccaagaagagtcgggccgtgccagcccgacatacacgccgaccggggcaggccgccaatgtactgcaccaatagcttaggcacggcctaataagactcgggccggaccgaaggcacgaaagccaccatgctcctccttggaaaaagtctattttcctccctcatctatttgggccgtctcctaaatggctggagtaagtctattttgaatcactcgtctctttgggccatgccttatagagctagaataagcctattttggctccctcgtctgttttgcctccttgatcgttggaccaagccataccgagccggcctgcccatcgtgtcgaggtaaaggccaaggcacgggcctgacaccagtcggaccatgtcatgcttgggctaggccaaaaccccatgacatggaccgggccgtcagccctgggccttttagccaactaggccctgtgccgaagtccaaacaaaaactacacgaccatatgaaatttccatgaattttttttatttataattttttttattaaaagttttacaaaaataatttttcattttgaaaattgacggaagtagtcccctaccgccctctgggaaaaatcgccctctcagagggcggcgaaaatgacgtggcagacggccgttcgctctcgggcgacggccgtcaacgaaatttgcaggcggcccccttaccgccctccgctagggcgattttgtactgtggggggggccgcctgcaaatgggcggcgagggggggcatggaattttgcaggcggcccccttgccgccctgggggagggcgatttttgcctcccccctataaagcccagtccctcctctgtgaaatttcattatattcactaaaaatccaaaaaaaacgaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacaacacatatgtgtagatccagagcatagaatataatagtatgaattgagacatagatagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 9504 - DNA, 1501 bp, Oryza sativa
tgttccggaattgccgttgtaggtgctggatgtgatattatgataatcaaatactacattttacaaaatttagttttttattggaccatttatcttaagaggttagagttgattcaaaaattccaataaaattctctgagattatagaaaaattgccacaaaaggttttttttcctcttagagaaaagtcaactaatctatcatgattttgtcaggttcaactcaaaacagtactgaaattcaaagaatttacattttacaagactgttcaggattggctagtgaagcataaatcaagttcgccccatttagatttgcttgaccgcaatcatacaatttcatatgcaatttaggtgacatggtaaattattgtttgcgttattaattaatttaccattctatcttctcctttagaaattatgacagactaccattcaaacagataaaatgtgcaatcaactgttaacatggtttatgtgggtaaaggctttatgtagaattttagtcacttgggatattactcctcagcaacatatattgtctctcttttttccaacaataaacaagaaatgttcacaaatgctcatttctggtggcattgcaacatggaaaggtctggtgttttaacattaaaatctgctgcatctcttggggattggaccaatgtgcatgacttgtacatagtgagccaacaaagcatacaaaaacaattatataaagggtagaaagggaggtggggaggtgaggagaacgtggatgctgtttctagtgtttcccaatccttgtccaaactttttaacttatgaccaaagctccaatctctagtcttggctatagagctcaccactcttaaacaaatgcagtgcccaagaagccctttgattccttgtttggaggcttatgtgtgggggagaggatggcctttcttgggcaacacatgcatacaatataaatcaccagtctccactaacaaattactgccttgggctttgccccatcgtgtttgctacaggctagctgttgttttacttgagttttatatctcaaatggtaaactacaaaaactcaaacctgttatgcattctgtgattaaacttttttggaacctacaatctgttttactcttcaacagttcttgttttgaatacaaatttgaatgctatgcaatggagataatacaggtacaaatacaatgtagatttgaactttttctttatggggtatatactgtgtacttgtgctgtgagacctttctaacatggtatatccaacctttttggcctaagttactactcctttgcactaaatagataaattgtctctgttttggtgtttatacatgcaagatttcctgatttcaaaagataactactactgcttaaatctaacagctgtgatttggcttgacttctagccttccaggtgtggatttgatgaggactgcaatggtctgtcccaggtgtgcttctgtcaaggttcgcaaaagaataactttgcatca

SEQ ID NO: 9505 - DNA, 1501 bp, Oryza sativa
taagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgacgagtacaccatttcctgtcccacggcattaaccgagcgagacacaggcgttgaaaaagcgttgaaaaaaggtaaaggaggcatcgtttttttatatacgctttcccaagctccgcccggccaccatatcctctgcccactctgcctgcccaaacctaccacttcacactgccgccacagcccgcagccacagcgatcgagcccctctccctccgcgagccgtgtgcagcgggcgacgggataactaacaaaaatggcggccgtggtggcggcggtggaggcgggggtggtcgcggtggcgcgcgggcggggcagcggcaggctgctccggggaatctactggaggctccgagccgggatccggcggatgcagtcggagcgcgggaggtggcgcggcggcaggcgtgaccacgcccggttcagcttccactacgacgcgctcagctacgccctcaacttcgacgacggccgcgccgccgcggacttcgtcctagtatgagtccgacgcgacatggccggcgtttagccgcgcagtatgcaggtggtgtgtgtgtttgtctgcgtgttagtgcgtttctgcttagaggcccgtgtaattaacggaagctggcggtgtgtttgggtggttagtgtggccgcgtactctgctcttcttggtt

SEQ ID NO: 9506 - DNA, 1226 bp, Oryza sativa
  unsure (1)..(1226): unsure at all n locations
gacgatcaaggtcagttgaaatcgagccattttcatgctcccgtgcgcgttcctggttctttatttttgtctcttggactcttggtggatgaggtaactcgaagttgtttcggacgcggcaatcatcatgtgtaacagtgtaagtatgttgaaattctgtaaccacccagttgagagagaaattggcgagggatgaaatattaaattttgtaatatcccagcggggatagctcagttgggagagcgtcagactgaagatctgaaggtcgcgtgttcgatccacgctcaccgcatgttttcatttttaatgtatacgagttatttttttttttgctcatcgcatgttttcatttttactatatatacgagttatttttctcctcactagcatattttcatttttaatatactagttatttttctccttactcgcatattttcatttttaatatactacaaaaatgcatgatttgacaaaaaaaaactatgtcaatttaaatgataaaaaacaaaataaaggtcaaaaatcatatatagcattgaacctggttacacgagttatttttctccttactcgcatattttcatttttaataaactagaatttgattaaaaaaacaatgtcaatttaaacgacaaaattaataacaaaaaaagtaaaaaaaaacatatatagcatttaacctgattacacacgtgacgccgagtagagatgcatggaatggtgttggttgtctgggttgggctgggttgggatagggaggggttgcgttggtataatcggatagaagtgtatgatactccctccgtcccataatataaaagattttgagtttttgcttgtaacatttgacccctcgtcttattcaaaatattttaaaattattatttattttatttgtgacttactttattatctatggtactttaagcacaacttttcgttttttatatttgcaaaaaaaatttaaataagangagtggtcaaacgttgcaagcaaaaactcaaaattccttatattatgggacggagggagtagttattagtcatgttgaattggatacagacaacatataacaaacttaaacataaataacgtatcaaaattctggttgaaacatcttcaatttttataatagtgatacgagttattttttttctcattttattatttttacaattttagtatatgagagatttcttggttgctttccttctcttcagg

SEQ ID NO: 9507 - DNA, 1501 bp, Oryza sativa
tcacccagctagtttagaaatatttgaatgatatacaaacaccaagagacatctcttgagaatttaaggccgttctatatgtactccaaccgcaaacttcaatttactcgtttttcgttagcacgtttcctagactgctaaacgttttctgttgcaaaagaaaaaatatgtagaagttgttaaaaaatcaaaatttcaaatttacaataattaatatttaattaattatgtgctaatgagttttctcttttcgttttgtgtgccctgcaaatattcttggtgaaacaaacgaagccaaatccgttccgataaccccaaaactcgcactttcgttgcacattaactaaaacacaatttttaagtcacatgccgttgccgttgccgttgccgggccgcttctccggcgttttcctcagttcaccacatgccacctcctgcagctggtcctatacccttactgcaggtctgcagctgcagctccgccatcattcttcttcttcttcttcttccttctttttcttcttcttccagcagctcatgccggcatcagcagcgtccccatcaccaccaagaacagcagcatgctagtcttcgtgtccagctccggcggcacccatgggcagggcaaggaggcggcgagtgcgcaggagggcagagccggcgaagttgctggcagcggcgagagcgagacagaggcatgccgcgccgaccaaggcccgctcggcggctgcaagtagaggccgaggcggcgggataggaggaggagggagaccgcgacggcggcggcatctgttgagcggttaaggtggtggcatgactgtcacacacactccaagccgagacgtgcgggacggattcaacatcaaataactttgatttgatctaacctcttaaagacgttataactggaaccaaatttcttatagtcaaataacatacttagggcatatttagcagagcttgaactcataaatttaacaccatgagttgagtctggagtagagttatggagctgcctaaacctagatccacctcgttagtttattttgtgagagtgctccacccaactacactcccattctaggtggagctgaaattatttagctagactacagctctagtagagctgtagaggtagagttagagctgtgccaaactgactcttcgtacttacggtgacaccatgaaaacgagagtgaaaacactgacatgtatataatacatacggtgtgtccactgtccactccatggtgtattactgcttctctgatcgagacactgatgcacttcagcacttcgcaatcgatgactagatcaaacacgtacgatcaccacatgtaaatcggtcaagtccaacactgtgaatacacacgtacggacgaacaaaaatccattgaccacttcctctctctcttcgtcaacaccactcactagctactgtccggtcaaacaccacacacctgaccgtttcgccgccgcggccacgcccacacgcggcgtc

SEQ ID NO: 9508 - DNA, 1501 bp, Oryza sativa
agatgtttctgcctccaacttggggggtatatatattaatctgttttcagaagacccttggagaggtttctgatgagttgtctctgaatgagctttgtgtactcttcagtactagtgctttgtactctcgagactggactggattaagacgcaaagttgcagagaacattcgccctgctacatttttatagacatgtcagttaagtgtgtcaacagtttgtgcaacatcaggtgccaggaccatgttgtgacctgtccataatgtatatatactttttacgattacacggaagagacatacacgagcacctcactacgcacccgccatacttttgtgcaaccttgtttctagttttgttgatgatacctctcaaatactccctccctgttttaggttataattcgttttgactttggttaaagttaaactactttaagtttgactaagtttatatacaaatataataatatttacattatcaaattagttttattaaatcaataattaaatatatttttataataaatttatcttggtcgaaaatgttactatatattatataaacttggtgaaatttaaagcggtttgactttgaccataatcaaaaagacttataacctgaaacggagggagtacatgcataatttgcggtcaaagatgacacaaacaacatgttatgaattgattgggttagggagttttcttctggtcgtgtaagaatgtcattaattttagaatatgtatactattaacataagttaattttgactacgattattgtttaggaaagtaagctttattagtcatatgaaaatgacatatccaagttttttataagaaaaataaaatgatgatggtaatggcatgacacttaggttgctatttctattttcatatttaatcttatgtaaaaacgtatatataaaggttgtatgtcgatctcattaactataaaaaatattgttaaatttctttagatctgattaagtttgaatgaaaatttagctatatctacaaacactgagttagcctcatgaaacataacattgatatatttcgataatatgtttgttttatattaaaaatattagtatagcttctaataaatttagttaaactttaaaatatttgactagaaaaaaaaaaggtaagaacaacttatgaattacgatatggaacggagggagtaagtagaaatgtaggatcaacttacaaattgccaactcatgaaagtgatcgatgatgggcttatcatgtcgaggaaaacatggagcaaggcacgctttccgatgccatgcatgcagagcccgcaacgtctccaccaagctttgtcgatcacctccatgctttcctataaaattccatggctgctaaaaacctaattaagccctaccacctacatccacagtacagacaggcagagctaagctaagctaagtacgtcagcaatggcggacgcggcggagcagcatcaccggcaggaagagactgcggcggcga

SEQ ID NO: 9509 - DNA, 1501 bp, Oryza sativa
atactcttctttcaatactcctagtttttaattacgaccttcaattatttctaaattgtattccaataggtgctctagagtctagactcttctctcaatctttttttatcttgaattttcgttcttttttaattgtatttctatatgaactctaagatatactattattttttttaatttttgactttcagttagttctaaatttgtatatggacttttgactcttcttttagtattcttttcttaaaaaaattgaattccacgaaattgtattcctatttagactctagactcttcttctaatattttttatctttaacttcgaattttagttatttctttattgtatttctatatggactctaatctctacttttaattttctaatttttttatttattctgattttttattatttctagtttttatgcctatatggaccctagtctcttctgccaatcttgtttatttttagttttgattttttgtaattctaaattgtatttctatatggactataaagtctacttttaattttcttatttttttagttctaactctgttttagttatttctttattgtattccatatggactttaactctatatttaactttttttcattccaaatttcaattatctctaaattgtataactatatggactctagtcccctcttccaatatcccttattttttaatcctgaatttcagctatttttcaaattgtatttatagatagactatatttttttcttttctccgagtaatatgagaatttataggctgtgagagcgaacgtggaggctcctgtatttatatgtggactcttttttagttttatttagttttacttatgaatttcacatagtttgaattgtattttctacttttcacttgaactctcattttttttcttttctaaaaattgtattcttaatgactctctcaattactattttttttaaaaaaatccattttctataatattttttgaatcttaattataggtatttataaattatatttatacctatattattttgagacaaattatagaggctagaagttgatatattttgggacggaaagaatattatttagttctaatccaacttcaaactatttttatataatactcatacatgaacaatttttttcataatatttattttctctctccaaattttaggtacttattctcttaatattatctattttttgcctaaattgtatttctaaaggtacttttatctcaatattaattatttttaaattttaatccgagtttcggatatttctaaattgtacatctacgtagactcttctctaatttttatttatttttttattctgaattttagatgtattgaattgttgaccacgtggttctgtttggactctttttttctctaattattatggattatattatgggagtttctaggaagtgggagctaacatggtggccctttttcctattacattaagataatatagat

SEQ ID NO: 9510 - DNA, 1501 bp, Oryza sativa
tgagagttcaagtgaaaagtagaaaatacaattcaaactatgtgaaattcataagtaaaactaaataaaactaaaaaagagtccacatataaatacaggagcctccacgttcgctctcacagcctataaattctcatattactcggagaaaagaaaaaaatatagtctatctataaatacaatttgaaaaatagctgaaattcaggattaaaaaataagggatattggaagaggggactagagtccatatagttatacaatttagagataattgaaatttggaatgaaaaaaagttaaatatagagttaaagtccatatggaatacaataaagaaataactaaaacagagttagaactaaaaaaataagaaaattaaaagtagactttatagtccatatagaaatacaatttagaattacaaaaaatcaaaactaaaaataaacaagattggcagaagagactagggtccatataggcataaaaactagaaataataaaaaatcagaataaataaaaaaattagaaaattaaaagtagagattagagtccatatagaaatacaataaagaaataactaaaattcgaagttaaagataaaaaatattagaagaagagtctagagtctaaataggaatacaatttcgtggaattcaatttttttaagaaaagaatactaaaagaagagtcaaaagtccatatacaaatttagaactaactgaaagtcaaaaattaaaaaaaataatagtatatcttagagttcatatagaaatacaattaaaaaagaacgaaaattcaagataaaaaaagattgagagaagagtctagactctagagcacctattggaatacaatttagaaataattgaaggtcgtaattaaaaactaggagtattgaaagaagagtatagtgtccatacatgaatacaatttagaaataaccgaaatttgaaatttaaaaatgaggaatatggaaagaatagtttagaatcaatataaaaataattgtaattcgggatttgaaaataaagaatatggaaataacataactttcaaattaaaaaaaaggaatataggagaactttgaaactgaaaaaaaaaagaaatattggaagaggagtctagactactctagagtctatataggaatataatttagaaatactccctccaacctccatcccataatataaggcgtccacgcattttaacattccaccttcaaaacattttgaccaatatttagtacaatataaattgaattttacttgctaaaaattatatcattggattaacatttggatttactttcaaatggttataattttgttactacagaccttatagtatatgagaaattataagataaaaaatagttttagagaccgtgtcaagtttgatcatgccttatattatggtatagagggagtaactaaaataaggaattaaaaaataattataactatcacatatatacaatacaacatgaatactacacattgg

SEQ ID NO: 9511 - DNA, 1501 bp, Oryza sativa
tgtagactgagaagcggcaagggcacagcaatggtgaagatatatatagaagaccatgtgcgaaataagaacatttcggtgcagtaccgccaatcctatgtaagttataacccactgaatcctaaacctcaacatgcaaatataccacattatcatccactaataattattacatttaaacatcatgcaagtaagttatattatctataatattataatttattaaattttagagttttaaaatgtaagcatgttaagtcataatcccacataattcacatgatattttcaatatatttctttatcattttttataatatcatatatatgttatttccctcttctctcattaaatcacatcaatagattgtttttagtattagatgattaatctatggtccaaactatctcgagattagctcactcattttcttttttcataaagcaacatcaccttactattatatttgaatcatcattctatatataatttaaatttaaattatcataaatcatatcaacttacataagtttacgttgtctagttatcttatagattatttttacttattgttatcataataaacttccgccgcagcacgtagggtttcacctagttagtacaagaagcaagactattttaccaaccaaaaaacagaaggggatcagggcctttggccgcgttcttttcagtggttgggtttggatgattagctgcacgtaaaacgagaaacgcgatcagcatataattagttagtaagtattaattattaaaaatttgaaaaataaatttatttgattttttaagcatcttatatatagaaaattttcgcacaaaatatactgtttagtagtttgaaaagcatgctaacggaaaacgaggaatatatgaactgcattagagaaagtttaatagtataacccaactactaacttcaaatcatatatagccaatctaatagctcattcatacaactaggaaggtagctcgcgtattcgtgtgggcatgtaccgtatgtaagacgaatttgagaaacttatagggacaatataccagcaaaataatatctgcaatgtttcaaaattgtgattgtttttcatgaattttcttcattagcatcacaaaacgaatttaattgttatttgtaaaattatctattgaagattggggctggtaacttatggtacctaagaggctaagacatactccctctctgtcccataaaaaatcatcttagattcatagttagaagttgacttttttttgacggaaggagtatgactcttgaagttccatatggaaagagaaaaaacttaagttataaaagatattacatatacaaccatatataattaatggttgtactgatttatgtagaaaaattgatactataacaatattattggatggcagacatcgattggtcatagctatggataatttctcataggaaattatgaatatgtgtattgtacagggatacaaattagaaaaaaatag

SEQ ID NO: 9512 - DNA, 1501 bp, Oryza sativa
taaccaatcgcaccacacctcaggtttcaccctcactcctcgcaaggcagcgggcagtcccctctcgtgccacggtgaatccggaagccgatcaaccggacaccccggccgacccaactccatcacgcccacccttgcctgggtacgtcggctagaggaaagctacactacaagcccagccgttgcccacactggcttgtggtaagaacgataaattcttccagggcatcccgcgaaccggtccttaatcgccatgggcacgactagcaaaaccatgcacccacagcccaccatgtagtgtattttaataaactaacaccattgcggtggcactaatccaaaactatgccaataatcaaagtctatgcattaatgtgattccccttttgtgtactagttgaactaagcatagctaaacatttcttaaaccaacatctaatcatattgatacccaagttatcaattgcataaggtaaacaatatatggctgagtagtaggacccatcccacatgatattgtaaaacaatgcaacatttaatagaaatgcgggacatttgtaaattgggtacaatatgatcaattgtgatgcatgacttgccttgctctcgcactgatgaaaccacagcaacgtcttcgagaaaccgcagatcgacgaaacggccgaaatctacgcgacaaacaaagcacacaagcaaaacatgctataagtctactgaaacaggaaacaaaaccatttttaatggattctatacatttttatgaatttactgagacttgaatggacttaaacggagctcggatgaattagatatgaattttagaagattcactgtgtttttactataaacagataaatccttaattgatttattgcgcaatatcttatcccagggctgacgtcatcaaggagggggcggcgccgacatgcccgacccacgggtcagcggctcaagggggaggtccacggtggaccggttccacggaccgggaaggagacggcgcaccacgtggtgcacacgtggcgccgacgtgccgcacacgtggcggcactggcagccacgcgggcggcgggattggacggccccgatctacctacgggcccggctcaagccggcccgacgcccatggcgcgcggcggcgcggctcgacgcagcggcggcgaccggccgacggcggagggcggcagcgtcgcggcgacgcggacggcgctagcggcggctaagcggctaggcggcggcgcaaggctaagcggcacgggagagagaggaaggggaggaggggcctcaccgacgacgattgacgacggcgagcgacggagggcgacggcgacggcgggacgagctccgggaccacctagcgaacacaaagaaaggggttagagagagagaggaagatggaagagggtgaggaagccgaccgaaagcggcggccatggcggtgctcaccggcgcacggtgcggagtgggttccgacggcggaatccgacgggagaggggtgga

SEQ ID NO: 9513 - DNA, 1501 bp, Oryza sativa
ccgctttcaccatggggcttcgccccgatgaacttaacaccttgagcctgaatcctgactggtcgcacggtttcggcaggtctggtcgaagggtctcatgacatactgccaacaagcccctcacgggcaagggtgagataggagcttcggccgagaccatgcaaactatgtggtatggtatgagacgcccccttttgaccgatgctcctaccgaaacctgtcttggaatcctgtaaaggatgtgtgcactgcgcatacattattcctgtggttagtaatgtgttacagctttcacactctgcgaatcggcgaagttggtattattctttcgctgggccgggttgaacagtgatgggctttccttcgtgggcttgtcactgtgcggcctggtcaatgggaatttaccatttcgcctacccttatgacacgcggcggctcgtggttgggtggaaggtgaactgttgcctgggtgggctatatatatctccccttcccctttttcaccgccgctcccccgtcattttcaccgcaagatcactctctttctctctcttttcttcacagcgcccttagagtcgctaggtcgttcgcccgttcaccctttttgccacagcgcatgcttctcgccatggctccccgcaaaccgaatccggcctccgcgacgggccgcgatcccggccagatcgacaatgacaacaccgcctttttaggggtttcacttgtggataaggacgagttggcaaagttggtcagctctggcgcggtggtggaggggcaagctttcgccccggggaaggccgtggtgccgaagcccggcgacaaccggacggttgtattcgccatgttcttcaaggcagggcttcggtttccgtgcaacgtactgttgcctgagatccttcgccttttccaggtggagcttgtcacaccccgaagttctcctcccaagcctaaaatttaatttataaatgaccccaagaaaatacaggtgcaaagcaagagtaaacccttttaaatcaatgcaaataataatcggaattggcatgtggaatttttcttgagttctacatgccgaaattcactaacaggatttttagtggaattttcagagctctagaaataattttaaccaattaaaattgagcatgcaatattttaattccagggaaaatcctttttcctttttcttttttctttttcctccctttttcctccttttttcgaatgggccgctggcccattctctcctttcctcccaggccggccgcaggccgaggcccagccaggccgccccgccgccctcctctcctggggtcaccgacaggtggggcccacctgtcgggtccttcccccacctcccgccgctcccgccgcgccgccgcgcccgcaaccgtcgccgcgcccacgtctccgcctccttcgggccacgtcgaccacgcccgcgcgtgcgccgcgttccccgcgcccactcccctctctctcccgcccgcgcccgcgcccgaga

SEQ ID NO: 9514 - DNA, 1501 bp, Oryza sativa
ctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacagcagaggcaccttggaacagaaatggagaaacaatctgtacaaagcaattcccttggaaaagacaggtactacaacagatattggttttttaggcatgaaggacgactttttgtcgaaagtgcagattccaaagaatggggttactacagcactaaggaagaggtgatcactttgcaaactttgggaatccctatgttttattttctggctaacagttctgtttcaatttgtaatccacagcttgatgcgcttattggatcgttaaatgttaaaggcataagggagagagcactgaaacggcagcttgataagttctataatacgataaggtactcaattttcattcaaagaaaaaaatataagataattcactcattgctgtagttgggtactttttacatgtttgatggttgcttctgttaatttttggaagtgacagattagctggaaagaagttaatcatcccatgtcaattttttgaaggcctacatctaatttttttaaaaaacaaaatgttatttaatgtagataatggtccagaatggtctttactggtggaacattcagttcaaggcctaaataacacaccgtagcctccatttttcactgaatggatgcgctatacttgctagacatgatcgaagctcctaaaaatagatcttgaaagattaatcattgagtgtaggttttttgagacctgtttgccttacagttgcagtctttatttgtacaagtaaaatgttctttgtgtgtttctcaaacatgaaggaaaccttaagcatgggcaccatatgctctcatgttacttttcagcctgtgggcattggacacttatggtaaactctttgctctgtttgtttagcaattgacctttgtgttggccgatgtagcaatgctctggaaaaa

SEQ ID NO: 9515 - DNA, 1501 bp, Oryza sativa
gtgccacgtttcccctggcccctcctgcatagtggggaaacgcgtgtccccaactagcagcagcagcaaacgcaatcacctgagaatataccgcacctcctcactgacccgtggggccatcgtagatctggccccacgtgtcactgaccagcaggctacgtggaggaggcacacgtggacgttatccgcttccggtttccgacgccaggcgtgagcctcgctgacgtgcccgtcccagcagcagctcaggcagatgcactgcaaggcaaatgttggagtacgaagtactatccattgcacttttttttagaggagggtattttttatcggtcgctatatcaaaccgatatataccgcctttatccattgcacttttatctaacacaatttaaccatttaaaaaaattatcaatggtcaaagtcgaagcaacgtcgggccaacagtgagtcagccacaactgacaagtgtattatgtagctaattctcaaattttaaatttgattttaagtgtaaaaataatccttcatcaataactttgttccattattttttactagtattttcctaactttgttccattattttttactagtattttcctatgattaataggaaaaaagtaaagatgcacgtaaatttttctcaaatatcaaaattcaaatcaagattaaattacaattagaaaatgagcaaagtacacaggtgcctatatctaaacttgtataagtgtgtcatctagatcgctaaattcttaaaatgtaatatgcaagtctccaaactttgtctaatgagtgtcatggagatcaaaatgctgtctaacccgctctgtatatgccacggtggcgcatacgtgttagccagacctctatattagtcacatagaaaaaataaaaaaaaacatcttctctatgcacgtttttttccatagcctcgtagacctccattattatccaccacgaggataacaaagtgatcaactcattggccacaggcaaaagcagcctaacctttgcaaaaccggattcggacaccaaagcgaagccgcctacactacaggggcaattccgtccaatccaaaacccgatccacaaacgagaaaaccgcgcggggccccaccgccccgaaccgtctcgaacccccccacccccgccctaaggcctaacgccgtcagtgacacaccccctactcaaattaccgaaacacccctccatccccgccttgccgtccgatccgcctcgagattcgcaaaccgcttcccaatactccctccacccgccgttatatattgacgcctcacgcgaacggcgggaaagcgtaacagaacaaactaacttcttctcgagagaggaaaaaaaaaaaagaaaaaccaagaagaagtcgaggagaagagaggaagagtaaagcagcgcgaggaaggaaggcgagtctgctttgcgggattcgcccgtagtagagtttgattccgccgggttggtttggtggtttgatcgggggaggagg

SEQ ID NO: 9516 - DNA, 1394 bp, Oryza sativa
ctgctacgttgagccacgctttcgaccgccagcacccggcctgtcgttgcttgtaccgaacgggagctagctcttcagatcgatcgtggataacggtagctatagctgccgtttctctgctcagatcgaaacgaaaaaggaagcagaatgtgtaggttttcttcggttgtcaaatgccgatgtgtgcagacgtacagtacgtggtcgtcatcatttgatctggccgtggagtttgtgtgccattgcaattgcaattgggtgtggctaatgggcgatcgatctgagcgaaacccatgccccctgtacacacctctcctcccctccccttcttctctttctactacactaaaaatttttaaaaaataaaaaaacaaagttgaaaaaatttatgtatagaaatacttatataaaaaaattagaattcaaatttaaatttgaaacggatgtgtaaacttttgacttataaattttgggtctataaactaatatttgaattcaaattcaaatttgaatcgggtatgtaaacttttgacttataaaatttgggtctataaattttaggtgtataaactttagatgcatagaaatactatatatataaaatatttgaattcaaattcaaatttgaatcgtttataattcaaattcaaatttgaatcgggtatataaacttttgacttataaactttgggtctataaattttaggtgtataaactttagatgtatagaaatactataaataaaatatttgaattcaaattcaaatttgaattgggtatcaaattcaaatttgaatcgggtatataaacttttgacttataaactttggatttataaactttagatgtatagaaacactatatataaaaaatatttgaattcaaattcaaatttgaatcgtatataaacttttgatttataaactttaggtctgtaaactttagatgtgtaaacttcaggtgtataaactttaggtgtataaatttactaaaataggaaagtaatatggtgtaaaaaaaaaacacgtggaggagggggggggggaaaccgatcgctcctggcgatcaatcgccaactggactctaggagtttcgattgcaattggtcttgcaggaagacgagacatctctcgtttctgaatgtggaattttttttatttttaattttttttattaaaagttttacaaaaataattttccattttgaaaattgacggaagtagtcgcctaccgccctctgggaaggcgatttttaaaaatcgccctcccagagggcggccaaaatgacgtggcagacggccgttcgctctcgggcgacggccgtcaacgaaatttgcaggcggcccccttgccgccctccgcgagggcgattttgtactgtgcggggggccgcc

SEQ ID NO: 9517 - DNA, 1501 bp, Oryza sativa
ccaaggcattggcaaaatttgctacagtacatcgaaatattacggtctttgctgtgagacatccgaagatcgtgtatttgctcgtggacaatgtaaaaaaagtggtaattagctgctggaccctcctcccattattttattatttccaatcaaaattgagagagaaagagttgtgtaattacaaaaatacccctatacagtgttcttcctctcacttcttttcttttccccttcttcttcttcttcttcttcttcgtggagcagagagcgacggcggccggcccgagccgggacggctcggccacgacggggcggcgccgccggcgacgccctccgcgtcggcgcggtgcgcggcggcggtggcgggctcgacttcttcgcgtcgcgctcccacgccgcccgccttgtcgacctcatcacctcaccgtggcccgcccacgtcgtcgcgtccaagcacgccgcctcctcgttgcgtgctctgcggcgagctgcccgaacagcacgtcatcggcatcatcgaggaagccgcgcaccgcgtcaccatctttgcttcgtcgccggctttgtgaagggaggctccactctcgtcatgcggcgcgacgagtggagccgatatggggtcgcaggaagcagccatcgagtcgagcggtcgggagggaacaaagctcactagcttgagcggccacatgccgcgtgtctttcttctcctctcttttcttctcccgcgggtgctgctccgccacgcgtgcgttgtcgaggtgaatgacgaggttgtgcgcgtcaacgggccacggccggagccgaggagcacgccactgttcccgaccacggtgcaggtcaggtaatggtgcccgaggaggcccgtgaggtccctcatcacgccggccacattcctcccgcggcagcggcgagcggtgggcggcgaggaacgacccaagcgacgtgcgaaacgaggcgaggagcttcccgtcggggggcagcacatccaccgggacgcggtggcctgcgaaggtagcaggccagcagcacgcacgcaggaggaagaaccgaagaagatgaacatagaaatagagaaagagagattgacaagtgggccatgggcaaacttgtctttaaccaatgtttctttctccattaccaccgaaaataataaaataatgaggtgggtgttcagcaactaattaccatatttttgcagtgtccacaagcaaatacatattttttgggtgtctcactttgagtgtcctgtagcaaatttggcccaaggcaaaagacaatgacccccgtactccagtttcgtgacctcttacatttaaagaaaaattacaaactttcatgacgatttataaaatttaagaccaaactcaatcaatacatggatggaagttagggtattgtcctctattcagggcccttttaaatcgtaggaatgaaaaaaaatagatgaatagaaaaacacaatattcgagcagaaatgtgaagtgtaaaatagaggattgta

SEQ ID NO: 9518 - DNA, 1501 bp, Oryza sativa
ttttagacgcaggtgcgtaatagtgaatactccctccgtcccataaaaaaccaacctagtatcagatgtgacacatactagtactatgaatctagatatacatatgtccagattcgtaatactagaatatgtcatatccggtcatagattcgttttttatgggacgaagggagtagtattttttcaatcttggtttgaattaccgacttgagtgcgcagtgccgttcaagtgcgcaacgcacgggaagtccgcaagtgcgtcggaacccgggtttcccttaccgtcggtaaccgtgcggttaccgggcttaccgcgggggtacggtaatataaataccgcagtaacctccttaaattcaaataaattttaaaaataatttaattttttgataaattttgcacggtttttcgcggtcaccgcgataaccgtgcttatcactggggcgcggtaaccccggccccgacggtttgggaaaccctggtcggaacacactattgcatcttcgtgccttcgggcttcatcggttcatccatggtccaactgggttcatccatggtccaactgaatcagcaacagccaacatgcaacagattacacatggaatcatagagtaaaggcagcaatcaggcatcagcagaagcagaagtgcagaacgacgggcgtcgccgtcggtcgacggcaacagcaagagaaacctgcgcggctcggacgaagtaattaatttgtttcgtttgatattatggaacggatgaagtaattgtatgcatgcatacatacaattaattaggacctcttctacattaaattagtacttttttaaatcctccatccttaagatgtctaattctattgaatgcatgtattatactctctccattccaaaatataagacacaaccaccctatatccaaagaccaaaaaacaattattatcacctctttgtttcaataatcccaactaatacaatacatgcacccagtagaattaagcatcttgatttaaaaaataataatctaggagagagaatttgcaattaattatcatgcatgcatgcacgccttatattatgaaacatctttaaaaagtagttgcgccctatattttagaacggatggagtatttattagggtgatctaaactaggagatgataataattgtttcttggtttttaggttaagggtggtagtgacttatatttttggaacggagggagtagcaaccggtactcacgaacatgcggactcgcgaagatataggaaaccaacaggtttgctagtggtagttggaaattaacgaagatcggaagatactatgatcatatgatcatatgcaacagtccggtccggttttgaagcctaatccagtacgtttcgctaccgaagctaaacaagatggaacagctagcgcgccgcgtaatactcagatccgatcgatcaaagcaacaactcacaacttcgcgcgcgcggcgcggctcggctgggggcgtccgccattgtcgt

SEQ ID NO: 9519 - DNA, 1501 bp, Oryza sativa; identical to SEQ ID NO: 7267

SEQ ID NO: 9520 - DNA, 788 bp, Oryza sativa
cggcgggaggaaggggatgacgggtgggccccacccgtcagcgagggtggcgggcggtcccgcccgtcagcggcgcgcgcggggagaggccggatgggccgcgggggagaggagagagggggagagagatgggccgagccggcccaagagggagagggagggataggggactttctagagtttttctttttataaaatcattttaactttgtttatttcttaacaattattatttgtgctctgaaaattccactaaaatttatttatgcattttaggcttttaggaaatatacaaaaatcctccaagccttatttgacttttaactttgcacattttaattgttgaaggcttgcacacagattttaattattctaggcataattttaaggatatattttagagtcgttttgggacgtgacagggttcactctattttcttccatataaatcatgcttgtttacggtttacataatgcctgatatttatatatgctcgttatatcctgataatgctagaaaatccatgtagttttttgagtacacacttgatattatctgctatatatcttgtcttctagaaaatatttttcaggaataattgagcactcaagtaggttgtgatcaagtacaccgcattattgagaacaatctcgacaaatgcagagtcgtcgcgcccaacctaccaacaaagaccgacgacctatctcatagcgccggccgtggctggactatttgagaaaaatgttgttaacggataattcctcgtgaacgttgtcggcttgatcac

SEQ ID NO: 9521 - DNA, 1501 bp, Oryza sativa
acaagtcattctttagttcagcctcgctcacttggtatcacagaagcataacctagacgtaactaattcagtatagaagcaaaaagtgcaacagcaacaacgagggtggaaactagaaagaaggatttattatgttccttagtttattcagtcacgaaagagtgactttaaaaaaatgtacacttcttccaaagtgaaaattatgagatgtcttacttatggaatgctcctacatgctgaggttgttcttgctgacaccctcgtttctatgagaagattaatctaacatagcaagtagatagtttactgcaaacaaaatggataataaacctgatgtttcaaaaaaactagaggaactcatgcatgatgtacccaaaggaaaccggttcttgacacactacaaatctgtggtagttcttttccatctcgaaaacgaatcaaggctgtgtttggaatcagctgttcccaacatgcaaagtgcgcacggaaaacagggcggtccattagagcgtgattagttaagcattagctttttttcaaaaaatggattaatatgatttttaagcaacttttgtatagaaactttttacaaaaaaacacaccgtttagcagtttgaaaagcgtgcgcgcggaatacgatggagatgggttgggaaccctggattccgaacacagcccaagtctatccaaaaagtttagacaagaaaacacgtaacaagttggtttgcaagaatacgaattacgtcaatcctgcactataggtagagcaaaatggtgatttctcgtaaatctctcgaatggtgatttaagaatttagtgcaaacctaactcttgctataaaatcaaatgttcggtaccgcatcaacggaacaataaaaagcacttggcataccataattttgtcattcttgttgaaattttgtaacataaaatgcatgaggccacacgaccttaatgttcaacgtgtcatgcattagtgaaataatagctcacaaaacataacaaatatagctagataacggttgcaatccttaccaaactaacgtataaagcgagcgatgagtcatatcattatctttctagcctgctaaccatcacgtacactttccgatcccaaaaaatgacaacttctatggatgaacctggacaatgtttagggtttagggatgaatctggacaaatgattgtctaggttcatccctagaagtgggtttctccttatgggacggagggagtatatttgatggacacaaaagttactttcgtgatgaaatcaaaggggatttgttgaggcacctaatagaacatatgtccaaatgacatgactcacttggatcctaataggacatgaaagcaaaactagcactccaaagcaaccaatgaggaattgaaagaaaataagtgccatcgcatctataaatagacaatgaaaaccctccccatcgttcacacagttcaagcattatacagtaaaaaagaaagatctagtgtcctgtcgcaa

SEQ ID NO: 9522 - DNA, 416 bp, Oryza sativa
ggccattcccatggcgcgtggacgacacgacaaatgcccaaaaatgaaagggagggaaaaagcttactagtaatagcttggcttagcgagcagctacagtagcaggagtggagtggagtattagttaattaattagtccacggcgttaatgatactccaccgattgaaagagtagcagcaaaggggaatcctttccaccatcccacttccacctttcttcttcttcttcttcttcgcggcgacatggcgcgcgagggggaggggtggatccatgaccatgagtagcttacgaggattccccaagcccaccacccaccacccaccgccaccttttgttccgcaaccgcaatgatttcttcttcttgtaccacactgcttctgctgctgccgacgccgccgccgccgccgccaccagc

SEQ ID NO: 9523 - DNA, 1501 bp, Oryza sativa
accatcttgaactcatctcaagatccacgctcctcgtatcacgaatgggtggccagccaagaatttcgaagttcgcatctagacatcttggtcgatgatggtagcttgaagatcaacacatggaacatgcctatcccggtcactcatgggatgactggaagcctggatgctccgtcacttccaaccacttggacactgccctgcatagttacatgaggaaaatagactacaagaggaaaaatgccgccatatccgtggagagtcttcacacggcttaccctaccctgagcatcgctgatgatgatgatgttgtttacttgctatccaagcgcaccacaagtggaaactattctaatccctcgaggagatgtttcctcgtttgctcaaaaaccatctaaatggttatgaaaaattctggaaaaatttgacaacattcatacaacacatatatacaacttcacaaaatcttaagtccaaactcaactcacacgtcgagatataaaaaagacaaattcagcgtatgaatagtagagtactgtttatatctaaatttgtcttttttgtttctcgatgtgtagatcgaatttgaacatgaattttggtggactagtaggtatcattatactctacattgtcaatttttttttcagattttttcacaactatttgcatcgaatttggaagaaaaaggtataccactccccaccacaaggggagcagccaagatggtattcactcttaacatgagggcacgtgttctcgaagaactggagaaacttcatagcatgagtcaccttggttttatgcgttgcttcctttccactgggatctccaaacatcttaagcctacaggtaatttgctgtgatatctggggaaatttatatataccttatttgtgctgtatgagttgaaaacaaaactcaggctgcaggccgtgcatggttggaaaacaaagctcaggtgaattttgttgcaccgcactgttacatttggagtagatgttggtttaccgaagcttgcttttgccaatatattggcagcaaatccacatccaataaatggtgagctcattcctagcaaaatgtagcacaatatgggtgtgaaaacacaatataaggatctaaggtcggatcataataatattccttggtttaggaattaggatggtctgtgtgaccaaactactgagattatattacaacttaccaaggtagtgtacttaatttaggagaatatgattgataatgaggatacaatgcaatggtagagtagtactcaaggatcactatgcactgttgtgagttagttgatgacaagccttggggcttcttgctgtagttgggaagcaaaatggagttgggagctgtcacgcccagaaattcccgaatagaattccaagcagaatgtgcattaaaatccccgtccaggaccagccggggtacacaaacgacaatgttgacatacagatccacgtcttacaaacatcgtaaagtcttacat

SEQ ID NO: 9524 - DNA, 361 bp, Oryza sativa
acaaggtttagggtttaggtatgaatctggacaaatgattgttcaggttcatccctagaagtgggtttctccttacgggacggagggagtatatgtgatggacacaaaagttactttcgtgatgaaatcaaaggggatttgttggggcacctaatagaacatgtgtccaaatgacatgactcacttggattctaataggacatcaaagcaaaactaacactccaaagcaaccgatgaggaattgaaagaaaatcagtcccatcgcatctataaatagacaagcgcaatgaaaaccctccccatcgttcacacagttcaagcattatacagcaagaaagaaagatctagtgtcccgtagcaa

SEQ ID NO: 9525 - DNA, 1501 bp, Oryza sativa
gcggcggtgatgatgcatgatctgaaagagacagtgtgcaagctgattattgtatgttagatttaattaaatagttaaataatggcaacatttaactgctccatatcgatatggatatatctaatcctacatgtcacatgtgcatacgtacttgttattaacgctgagactgaattaatatacgccctccgtttcaaaatgtttgataccgttaacttttcagtacgtgtttgactattcatcttattaaaaaaatcaagtagttatttattcttttcatattatttgatttattgttaaatatattttcatgtacagatatagttttacatatttcataatttttttaataagacgaacggttaaacatgtgctaaaaagccaacggtgtcaaatattttgaaacggagggagtattgcagctagctcgcgattaaccaaggtagctatggccggccgacgcttctaactggcgcgcgtgccaactctcgatcgactgctaatcatgcttgcttaatttggaaggccacgacaatccattttaagtcgtataattaaccttttgtaattttgagtgagaccacaagtagatcgacggagacattctacttggcatgcatgcaatgcagaaacgcgcagagctagcattatgtatgcttgtgaattgtgtgagagagaattagctagattgataatgtacatatatgaatttgtatgcgatatatatgctagtatatataatatgcagttaagtgtacaaattaaatgcactaatttgcattacaaaattaattaatacacatgtggttattaatttgtcccgaagcgagaataataaagccgggttgcagtgtgacgagaggggatgatcgattagtttacattacccttttgatctcatggctttgactcttagggtttgtacgctacctagctagctttgctttcggacagagctagaggtgattattactccctccgtttcaaaatgtttgacaccgttgactttttagtacgtgtttgaccattcgtcttattcaaaaaatttaagtaattatttattcttttcatatcatttgattcattgttaaataaactttcatgtacacatatagttttacatatttcacaattttttttaaataagacaaatggtcaaacatgtgctaaaaagtcaacggtatcaaacatttttaaacggagggagtagtaattagaaatgaataaaaaccctagctagctagctacatgttgatgcgtattagttattcatgacatcagctagctaggcagacgagagtacgtcgagtagtatttatagccggcatggaggaagcgagaggaagcatcagcagcgcatgcactagcagcttagctactgcgcgcgtaccagagagagatcatcagctcaagtagctaagctagctataatctgctagctagctcgatcagacacttaattacctgctaggtggtggtcgatcgaagaagaagaagatga

SEQ ID NO: 9526 - DNA, 1419 bp, Oryza sativa
tcgaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggttgacggcggcgacggggctccggtgaccggcgacttcgggggtcaggcggtcgggcttctccaccctcccgcgcacctaacagtggtgacggcgaccggcggcgacgacggagtcggcggcgcgacgcggatggagctcggccggcggcggcggcgaacttggcggcggcggcggagaggctacggggcacgggagaccacgggagaggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttgggggtaaagaagatagaggaggataagaggaatatttcccctcaactaaattggaaaaaggagcaacggggaggcgagatttggaaggaggaggcggcggcactgtgcacggcacggctggctcgggctctgcctgagctggaagatgaacagtagctcagggagggaaagtagacttttccggctgggctgagaggagaggaggcggcacaggttgggccggcggaagagagaggaaggaaaggaaggaatgggccgaaaatggcccaagctgaggaggaggattttattactttcccaattaaaataatcacttaaatgatctttgaattgttaaaaatacttccaatgctcaaataatttcaagaaaaatcatgaaaatacttggacactcaaagtacttaacaaaattataattagaccatttaatgattaatttaatatgtgggtaattactgaaatgctctttgtaagattaaaattaggaattgagctccgaaaaatccgagaatattccagagagtataattaaccatggagaatttaataaaaattaaatccatccatgctttatatttaggaaattttatttcccacatttaacttcacttgaaaattaataaacatttaatataaattctaataataatttattaaataatttataaatcctgaaacaaaaatcaggatgtgacatttcttacgtgtaaccacgtgccacataccaccacggtatacggacggaagacgtgacatagtttccaacccaac

SEQ ID NO: 9527 - DNA, 1501 bp, Oryza sativa
aaaaaaactatatataaaaattgctttaaaatattagataaatttcttttccaagtttaaaataattaaactcaattaatcatgtgctaaaaactttcccattttacgtacatgtagtacttaatctttatcttcattactttcaaacaaggaagcttaagattttaagaagctggcttgcgagaatctggaaaagtttgagttttctaatttctgctttctaattccttttttctagattctacaactttctattactacaatttaaattgtttaggagagcttttcacattcggagattgtagaaaaagctacatctatactaatataaaaatgagtagtttgccctccaatcatacgtgccaaatcagagaaaactgggcccacgtgtgaacgcaccgaatccccatccccgccgctgtaaatcccttcgcgcactgataccctggcgcagcaaaaaatcgtttcccctgaaatcacgctgccgatagcttcctcttccccttgatatcgctctccacaaaatcgattagcctacacacgatttcaccatccacaaaatcgctcagcctcctcctccgcttgatcttgctggccatctccttcaccaccgctgtacgcagcctcgccggagatccgcctgacgacggagtttgaggtggcgcgacggagatccaccaggagcgaaaaccagtctctgctcccgcggagcacggcctcgacgacgcttcctccttcccacctcaccccaactctctcagattggcgccgctgccagccactcactcgccatcggcaagatcagtcgcaccgccgacccctcgctctcccttgccaagaacagtgccgctgcacctcatcccagccatctccatgacgaagcaaggtaacctctcctatttcttgccaagaatttcatttttcttacactgattcccttgtgagtattttattataaagtgatcttttcaatggcataagttttcatgtcaattctcaatgcatctttcttgatggatctatttttagcataatcagatggtacgaggcatgcacttgcaagtcgtgtcagttcttggtttgcaattgatatcatagttagggaaaaaaatttcagtattgctccctagatcgagggaatgatatgtttcgaaacaattgaattattttcattcttcatgtttcacacaattattcatcaaacgatctctatgttccatcagttattggcctattgggtgattgcctgtaagcttggaactatattgggtaagtattagcaagtttaacctttaatgtttcctgtgtgtagaactacagatcatgagatcaacaatggcaaggacagagggcaggtaaataaaatggtaacaacagctcccactcctccattttcttaatttctctataaaacattggatgccctgatataggatgagcaccatacccaatgatgagtaatttctatagaattaactgcacacctgattaatcacttgac

SEQ ID NO: 9528 - DNA, 1501 bp, Oryza sativa
tgaaatttaatataacaatagatttttttatcgggagcactaaaaaaatatcgtgagcatctgtagtactatctttatacgaatgctcctcatttttacgtcttttttctaaaaaaataaatatatatattttattttattatctaaaaacaaattttgtcaaaaataatgtatcgcacaacaaactcataactataatagtctcatgtaacaaacatttacattctcaataatacaattcataattttttatgtttatccaaagagtaaaaatggtcatttttatagaaattaggcggtcaactaatatgaggagcatgaagggataaaatcaaatttttgggtataaaaagaagtaagcaaaatttaagggtatagaagtgattagctaaaattttagaggtatacaagagattttctcctttaccaatgagtagtggattcatttctaatttttcatatacttgcatggagttgtatacagttttttcacatagggaagtctttgtcaagacccatctaataaagaaagtcgtcttatgccctggttggatccatgggttatcttttagccctcctttaaatagtcctaaatagctcaaaagttctaaacagataagctattttaaagttattcggaaacaacccaccaaaaaaaactatccctctcaaggagtgctaattgaggctatttcaggtggggtccactgaaaaagtgtttttttgtctctctccatgggaaagtgcattaaaggccaaatagctctcaaaatacccttggatccaaacaacttaggactatttctttgtgctaaaaaataactcttaaaataactcttgacaacttagggctatttccttgtgctaaaaaacagtttttaaaataacttttgactagttctccaaacagtggcttagtacatgctactagcacctcccaaggacacggacattctctagccggccatgttttttcttaattatggtacagactttatcttaatcagtacacatttcaaactgttgaacaatatatttcatgcaaaaaaaactatatataaaaattgctttaaaatattagataaatttcttttccaagtttaaaataattaaactcaattaatcatgtgctaaaaactttcccattttacgtacatgtagtacttaatctttatcttcattactttcaaacaaggaagcttaagattttaagaagctggcttgcgagaatctggaaaagtttgagttttctaatttctgctttctaattccttttttctagattctacaactttctattactacaatttaaattgtttaggagagcttttcacattcggagattgtagaaaaagctacatctatactaatataaaaatgagtagtttgccctccaatcatacgtgccaaatcagagaaaactgggcccacgtgtgaacgcaccgaatccccatccccgccgctgtaaatcccttcgcgcactgataccctggcgcagcaa

SEQ ID NO: 9529 - DNA, 603 bp, Oryza sativa
tggcgccgtgcccgtgccaccgtggcactagggctgtcgtggaggtgctgactgggcagaaagggggcgccagccacactggcgccgcccctcgtaccacggcgccagcatagctggcgcgcccctcctctgtgccttaaaccccgtgggccccaccacctttctcctccccactcccattttcgccattcccagcccgagcagcgagctgctgttcttctccctctctctccccctcacctctccacctcaaatccactcaatttgaagccgtatttcgcgggatttgttgtggaaatcgaagagaaaggtagactccttcattcccccttcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacggaggtttgggttgtatgatagagtatttgtaatatta

SEQ ID NO: 9530 - DNA, 1501 bp, Oryza sativa
tataatatatgtaaattacttttatgttatattgaattacttttatatgtttaaaaagtaacttagtgaaatctaaaagtaatttagatatattacaaaaataatttatattttttcatcaaaatataatcatgtgagatcttgttctaaagatttaattgttacgaacacaacggtgtaatcggattgtagatcggatgagtagtttaagagaaaattgtatttgaagtgtaggtggatagtgtttatcatagatagagtggtagctggtttgtcggtttagacaaaccagctagcactagctgtgtagccatgtccatgaaggaggaaaatgaaaaacggaataatcctagggacgtggaaggaccttgttgcaaaacaagtttcttcaagggtggacaagacattttattttacagtatataagccttgtttagtttttaaaaacaccacctcgaatctttgaacatatacataaagcattaaatataggtaaaagaaaaactaattgcatagtttgtatggaaatcgtgagacgtatcttttgagctaattagtctatgattagacataagtgatacagtaacccacacgtactaatgacggattaatcaagcttaataaattcgtctcgtggtttccaagcgagttatgaaattagttttttcattcgtgtctgaaaccccttctgacatccgcttaaacatccaatgtgacaccagaaattttcttttcgcgaactaaacagggcctacatataagagccagtttaaaagtatagtcaactattagcttcaaatcatctatagtcaatgtaatagccaattcatataattagctacctataaacatatactactacacaattaatatctggtcctacctgtcatacatatattacgtcttgtagtctatgcttaagctggctacaagtctatagccgctgctcttatctctcatcatttatcttctcgatatatatttatagctagcttatagtctgctaccgtacctgctctagatctagttctatttctcaactccaattttctcaatttccgttagcaagtttttcaaactgttaaatgatattttttttaaatattgtatataaaagttatttaaaaaatctcaaataaatttattttttaaatttataattattaatacttaattagtcatgtgctactcgttctgcgtgagtcgaaaatctctctcgaaacagacagatcgaacgcagccgtctcagccccggcgccgtcatcttccgtcttagcctcaccgctccgttccgttccgttccatttccgccttgctcgagccagcaaccaaactgcaaaaccgaccaaccgcacccacccaccccacctctccccacccccaacctcccaaaccctaactctctctctccctcgtcgccggcgaagcttccagaggcgggggcagcgcgagcgcatggagtcccccaccgccggcgggggcgggggagggggcgaggccg

SEQ ID NO: 9531 - DNA, 1501 bp, Oryza sativa
ggaagtctgtttgtcctccctgtcgctacagtggcatcttcaacctccagccagccatccagagcccctgttcttcccgatccggcgccattttccgcatgtccatcgcacctgagcgaccccatgtccaattagttgaggggaaatattccacctatcttcctcttgcttttctcctaaggaattggattttatccctttgattcgagttcaaatcggccggataaactttatcccaaaccggcgaaccttaactaatccgccgccaaatcctctcgggtccgagccgatcttcctccagctttgcctataaatagaacctccaagccctcctctttcgtttccatcccctagctcgagttcccgtgccctagccgcctctccccgcgctagccatctctctccatcgccggcagtgatgtcgtcatgacatcgataatccttttctgtataaggctaaaatcagtttaatcttgtaaaattcataactaattcatatgaactcggaatgaggccgtttaaatctctaaattcatctaaaatcatgatctacatgtttgtttacttttatgtactgtttatttggtttttattagtttttttcatcattttgcgtgttagcttgtcgtttctgtcgttgcgaaggttcgtgagtgcgtcggaagtgttcaagaagattaattgaagaccgattattgcaagccaagtcacgcagatcccaaacacaatcctttgagcatattgatcatatatttaaattctctatttatttcaactgtgcatttattttccaatgtcaccgtgtggtgtgaacttattcctttggtgttagttctgtgatttttgggagatattttaatcgctactttaattggatttctcgactagggacagtctagggttttagtgaaattttatttggagtttattcgatagtcagtcgggaatctattgggtgatatgcactaagtcgtgtctatgtttgatggggcaattttatgcgcatcattttaactatgcatctattttatgcattaatttattgtttagtcagttgcattagtgtctatatctgggttcatgaaaaatgttctatgcataaaaatcatcatgcttggttattcttttgagtcttttgttgctttgtttaatttggatttgagcatgcattgattcctatcccttgcctactttagatatcagtcctatccctcgatcgcaagcactgctccgagcttcagagtcgccgcccttagctttatcgtcttcttagttttgtttgcttgctagtttccgtgcttaggtttgttgcttatgggttagtcggcggtcgatatcatatgtcagtggtatggctgcctcaattagaagttgtttgcttccttttcagtgttttaatgaagataaagataattgcactttaatttataagaaagattagtttctaagccccctgtttttcctccatttctcatatttctacctatccccctttagatgg

SEQ ID NO: 9532 - DNA, 1091 bp, Oryza sativa
gcacctaataagaccaaagatctcaaattgcgtgattgtcttcttatccaatgcccaatacatatgagttgtactattagataaaactaatattcgaagcaaactgaattaaagaccaaaccgcgcgggcaaaataacaatcaaagaacaaatgattaatagtttcatctttgtggcagaaagaactagacttgtttcctctccaattccttttaatcagattatcttttgttaagattactccatggcgtaagttgtcacgcccgaaaattcactagtaatttccgaacttatttgtgcataaaatcctcgtccaggaatcagccgaggtacacaaactaacaatttaatatacagattcatcaaaatatctaaaacgataaatacttactaaagaggcacttagtcctcaccatgaagaaaactgcagcggaaaaaaaaaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcgcaaagataccaaaggttggcataatataggctcatttgcaaaagcagcatttagcaaaacatttaagagaagtaaaacagtggagtaattaatcagaaattttaatcaacactgaacaacacgcccatgctgctcaggcctaaccattctgaaacaaccatacccggctgtacagatctaatctccaatccaggagctaagcaaattattaccagatataacatccataattattgtgagaagtgtgggactaatcacgaaaaacattgctcaacccgcccataaccgtgggcacggctattcgaatagtttactctggccagaggtgtaccactgtacccacaagacacagccccacatcatgtcaccatgtgcctcagtaccaccacggtacctcggaaaggggctgtgacattaccccttgcataacacaatccaccgcagtgcaccattcctggatcataatcacccccttataaataaggca

SEQ ID NO: 9533 - DNA, 669 bp, Oryza sativa
aatatttattgttttaatttctaaattttcattatttctaattgtatttctacgtggactctaaacttaattttaaatttcagttacttctaaattgtattcctatattgactttaaactcttcttcccatgtttttcttaatttcgaattttagttatttgtaaattatatttttatacggactctaagcactacttttaattttattatgtttattccgaattttagtatggactttatactctacttctaatattccttatttttttaattccgaatttctattttttttcttaattgtatttatatatggactctactctacttctaatattccttatttttaattccgaatttctattattttctaattatatttctatatgaactctagtctcctcttctaatattctttattttttaattccgaatttcagctatttctaaattgtatttttatatggactctgctttttctttttctccaattaatgtgagaatttataaaaaaccccagcgaacgtagaggctcatttttctatttctttaataatataatagattgtgaagggtatattgtctttctatattttttgcgggggatatttttgtattttcgcattctattctttagtcagatctggatagtgagaaagggactcgtccca

SEQ ID NO: 9534 - DNA, 1003 bp, Oryza sativa
tctctctctctctctctccatccacatctctgtctgtctccgctttaaagctgtcaccttttcccatctctctctctctctctctctctcccgtgctgctctcccttctcctctcctcaattaccacgccgcagccgcagccccccaaccctagctagtacggcgggcgacctgagggggtagctgcctacctctatacctgctatctccgttcgatccgggtcgggctcgtgctgctgggggcgggggcaatcaatcggcgagctcggtgatccatggccgtggctgtggggtggctgtgagggtgcccccggcggcgctcccctccgcgcctgccggcgagggggctcggactgaaggtcgccacactctaccgccccacccatgctccctccgcgcgcgatctaagctaggcctaatctagggttcctgattgcttttccattttcgcccggacggaccaaactactactgtctatctatctagcttcttctgctgcttctcgtgctgctcctgcatattttttaaaatttttatttcatctcatttccgggttactctcatttatcatctactccgtaccactattagccaaccaccccattttcccccctttttttcttgagatttttgtgggcgaattcgagtaacctttactccccccattctaggaagcggtttcttttagcatggctttgtttttttcttttcctctcccgctttcttagttaatcaactttaccatatctgttgcgtgcacttcaatccctgtcatttgtatccttcccctagattttgatgctcaaacgattgttttcaccaaatgctgagtcaaaagaactctccttttcttttttcccccagggatctaggcgagctgaaaattgaagtgcaggcaaggagataagagcagcgtccaaattgtgagtacttcattagcaggaggtagtggttgtgcttgcttggctcctttgcaatttggctttggcgaggtagcaatgg

SEQ ID NO: 9535 - DNA, 1501 bp, Oryza sativa
gccgatgccagccacaaccgtggacgaggtagacgagtcggcgtggtccacgtgccgcgacagtttggtgtgccggcgattgggtacggatgcggtgaagcgggaagacccctaccccgatggtggtgccctcgccaccatatcaaccccgccgcctcccgttcgcgtgccgctgagctcccatcgcgctgtcacccactggtcagagggggaggagaggtggagccctacccagcaccggtgtcgcatgggccgcgctgtcgctgctctgctcgacgccgtcaccgaacgagccacctcgcttcctctgccagggaaaatgtagagaggaggagcaccgccgacctcgccgctccacccgacggtcgtcgctgaccttgcctcgctttatcctccggcgccttggctttctctgccgacagggaaaggaagagaggagagagatacatgaaaagtgaaggtgatattagtgggacccactataagtgactttcactgtaaagcatgtagccaatattgttcttgatctatgcggcatgtgaggtctagcaaaatttggtaacgcacctatatagtattttttttgaaaccttaatttatactaatcaacctaaaatgacaagtattatgtgacggagtgagtagcaaacaataagataagccaaatcgtcctttaatttttttttttgttaaaaatctcatctgaatggcatctattgtatcaaactcaaacctttcagtaaaagacagtgctcttttagatacggagtaagtcagtaaaaccttttaattgtggcgaacatcgtactagttgcctagtagttggataaaaaaaaatcatcctttgcatcaaaggaagtacccactgtggttacatgtacagtagcaaaaaataaaacaagttaaaaatctcattttaatagcatgaattgtgcccaacccaaccttttgaaaaaacaatgctctttttcacaattctgtaaatactagttggataaaaaaaatcttcctttcatgcacaattcaagaggataagggaaaaaaaaaatcttcctttggatcaaaaccatcatctggaattggacacttggtgtggatttatacaagttacatgtcagattttccctagtgaaggagtaagaagacatggtcccatggatatgtggactgcattgcatggcttggcccagctgagagcccgagacaatcagagcagaaggcaaatgcaggggagtgccacgtaggacgggcaaaagatgccacgatccgacgtggcccaatgggggtgggcgcgcgcggatatcgcagccaatcggcggcgggattcggatatcccccatccccggcctcgtctccggccgctcgcgtcgtgctccccccttaatatcccgccacggattccggcgtccactcaccggccacctcttcttcctacttcgtcttcttgctggtgtgttcgaggaggaggaggaggaggagaagctagcggcggcggcggcaa

SEQ ID NO: 9536 - DNA, 1501 bp, Oryza sativa
taattcatgtggtttgtttttcttagtttcatacaggcatgcaagcgatgggcttggtatgtgttttatgatctaacctcaataaagtattgtatggtacttttcaagagataccaccgaaaaaaaaacatggtaataaaaaggtagagaaattctgttatttgtagctgttgaagcaagagtaaggactctgcctataattttttttttggatggtaatccccagctctcagcatcaagcgtagattctcaagcatcggtcttgagttagaatgggtttagtgacgtggcgataatgtgacaccgtatcccagggtgttttccatggatgaaataatttttgaattttccaaattagtaaacagctttaaaaatcatgaattccactatagagtatttctaatatagattagtttgtaggtacaaaataaaacataatttgtctgcaaaatataatttaaatgtactaaaaaccattttcgtgcgaccaatttttttcactacacctaaatttatttaggtttaaatcaaatgtgcaaatgaagtgggaattgttccataatgttttgagtttattactaacttttaaaattcacattattaaacaaactatttaaaaaaaactaagtcgcatattgtgggttttagaacctagatattttgtctacaatagactaggttgtcatctataagatattccactctaaagaataaaactattctaatgccactcaaaaagatgtaatgctgtttttccactttgaaaccttttgtattagttagtatggattcaccatttattgaccattttgcccctgtgcttttaaaaaaaatcccccgtgtgcattccctcttcatctaacagaatatggcaaagctcagaagcttggagtggcaaaaacagaattacaacttttgaaaatagcatgataacaattacattggagtggaactcttgaaaatgataaatgttcaattttctcttagaatgaaggttacttgcataaacaaaatcataaagaaaaaaagagttggatccataatcaacttacctcccaaagggtatgtttcttgtaggaagcaattcccagtcctactttagccacattttttcactagaaccaaacacagttttacgggggatttacaattatgacattgcaattttttacataaacaaccaatacttaaattgaaaagctccacactttgccctgatagcaaagcctgatatatgacacctggaagtacacctgaagcactaaacagcagacaaattatgcccttttttatttgtaatcagaaggataagccttcacatggattttgtatcagcaaatgccaagatctcgctgttccccggtggcatcacgggcagcacgacttgtaaagcaactggacataatgaattctgttttttttttctttctccaagcaccaaatctgcctataaatacacaaaccttagtgagaacagcagcaggagaagagtcagtggaga

SEQ ID NO: 9537 - DNA, 1501 bp, Oryza sativa
gtgtgagttgaaaaacctaagtcaaaatttcaatcccgagttgtttcacttgtcacaacacttacaccgggtttctttgcaagtttttcaacatctcttgaaggttttggaccatgttttatgttgggtttgatagcccacgaaactagcattccatagagtccaagatctttgaaatcggagttcggagtaaaaagttattgcagttttacttgagcaacatcagactatccgatttgaaatcagactatccgatgtatcggactatccgattcttcacagaacttcactctctgtcttgatttgaaaaaatcctatcgagtgagtttttctaagtatcggagtatccgatgtcggatcagatagtccaatgatacagagactccgaaatttcatagaacttgagtctctgtttgaggacgaagtttttgcttctaaaatattagatactccgatttaacattagatagtccgatgtctcggaaagtccaaaatttcatggaacttcgttctctgtttctagttgccttggaggtttaaaatatcggactatccgatcttgtatcggactatccgacgtgggctgaaagattcccctccaacagccacatttttggggatctataaataccccccacctaacccttttctagggttacccaactcatttcattctcattcactttgggttgagcttggtgctaaggtgctttggatctttgagctctttctccctctctcaaatccctccttgttctttgtgtggtggatcttggtggttgtggatttggtgtttgagggcctagtgtgtgtttcactcgatcttgagcactagggtttgaccaagagttatgtggtgtttgttactcttggaggttgagggctcctagacggctaggtgtcactcccgagccacaaatctacgtgtggttggccgggagaagtttgtgaaggccggattcacctccgcaagaaaagagataccccttagtggaaggaggagtgcttagtgcaacctcttgaggaaagggttagcaaagacccggctcttagtgagcttctcaacggagagtagaatcccctcaaggatttgaactccgggaacaacttcgtgaacttcatcattggtgatctcccttcatcctctttttagctttgcttaattgtgccgctatagatctagtcgctgtttgtgccttactcttgtttgtgtgatagatctacttgttgtgcttcattggtggatcagacagtctgatccaacatcagactatctgatattttcggatagtctgactgtggatcagactttccgaccttatttcagttttagcttccgcataaagttttaaattagcctattcacccccctctaggcctaattgaccctttcaattggtatcagagcctaatctcctaattaggcttaaccgcttggagagatcatgtcgggtcaaacggggaatggcaaggatggtgataagggagctacgtttcctta

SEQ ID NO: 9538 - DNA, 637 bp, Oryza sativa
catatgaaaggagcggcggtccttcctcgggtgttagctttgtattctttgttgcattcagtttattaatagtttttgttttcattcttgtaacaatttctaaactactttccttttcactaaactactttatactctagttttcaagctaggtatttgttgcatgccttttctgctaccaggcttggcatgttggatcgtaagcgagttgcccttttgtaataagcagcttagtgtgtaactcaaactgacctgaaaatcattactataagggggaagcaatataggatctaggagaaaaagaagaagcaaagggcgtaagcaataaactacttatgctgactcaactacttatgtttatttgatactagcacttctttctatacttgtaggctttctttcttatattcaacttcaagaattcgctatgctaggttcattacatccatctatcaggtttgggtagataggctctttccttaagaaaatgcacgtaaataagtgaatccgaaaagaccaagacttgaatgaagcccatttcccagggttgcccatgtagaatagccaaaagtaagtgcataaagtgctattgtagccaatcttttctataaatggcacctcccgtcccgtgaccagt

SEQ ID NO: 9539 - DNA, 1372 bp, Oryza sativa
acactctcaacggatcctccatgcgctgtgttgggcataccatagttcttccgtgcgtctttatcgtggcggaaacagaacaagagggaaagacccggctgactcgcccagggctcgagggcgagccattcgagagtgagtcgaattctgtttacgttctcggtttggtttgggcccctctcgatcttttgcgtataagggaggggggaaggagtctaaatctatggacattaatgaaccaccattgatggacgttgcacatgacacgatcaattcgacttgacggtccggtgctaatagaagtcgcttactctccgtctagcgaaggtgccaggggcagggcttttttgtagtaatagtgggtgggtctcatgggatttcatctatgccggccgtcagaatcaaacgagggtcgaaggaccattcgattcattaagggggacggcccatttgtaaggcgggggccctgatggacgacatcccccggcctcgattcttttgcatagtctgggggccggccgcagcagagctgcagggcatagcggcaccctcgcctggcgccattctcggacctagcagcagatgggcgggccgggcctgaatgaagagcggaccacgcactcagaccggaagatcccagttgtcctggactagacaagtacgtagagatcttcgtggaaccgaggagggagtctcaatcgatcttttctaggattcaaactcacgccacgcacgaagatttttctattgatagagttaagggctcggctcccctgactctaaaaggttaggttactaccaacttgcctctacggaagaggtgtactttgtattgtctgggggttatattatgggacggagtacaagttgaagaaaaaaaatattaagtacatattagttatagctaagaaacggtgatattgtttttcatatataacccttaaattgatacccgagatcttctatagctgctgtagtagatatatccatttttgcagtaaattaattattaaaaaaatagggcacaatatagcacgagtagtgcacgagacaacaaagaaattattgatgaggtagctagctttaagctgttgtgggaggtcatcgcctcaccaactgcatgctaaatatatcgatagatatattatgctttgttatattctgtcttgcctaaccggccgcatctcccccttcctccactcactttaagcatcgatcactgcttggtactactacgtcgcttaatcacttcttgattcctttgctaacctactactccactacttggcctgccacagtttgatagctagcttagctagctagcgatcgatcgacgtcgtcgttgatccatcgccaccggcgccggcggcga

SEQ ID NO: 9540 - DNA, 1260 bp, Oryza sativa
gatcttctaagtggttcattttcgatcactgacggttgagaaggttcttctataatttcttcattttgtgcctcagaagtctgttgagtgtcattatttaattcattattattttcaacagaatcggtatcaccagaattttcatctggtgttaccacggtatgagtcacgggtacacaacatgaggtaccaaatttattggaatattattttcttggatttccggtgtaacattagcccgaatttcctcaagattaatttcccttttctgtgagctcccccagaattcattattttctaagaatacggcgtgtctagattccacaaatttagtgacacggtccgggcaataaaatcggtaccccttagatgtctcggggtatccgataaaatggtagcttacagtcttaggatctaatttctttagttgtggattaaatattcttgcctcagcacgacagccccacacacgcaaataatttaatgtcggttttcttccggtccataattcataaggtgttttgggtaccgacttacttggaactcgattgagtatgtgtgcagctgttttaagtgcctctatctataaattcacagacaaaatagaatgactaagcatactccgtaccatgtccataagtgtacggttgcgacgctcagccactccattttgttgtggttctctaggcatggaatattgggcaattattccatgtatctgaagatattgggcaaatggaccaggactttgcccataaggagtaggtctcccataatattctcctcctcgatctgatctcactactttaatttttgcattatgttgattttcaacctcagctttgaatattttaaacttatcgagtgattcagatctatctttaatggggaaaacatatccataacgggagaaatcatctgtgaaggtaatgaacgagtcatatccatcaatagatgttactgggaacggtccacatatatccgtgtggattatttctaatggacacgtgctcctagtagctcctttcttaattttcttagtgaattttcccttaatacaatctaaacaatgatccgcattcgaaaaatctaagggttgaagtatctcttccttaatgagacgctccattctccccttagaaatgtggcctaaacgacagtgccacaatttcgaagacgtctcattatcattacaggcattcaatatattcataatatgatcatccaaagagagcaaatagagcttgtcttgcacgctag

SEQ ID NO: 9541 - DNA, 1501 bp, Oryza sativa
acatccgattttttagtttgtttgaattgttattttatttatagttaaataaataatttaaggtccacattacccatagttcatttagaaaaacaaatacatcatttgaacataaacgaaatagcaaaacgaacaaaaaaattaaaaaaatgacaataagtattatatcacaagtacatcctctgtagaaaaaaaaatcttagagattgtaaaaaaaattgactatcggttttcccttgaatagatgattcattatttttaactaacatatatacttttagaaaaatcttaaaccgcttcatgtgttacgtcttaaaaattagaaaaaaatatattagagaaaaaaattagaccatcagttttcacttaaattatttagaaaaatagaaaaaaaaacacccctccattgtgccctccctacacatgcacaccacacaatactactcgtcccctcccctctcggtttgagctgtccactgtacccctccttgttttatataacgaaaaataataataaatattaaaatatgcataatttttaagctatacatataatttctaatctaactaaaccaatgatttgaagatccataatgcctatattttgaactgatataaaataaatcataaaataaagaaatgtcaatagggacctacatttcacccgtcctcacgcaatatccagcaagtataccaagtgaatacattttctcatccattgaccttccagaataaggcaattttctctccgacgacgaaaccgtcatcatcaaaaggcagccaagtggtcatatttaattcatttattctccttcactactagaaaaaatgtagaaaaaatgtttttgcatacggccgaaaacagtcttcccaggtggacggccattccgtctgggaagatgttttcctaggtggaagggagcacgacgcgccgcctgggaaaatgggtaggagtcgcctgcgataagaaggcctcgtcgcctaggaaaatacacgccaattttttaataatattttttatcaataatgttgcaactaattaaataatgcataaataatattaggaacttacaaacaattaatactgacaaaaatacatatattgcattagtgaaaagtgtcatcaatatgttacaatattttttatatttgtcatttcaaatgcactatctaattaataaatacattatggcatcgcgttgttccactcccgaagagacttgtattcatcgcttgtcgctagggtgccttctgggtcgaagaaccgtccttggatatgacagcactcgttgtggatgaagtggcagaggtcccgctgcacatttttaatgccttcatcgtcaaagcttgttcgatgttcaattctaggcaactgcatgcacgaaaaaacgacaatatattactaacatctagatgtgcagttctccattgcacttatacgttgagtcgagagacttacatcctctgcgttggtcatgtacctcccattaaccctgaggaa

SEQ ID NO: 9542 - DNA, 1501 bp, Oryza sativa
aaaagccttaatgtatttattgcgcaatattgccccagggctgacgtcagcaaggggtggggcggcgccgacatgcgggccccactggtcagcagctcaagggggagggaggggtactggcaggcggggcccaccgggcggcggctcatggggaaaggaggaaggcggcctggcttggctcggcttcaagccggccggccggttagggcgagggcggcggcggcaagcggccaccgacggcggcggccggcgacgcgggcgacggtacatcgcggcgacgcgcatgcggggagcggcggcgcgcgcgggaggaagagagagggagttctcaccggggttcggccggcgcgggaggagacgacggcaaatggcgacggtgagcgaccgaagggcgacagcgaacggcggccgagctccgggacaccctaagagaggaagtgtgagaggttagagggagagagggtgcccacgacgagcgagagccatggccgacggcggcggctatggtggtactcaccggcgcgcggagagaagcgggccccgacggcgggattggatgggggatgcggcggccggggtagctttggcggcggcgaagctaatggcggcggcagattggctcggcggcggctccagcggcggcgagcggcgaccagaggagtggaaaaggcggcggcggcgggtgtagcggtgcgggagtgatggagggcacgggagagagcggcggaaagaggaaaaaggtggaggggagtgcggggaagctttattggggctcgtgagagacggacgaggccgggaggtggccggatttctcgccgacgtggggaatggagagaaagagagagagagagagattcgaattcgaatccctccgttgcggggtgcacgcgcgagtgggaggagtagggacggtgggcggcgacgtgggcgcgcggcgcggagtggggcgcggaaggcgggggaggcgggcggcgtgggcggctcggcggttgccggcttggggagcggcggcgggaggtggaagaaggggccgacaggtgggccccacctgtcggtgacccggaggggttagggaggagggaggaaccggcttgggccagcccagccgagggaaggccggcgcgggaggtgaatggactgggccgacggcccaaggagagaggaaaaaggaggaaaaagaaaaagaaaaagaagaaaggatttttccagagatttaacattgccctttgctcattttaattggttaaaattatttccaatgctctgaaaattccactaaaaatcctgttagcatattttgacatgtagaatccaagaaaaattccacatgtcgattccgattattatttgtatttattaattagggattcatctctaggttaaattaaacaatttcttcggacgatttattttatgaatttagagcaagggaggggaacctcagggcgtgacaaacctacccccttaaacggaatctcgaccccgagattcggaagagctg

SEQ ID NO: 9543 - DNA, 1501 bp, Oryza sativa
gctagaagacccagcagcactgcatgcatgctgtaggccgcgcccgggagcggcggcgcgcgcacgctgcagcctgccgcgaccgcgacggaggaaagccaagcagcaagacgaggagctgacgacggtcatgtacctcagcaactggggcccaaattaacaaccaattagcttgctgattttattaggatcgtcttagatggttagattggttttcttgcgtgcattcgtgcaagttgcaactgatggtatatgtggacaagtatcgtgcatgccgcgacgagcgggctagcgccgggctgtcgctctacctccagggctaccaccgcttcgctcgaggccgcgccgtcgctccaccacgaggccggccaggccgccgcacacgtccgagccgcccagccggcgcaccgttgctctgtctcaaggcaagatcgccgctgcttcgcctcgagagcgagccactgctacggggcggcggtaggcgaagcgggcacgatgccaacgagagcttcttccggcgctggtgccgccgcccagcttcttcccgcgagctcgcccgccacggcgcctgctccgcccactgccgccgccgcccctgcttcgccgccggccgcctctcccacatctgccgccgcccgagaagagaagagaaaaggaaaaaaaagaagagaggtggacccatatgattttctctcacttacatgtggccccacatacttttttttaattttttgctgactagtataccacatcagcaaaaccaggtatatatactgctataggacctaaaatgcacggttttacatagtataggagtgaagatttctgatattgcaaataagggatgtcaaacaatctcggtgtaaagttgagggacgacaagtgaacttattccgctcgcaaacgaacggacgtcccatcacgtccgtcgatgctccagccagcactattggccttttctggcgacagcggccgccatcagggatgggaataatatgttcattttgcgtctctcattatagatcgagttatagtcccgtcccttggccacgcaatcatgtataatgtatctctcatattgcaataccactgaaatcgaggttccaagacactactaagccgtgaaatggtgcctacgtggcacacaaattagaaaaaaatagtaataaaaatactgatggacccacgagtcagtgaaacatgcatcctttttccttctcaaccctctctctcctcccccgatttctcctaccacaaacatcaacggtggcggctagtgagctcgccagctcgttagcaagaaggcgaaagcagcgaccgatggtaggtggaaggcaaggagcttctcacctaggtgtcacgcccagaaattcacgaaccagaatttctaagctgaacgtgtattaaacccctgtccaggaccagccagggtaaaaaacgacaattgttgacatacagatccacgtcttacaaaaatataaaagattacaaatgcagcgaa

SEQ ID NO: 9544 - DNA, 1477 bp, Oryza sativa
ctcatgcatgcatggccagcttgcccatatatatacacttgtccttccggtgagagagataatctattcctagagagaaacgcctagaggttttccggttagctccacaagttgatgggctaggtgacctagattcgaagtctcaccccttctaattatttgatatcaggtctttccctaatattcgcgcctttttgataatctcttcccaacaaacacacacatgcacagatcgagagggagagatcgtctcaccgctgcgttgagataaattccaacaggttttatatattatataagttattttaggtttgtcctgaggcaaacaactctgagtttgaccaaatctatagaaaatgtagcaacattcctaacataaaataaatatatcgtaaaaatgtattcaatgctagatttaattaaatttatttggtgttataaatattgctatcctttctacaaacatagttaaatttgatgaagtttagacaccaattcaggaataggaagaatgggggaattgaaatggtatacttctccaatcttacgtgaacaaaaaaaaaacacacatgaaagaaaatatatgaggcctttgatagtgccacacaaaaaacaaagaaaagtttacaaagagctcatacatcttggtgtttttcctacgaaagtgaagcatgggaatacaatcatatggaaagtcctatgaatcacaaggatatatcggaaaagtttaataaggaatgtaaatcctatgaaaatctcctttgccaaatctcataaatcaaaggagtttttaacttaagataaaacctagaatagcttataataattaatataaaacaggggggggtatatatatataggcttcagcgtgttcggtttggaggatcagaggagcttgtcttactaggaccatcagcaggtccaaacccgagccagatggtgttgtccaaggcggcaatatatggggcgtatcacgtatggtccagacgtctttttttcgaaaatataatataaatgcacactctcatatacacgtaagtacgtacactcatatggcaaaccaaacacattacatcagtcgcaggggaatggggtcataggtccagtaccaaatcagtccatgtaaatgcaagttctgcagttagtgtccctgaaaaaagaaaaggttcccgtaatttgtgatattgtaagcttgaacccccaaaatgctgcatgtttccacgccaaatttgatgcaaaaatgtcacaaaagagagcgcccctaaatcttcccaaaaaaaattttactcaacataaatgctgaggctatgtcgaatcatcgcgaattttttttatttataatttttttattaaaagttttacaaaaataattttccattttgaaaattgacggaagtagtcgcctaccgccctctgggagggcgatttttaaaaatcgccctcccagagggcggcgaaaatgacgtggcagccggcc

SEQ ID NO: 9545 - DNA, 1501 bp, Oryza sativa
gttttagggattacctagtgaattcgatatatagtcacttcgtggatttcacattgttgtagtacgttttcttagttacataatcccccccctttttattttttgaatcgctacatgtagtggctaatggcaggaatgtctgttccattatttagaaaatgtttcctcctgttgatcagaacattgctatgaaattatttgcattttattggtgaatcatcatcttttatcagtgcatcgatcaagacgcctacgctagagatacctcaccagagcaccattagagtgatgatgttgccctttttttacatgacaaagtaatgcttggatggctcttctgcatgcctttcatttttctcatgcttgtgggggttctgatggagggatctcggagtgaaaggattggctctatatttccggatgttggatccttgggcaactctgtgctgtattgcttcctcatctcacctgctttaatcctgcagacctggaggatgaaataggtagtggtggcatagttgaggtatctgtcctttactttggctttctcattgtttatcttccatataatctctttattttacgagcattatatatatattgttatcctactgattatggttactagctctgttgagtaacaatgtgcagagaattcctccacttttgcaatcctttgtccttctactggtaatcaggaaataagaactcatcgcggttccttaaaattgcaaataatggttctacttggtaaaatgtgctcagttgtagtcttgagctatttatatgctggccctattatgaatatacaaaaatttgggcagtgctattccattgcattgaagcccaaccaaacaaggccgaaaggacatttcgttcatagatatcctgatatccactagtgctcactcaagtgatatgttatacaggttatctaacaagttggctattttactaacgaagaggagagaagtgctacaagaagctatgtgtagtccattcacatttctgaaggttaatcactcatccggccatcccaacacatatcgaacttgcgacagaagatgtttctttttacagagtcgctgcttcttcgatgcctagtaatacatcttaattctcttaagggccctattctgtgaactgttactatatatatatgccccatcactaattgttctagtgattatacttagtactcacgaatcacgatgcatattatcttttgatattctgctgtatggtgtacatactgtgcttggaggggggctaatgactcataattacatgactgtatatatgtcaatatgcttattattatccttttctaggaaggcatatctcttgagctgaaatggatttggcattatgatttatgaacatgtagcagtccatctcacatctatttatcttcagtgaagctttggtgtgatctctaaggttatttattatgtctgctgaatgcttgcttctctttcttttcccgttggttgggctgctg

SEQ ID NO: 9546 - DNA, 503 bp, Oryza sativa
ctggcagatgcatcctccttttacagttttgttttgctgcgagaaacgcaaaattggctccgacatacgtgttgaatggtccgcaaaattggctcctcacccttgcgcagatgcatcctccttttgcagttttgttttgctgcgagaaacgcaaaattggctcctcacccttgcgcagatgcagcctccttttgcagttttgttttgctgtgggaaattcggatttgttttgttttggaaacaatccgaaaaatccgaatacggtgcgtaaaaacggcgtggagtccggataagttacgcgctacttatccggttcggttacgcggagtagagatcgtgcgggcgccctgatcaagcgacctatctctatataaaccgtgccaccgccttcacacaacgcacgcgaaatcaatctaggatttgcctcctactctgtgctgcgccgtcgctcgtatactactccatcccgctcgccgacgtgcaccggcgatcgggagagcagg

SEQ ID NO: 9547 - DNA, 1501 bp, Oryza sativa
tataaaacttattgtaaaaatgtgcaacaataacactagccttaaagtttaacatctcgataccaaagatctttggcactagaaccctaaaacactatgtgaaaccccgcgcattgctgcgggaatttagtatgataacaataaaaaaataacgtgtaaaaaaataacgtgtaagatagctagataatatcagtttaagtaaattaatgtggtttatgataatttaaatttaaatagtatgtagaatggtgattcaaacgtaaaaagtaaggtggtatgactttatggaagaagaaaagtaggaagatagtttggaccgtagattaattatctaaaggctaaaaacaattgatgtggtatgacttaattagaggaaaaaatgagaaagataatttggaccataaattaatcatttaagcactctaactaagtgaggatgaattatataactattatatataggatatcataaaacataataaagatatacattgaaatattatgtgaattctgttggatgataatttaacatgtttgtatttgaaaagctctttaattataaaaactataaaatatagcatgtttgcatgatgtttaaatgtgatgattgttagtggatgatgatgtggcatcttgttagtggatgatgatgtggcatctttgcatgttaagcttaaggagttagtggggggtaactttatcagaaaggatacagcagtgaaattacagtggacaccgatgcggcataggacgctgctaggttccttggtgcctagggtcagcattggcattgacctccaagaggggaccaactcccctctatctcctccatctagggatggcaacggggccgcccccgcccccgagtgaagatgcggggccaaaccatcccccgcccgctgcggggacctacaacccgaccggggccccgcaatgtgtagccactccatccaatcagcaaaaaaaaagatacaagataatcgctattcagcgagaacaaatattgtacatacttcacacatcatcaaaaaagcacgaatacttggataggaccatcaaaattcagtaagaacacagcaagaacacaaatatttctctatgtgaatcctctgctcgcccggcgcctacacagctccgatcaccgtgaacccaagcctgcgcgctgctcgctcctctgcgccatcgcctcctctacatcgcggcctctgcgccaccccaccgcctcctttgcaccatcgccgccgcacctgtgccgggtggataccggagggaagaggaggggagggcactggggagaggttgaccggaggggagaggagaggagaggtcgaccgaaggggagagcagaggaggggagggcaccggggagaggtcgaccgaaggggagagcagaggaggggagggcaccggggagaggtcgaccggaggggagaggtgagactggcgagtggcggcggctgtgactgaggagggagagcgtcgagagaaaccgcgactccgt

SEQ ID NO: 9548 - DNA, 269 bp, Oryza sativa
aagttgtatgctagggtcggccatgatttcatcaacattacggccgcattggaggatctggccaggactctctaccagatgatgaacaagaggagcaaaaaaagatggtgcttcaggagaaacaagagcaggagaagaggaagcaagaagagctgaacagggaaagggaggagctggagatgatgcctcttgcctgcatccctctaggccatggggagatgcagtgggaatcgccttgtgaagcgatgcaccgaaggttcaaacttcaa

SEQ ID NO: 9549 - DNA, 1501 bp, Oryza sativa
ttcagtattgttcttcttgcccccataggtttggaagctagcgtttgataaataataaactgagttcgggaatagctagcctacagcagatgagaaaaaaaacatatacaaccattcagctcttgccactgactttaccattaaccttatcctattggttcatcgtaaataaatatactcctattttctgtcaggtactatcgtgctgttttacatgaggtctcaactctcaatgcactgaaagtgaagcattgtgcaaaaagttgccccactatcatccagaatttcagaccgcagtttgtattgcggcaatttcccttctttacatactattgtttttatctcacaaagtgtacctagatttttaaattctatttcaatacaaatatcccgcagcaacgcgcggggtatcattcagtgttatatatatgtgtgatggagtcaagataatatttaactttaagaataatacagacaaaataatatatgctatgtattgattgctattttgtgtttgcaggtaaagcatgtaaataggccctgtttgtgcatttgataaaaaaaaaaaaactgggttgtgtgccccatcaagatcttattattctctttcaaaattgtcaatgtattagtaaacaaacaaaaacaagcagacgtttgggcgttcgtttataatctaaatgcttgtcatgcgtattttggattgtaacaattttttacagcgtatatattgtacattaaaactactaatatatattgaacataatttatgtgttgcatgtcatgagctcatttcgattctatccatgtctacacgcagcgtagcgcgtgtctattgctagtttagcaacacgacaacataatgattcgttgatgcatgatttattaatattaactattataaattttaaaaattgatttatttaattttttaaaagagacttttcgatattttttagaaaaaacatactacctctgctacggaatataacggttactaaaattggctagaattaatagagaaagattgtgattggataagaattgaaagtattgtgtgaaaattaaatggtgaaatgttgtaattggttggaaagagtgttgatgggaaaattgttatattttgagacaacctttaaaaggttaaaatcgttacattttggaataaatggagtgatatttaacggatcgggaaacgtgtttatggaaaataagaaaattatcgtttagagttgtagtctgagttcctatcccatctcatagacgtctctcaatagtataatagtattatcaatatggatagaggtagtaatagcctaactggtacaatcttttaattatactagcaaaatacccgtgcgttgcaacgggtgaaaattggaacatctttaatgtaatggcccaacctcaacgatgacaaccttaccgatgcttgctttacctaaaataattggattattcacgcgacaacatacatacatatacatatatatgtactagatgt

SEQ ID NO: 9550 - DNA, 1501 bp, Oryza sativa
tgtagtgctggaatccaagtatgacggcctcagctgcaggaaaagagagattcaaagtttcaaacccatcaacatcgtcaggaccaggtgtgagaaccaccagagtgaagtgaccacaaactacaaccaaccaacacaagcaaacctaggaggccgacatcgacatcgacatcatcaatgctgcaaatctatacggctaagagaacataaatgccacaaagtacagtggatgattagcagctccgccatcaaaatcaaaaggcaaagatggccttggtgatatagagagagaatcagagaagaagaaattaagagacgtacgccatggcggtgggctggtgatgcagtaggacacgctgggcagctggtccttcacctggtgaggctgcaactcctcctgcttcggcggcggcgccgcccctcctccggccatcctccaccacctccaagaacccaacaaaaatgggacaaacaaaggcaaaaaagaaaagaaatgcaggaaccaagaacagggagtccaagaaccagaacagtgcagtgaaagcacaaaactcagagagatttcagagagcagcaaacaaaggcggctaccgattctttgcgtgcaaagaggagcaagaacaaaggaggatgaaaagaaagggagacagctacagctgctgcttcttgctttctactactactcctcccagtgcgcagtggagtgaagcagcagcagtgcaatgcaatgcaacacactcgcagctagcagctactacctgggtcgaaggaatctacaatgctttgagcttttcctccctcttttatgtttcccttcttttctctcgctaccagcaatgctttttttctctggccatgggatcggagtttcgcctttgcgccaccgcctccgcgaaaaacgcgccctccgctcctcttcccaagttgttatctttttcccaccaccgtaaaggagatggcagagagaggaaaaaagattgcaaattccacaatgggaagaagttcgggtctgtttggttgatatcttcgggtctgtttggttgatatcttcggtatactccctccgtcccaaaatataaacatttttagctatgaatatgtctagattcataactaaatattgtaacattttgggacggaggtacttcctccgtttcacaatgtaagactttctatcattggtcatattcatatatatatatatgtatttagattcattaactatctatatgtatatagattcattaacatctatatgtatataagcaatgctagaaaatcttatattgtgaaatggagggagtagtattatatttaaggttagctaggagtatgtcacaactttttaaataactatttggttcattgtcacaatagtctcttgtcaaactttttagacacatggacttccttgtcattgattcaagtttttaaccaaggttgtgtttagatctagtggttgaagtttcgtcgtgtcacattggatatacgtgcacatatt

SEQ ID NO: 9551 - DNA, 1501 bp, Oryza sativa
atgggcatgcaagagacagcacatgagtgatctttggtccattccagtctaaccaaataaactaaatttcattttctttaattatctgcaagccgatccaagcacaactctagccattccacccattttttttgtaatggcctaaaatttgagtaatcatttgttgagttaggctttaagcacaatctaataatcctgtcacctaaacttgctttaaattgtgagagatacaactcaaacttagatttattacaatatctattatatactaaaagtccattaaactttctacaaacgctcctaagccgccacatggcgctcctacaaatactcctaggctgccacatggcactatctaatctcaccgtcgattttcatttaaattggtgtacctgttaatttagaccattagattagatctattattaaaaaggtgatagttttttctaaaaaatatgcaactggtggctgtgaaaaggaaagaaaactaaatattcgtacgcaagtataattgaaaaaagaacaaataaagcttcctactgttaggcggaagaaaaaaaaaacatctgtgtacgacaaaaaatgataaagccaaaaaaaatgtgtagttagtaccggtggaaaaaacgacggtctaaaataggattttgtataatataaaatataattacataatatacggaagtatatgatctatgatataaatatcaaatatcaaatcaacggtctctaaacattatcttttaaattatttttcgtttaattatatatagtatcggtgtataaaagtaatgttgtggtcctaaatacatcatgacacatcgggtcgacatataataggtaacgttagagacctattaaacgtgctacaaacgcttctaaatagtcgtgtggcactcctacgaatacttctacgccaccacgtggtgttctagtaaattagagaaaaccttgtaaattatgagaaaaaaaacatccaatcatttttattggttgacccactatttttaaactactagattagatttatttataattcatcccacgtaacctgctcgaataaaaaaatcacgtgaatagttgcacgtatatatacatacttccatactttgctactcactgaaaaaaaaaagaaaaaaactggggttgaaaaaaaataaggtttagccctgccacagtcccacctaattgttacgagtgacacgtacatatgtactgttcacccaaaaaagtgaaaaaaaaatctcaaatgtacaatacgtactactgttcactggattgagaaaaaaattcgcccgagtttgtacaaactacgcgctgtccttcactccttgaatctttatacataaaatcaatattcacccatcctctaataaacttatctaaataataaatagatgtatatgggaaaatattatgattacatttggtattaagtatattttaatttaaaaattatcacattgaagcatatttagagctttgtccattaaatatcatg

SEQ ID NO: 9552 - DNA, 1501 bp, Oryza sativa
gttagtgacaaaaatggggtggtcgtcactaagatcaaatacagatcgtcataaacttgtctaatggtgtattgtgactgttattattttgtcatcagagaccaaccaacaaaagtcacaagttcctaacaatgttcgtttatcatacgtttttttctttttaaaattgatgaatgcttgaactgccctttgtaacgccctaaataattgtcacatcctgataaattcacccaaattaaaaattgttctctaaaatgaataatataattaactaaaatcctaaaagtaaatggcaaacactaaaatacatgtaagaaaaaatttgattgtggcccaaagtatttttcataaattctcctcggtctaaaatatgtcctggatgtttacttgaattttcaaagcaccgaaatatttactaagcaacaaaaacaattaacagaatttattaaaaagaaaaactaaaaacaatcctcttttgtcatttgggccaaatccgtaccaaagtctgattcaaattcccgccagcccgctcggcctttttcctcctcccattcccttccctctccctcctttctcccacggcccacctcggcccaagctgtgcaaccctcctctactcctccatgggccgcgggaataagttcacgttaggtccctctatttgacgcctagtctgattttcattcctgaaccgaaaaaccgggtaggactcgtcccccaacttacgaaaaccaggcaaactaggtccctcgacagttttgatagcggttttagctaatgtggcgcctacgtggctaatttgactcggtcttcatctgacatggcactgacgtggcaattcattcccgaaaaataataaaaccagtgggacccacatgtcagttcacacacaaaataataaaaaaatggtgggacccacatgggcccacctgtcatcctcactcctccctcctctctctctctatcctctctgtcccctcttctctctatcccttctctctctccggccggcaggaacgggcaacgggcgggacggagcggctggctggcggagcggggcggggcagcggctgacggcgggctaggtcaagtctgcggtgcgcggggccatagagcgcagacggcggcgactgccagtggttgtggagaagggcgtcggcggcatcggcgggagcatctcctccggtcacgcctcattccccttctacgccaagattgagccactgcgaaagaaggcacacctacttgaccaggagaacaaggctctccttgccaaggtcaagctcaataacaagccatccgccacctccccgtcctcccagaaaagtcacaagctacgctcttggccaacggtgagaggttgcaggctccgatccatttcagacaaatacaaaaaataaacttaaacctatctagcaccacaagctacatgctccatcaactgcaaaaaaaaacaaaaaacaaacgacctaaaatgctcaaatcaacaaacgacacaaaa

SEQ ID NO: 9553 - DNA, 1501 bp, Oryza sativa
atgtctatgcactatcccccaattcaaatcctctgctgtgctgcacatgcagactaacatgtgggccacagggtctatggggcccacatatcagtgagcagtactgtatgtgcagtactgcagaggacccttactcgctaaacccaccctcagtatttaaactttgtgctcatgcaacatggcgaattgacatctttaacatgttaacattgcactaataactacaccattgctttgcattttttttagaattcgtatgtacgtgtatttgtttagttgtggagggattatggaggattggagggcatgaggttgatcagagcagtcacaaatcctgctgcaaatgaatgatacccagatcctgacttatgtgttgtaggaggttgatattgttgtactgtgttgcggtctctgatctatataagtggattgggtaagttttgttgcaaaattatgcaaccacatcatcaaaacaattttactggtcagatttctactctgttacgagctgttggattcacagcatatgaaacctcttccatatcatgtctctagtgttgatagaatagtgcatacattaccagagcaggatggaagtgatatatggatcttcttctatcgtggtctaaatgtatattgggcaatgggcatggatacaaatagatgttctcaaggaacaagtacaatacactttgtgtgaactaattggagaataataattacatatgtttcatacactgctagtacaagatgtgaccgacttttccttgctggccgatggatggctttttgttgttgagtatgatgggtggctcgacatgtgatacttctagttgctcattactcattcttttgtcttgatttagtcctaaaatttaaatttaaaggtctaatgtggtactccctccgttcatctagttgacagctattttgaaacaaataagtgagcttggcggttaaagtttgttacgtgttattggttgttagacatgacacgagatttgcttggtacgtgttaatgcttgctacatgatatcaagaaatacggcgcattgcacatgccctacatgtaaactttgtgaaagccattcagaactgatcaagtttgtttgcatgacttatatcatgctgctgcaggatggcaacgggcaacatgttataaataaacagtttctctaagttattggttgagaataataataagccatatgtttttgttttagagggtataattagcgattggagagatattggaggaaaccaaatgataaatttaaatttggggtgtgtaatagttggtttgccagtagatgataaaaatagttgcgttaatgtcatctattgagttgccagtagatgatagaaatagttgcgttgcaggtgatctgggatcatcctagtcttgtacaaatgttgccatgaaagatgtggtcgctaagtatacattcaacaatcatgaactagcgatctatccaaacaagggggctcgccaagatcgcca

SEQ ID NO: 9554 - DNA, 1501 bp, Oryza sativa
ggcttcgaccaacaggagtagggttgttaccttcctatgaaggggcccgaacctgtataaaaatccttgtctctatctctcttacctcaatctcgcatataccctggtgccagtgatccctatatcatacaaataccgtagtcgtgacctaaaatgacaacagtggcacgcctggtaggggattttggtgcttcaaggtttcagcgagatgagttcaagagatggattctccgacaacaaactacttgacgacttcggctgtacggggatacgactcgagcgaagtgcgttctccgacggattggagccctcatcacctcaagttgattttacgacaagggatacttcaatgacttcggctatagggggatacgacccgaacgaagtacttcccccgacgagatcggaatcatcatcatcaacaatttgatctatcaagaccatccaaacttcaagacacgtggcgtaacaaaagatatcaaattgtatgatgtcgaacggatacgcaacatggtaattggtagattggttttctaaattaatctgctaattttgtagatacatctagcatgtgtctacaaagaaaaaaattttcaggaacaattgagcactcgaataggttaaggtcaagtacaccccataatcgagaacgttctcgacaaaggccgagtggtcggaccaaacctaccaatgaagaccgacgacttatctcatgtatagcgtcggccatggctggactatttgagaataggttgttaacgaataattcctcgcaaatgttgtcggcttgatcacccgacataattgtgaacgcacatctagatatgctacaagttgggtatgttagtcatgctggccacatgagatgcacatgtaataaccaactctagcgcccctattggtgatcgagagatgcctactcctagttcttgaccagtagattgtagcgatctcttgccacctatcaattgccttcaggtgatcaagaaatgcctactcctggttaccgaccagtcgattacagcaatctctaatcacctaaaagttgccttcaggtggtcgagagatgcctacaactggtttccaaccagtcaactgtagcaatctctcgtcacctataagttgttttcaagtgatcgagatatgcctattcctggttattgaccagtcgattgtagcgatctctcgacgcataacacagcaaccgacgcagttgtgataacaacaaccaagaccgataggatcgccgtagtcaccaggacgacaacgtccaagtgtaggatcaaggaggccgactagaggggaggtgaataggcggtttttaaaacttttggctaaaaccgagttttgcatgcggaagcataaatcaaaatggttttgcacaattcaaaatctaaatcaactagtctcaagtaagtgcacaaagaagctagcctatgttgaggtttgcaccctaatagcacaaataaactctagtatgtaaacttgctcaaagtaaatt

SEQ ID NO: 9555 - DNA, 1501 bp, Oryza sativa
cactgcgcagtccatggacgccgccgccgcccccgccgccggccggccggcggccagccgtcgtctcgaacaccggtagctagctagctaggctagctgatctgagcctggatctacagctagctagctagcaggggaaaaaattgccctttgggttacttcaattcaagctctctctctctcttgtttggaagggtagctagcttagcttcttgccaagcgatggcagaaggtgaggttggatttgtcatctaaccatccaataataataatgcaataataattcaataataacttggctgatagcaacaggcggttacaaacaggaactgatataatgtgatttggacgtgtcttatattatcgatacgatgcaattttttggatgactaaggatatatacaaatatgaatgatatttttcaagttgtagcaatggggtagtttgaaataaaaaggatacattgagctagttgggacctcatgagatgcatgaaatcacgacaaaccgaaaaagaaacagctaagcattatacatcagctgacaagtagctatagcagcgctgtagaaaattgcatacaccaaataaaaggacggctatgaatacatgctgcacaggaggtagctttaatcgacggtcaccggtggcagtgtgaattggacatttgggacacatgatgagctcatacccatgtggttgtaccccggctgtactgtatctttctttttctgtagactactggtagtaaattagtaatttgttaagcaaagttgctgaatttgtaacgatttaggtatgacctgtactaaaagaatgatttctcaatcttttttctcacaagtactgataagaatatgcttatcagtacttaaaaacatcaccagataatttgtactatattcttcgcatatacgatccctatataaacatttttataattcaaattttatacgcgatactggttctgatatacgggaattcaaacatttcagtcaattaggttcttaattaggaggaaaacccaagcaatttaaaatttggcaaataagattttgttgaaaaaattctacgggaatccttcttttccttcacttttttggtggatttttagcatgatctcaaatctcatgcatggtttaaattcctttaagaaatcggaggcaccatgtctttatctatctgctcaattagtctaatgatatttctcctctaaaattcgtacgagtttcccgcggagtatctaaacaaaattcaataaaatatgttttaaatatttatgtagaataattttatgtctctttaatttgtcgctaaacgggaaccacgcgtgatgaacttactatagcttatcatgtgacgatcattggcaaaatatatatggtcggaagttcatcgacggcgtgtcggcgagaattaagcagacagacattggctttaggctttgtttagttgaaaaaaataattaaccagcatgtcacatcggaaatacggatacatatt

SEQ ID NO: 9556 - DNA, 1501 bp, Oryza sativa
taattaaccagtctttggcttggctatagctgtgtagtcaccatctatgtaccttctttttaaccaacttgatagtactgcttttttttttccccagccattattccatccttttcgtcaccggcctcaccttttcttcccacgattagagatagcaccccagcaaattcagcttacctgttactctgagtctctgggaggttggcaaattgcaactttcttgacagtgagattcatgtttagatatcaaagccgccggaaagagagggcccggccggctaaatcatgtgtaaaattaaagtattagcatcccaaccaactcaaattagcctctttttaaactgttctgctgcgactattgtcgacatcttaagataaggtcttaaaaaaagcaaatttaaacactggattgcgtcacgctatgtatatgttaattgctgggcttgcaccgcctcaaattttccttttccccactgtttttgtcagagtgaactttatcattattcactcacaaatttagttggactgcgtaccctataaagatctctatctctactataaatgcgtaagaaaatgaagggttcctgctccttggaaaataatgaaacaatatgggctccgtacgctggggcctttgagtttcagcagttttcaattatcttgacatcatatatgagtttttctcttttttgtttttgaaaaaaaggacatcggatcacatgcgtactcaaccaagagagactagtccgttatcaaaatgtaccacagaactttgcaaattggtttttttcttaaaaaaaagcatatgacaaacatacgttcacaacacgcgcacggtcgtccctataaatatacacacacacaccttacccctatgagcatctctaaaaactgtactagcaaatcttaagattgacgaagtcagcacggatgtttcgttgtcgacgtatacatcggctaccactaaaagaaagctgtaaatgttgagcacgtgtaccaagtttagaacttgatcgaggtgggcggattctactacaagaaactaactagtggagctgtgctcacttcgtaaaatggaaaatattctgattagctgcagagtgtttcattggaaaatctacctaggcgactgaaatctttttcagaaaggagaaacttttgcagaaagagaaaaaaaggaaaagaaaaaaaaagaggcccgtgtagtcaattgaggcccagaacacatggaaggcgaaacagagcccacaatggaggcccatgtggtggcctctatatatcaacccatcacaaagctagggtttttctccccgcctcgctgcttcgcctctcgttccccaaggccccgaagccgccggcgccgccgccctcctccggttcgagctctccgccacatggtgagtagcgacctccgaaaccgagccacattcgtttgctccgctatgctctacccgttccgttgtctgacgcgatgccgcgctttgttttttttttgtgtcgc

SEQ ID NO: 9557 - DNA, 1501 bp, Oryza sativa
cactttcacaaggtcagtgatgcattcaggtaggaacaggacattacctccatcaaaactaactccttaaggtctaacactgtgagaattggagtacataaatctagtacagagcactgatagtgatataacccatcaagacatttggaacacagtttactcttaccagtagcttaccaagttgcatagaagtcgactagtacaggcttttcagacttctccagtaactcgtcaaacgaagagaacgtctgtttcttcgcttgaacctattcaaataaacatacaaacaatttttagaaacggaatatcaatattatgttaacagtaactatcaaattaattagaaagacatccatgaatataagcacattgaaggattggagaaaatactgatttggattgatgatggttaataaacctatgatgaatatctggttacacagcattacatctaatcatatatagttacattcatgaaagatttccaaccgatatgggtccgcaacaggtgtggttagcaaaaataaaactaagtctaaaaatattcatgacatacagccatcaaatcaagtaactgatgctgcacagtgatatgtgaagaaatgacaaatagtagggacatcaaattgttgactcaattattccacgggcaatagaagtacagaaatggtggctttggcttacactggtcccagaaagactgaactgggaccaacaaatctattggataactcatagccccaaatttcacttcgttgtcatctaaaatcgatccaggccagatcaccacagcaacagctagtacttgatgcagcgaaatcactacgaaatgctgcatcaaagcacggcaaaccaacgagcaacccgaacgaagctgcaacagctagtacttgatgcagcgaaatcactacgaaatgctgcatcaaagcaaggcaaaccaacgagtaacccgaacgaagctcgcggggggctcacccgcagcgtggcgccacggcgggacggcgcggccgctcgccgaagccccgccgccaccaccaccggcgcggcggagcggagcggcgccgccgacgagcgcgcgacgagggccgcggggcggcacggcgtgggcgacgccgccgcggcggtggtggtggaggtgaaggccgccatggaatctcgcgcgcgccttctagggttttgtggctggcttacccttatcccggcgattcgggaggaagaagaccaggtgcgccagcgtggtgcacccggtccaccacgtagatgcgtggactggttttcgtggaccgagtccacggtccacgggccagcagccaccaacctgcctggcccacggcccactacctcctctgcgcaaccgaagcaaggtgacgcatccgatctccgcaccaaactcctcgtggtggtttcgcagctctcctgcgagcgaattctagggtttgggaggaaatccaatccctccaaatccggattcgttttggaagacgttttggaggaggtagca

SEQ ID NO: 9558 - DNA, 1501 bp, Oryza sativa
gaggagggcggcggcgccggcggcttcggggccttggggaacgagaggcgaagcagcgaggcggggagaaaaaccctagctttgtgatgggttgatatatagaggccaccacatgggcctccattgtgggctctgtttcgccttccatgtgttctgggcctcaattgactacacgggcctctttttttttcttttcctttttttctctttctgcaaaagtttctcctttctgaaaaagatttcagtcgcctaggtagattttccaatgaaacactctgcagctaatcagaatattttccattttacgaagtgagcacagctccactagttagtttcttgtagtagaatccgcccacctcgatcaagttctaaacttggtacacgtgctcaacatttacagctttcttttagtggtagccgatgtatacgtcgacaacgaaacatccgtgctgacttcgtcaatcttaagatttgctagtacagtttttagagatgctcataggggtaaggtgtgtgtgtgtatatttatagggacgaccgtgcgcgtgttgtgaacgtatgtttgtcatatgcttttttttaagaaaaaaaccaatttgcaaagttctgtggtacattttgataacggactagtctctcttggttgagtacgcatgtgatccgatgtcctttttttcaaaaacaaaaaagagaaaaactcatatatgatgtcaagataattgaaaactgctgaaactcaaaggccccagcgtacggagcccatattgtttcattattttccaaggagcaggaacccttcattttcttacgcatttatagtagagatagagatctttatagggtacgcagtccaactaaatttgtgagtgaataatgataaagttcactctgacaaaaacagtggggaaaaggaaaatttgaggcggtgcaagcccagcaattaacatatacatagcgtgacgcaatccagtgtttaaatttgctttttttaagaccttatcttaagatgtcgacaatagtcgcagcagaacagtttaaaaagaggctaatttgagttggttgggatgctaatactttaattttacacatgatttagccggccgggccctctctttccggcggctttgatatctaaacatgaatctcactgtcaagaaagttgcaatttgccaacctcccagagactcagagtaacaggtaagctgaatttgctggggtgctatctctaatcgtgggaagaaaaggtgaggccggtgacgaaaaggatggaataatggctggggaaaaaaaaaagcagtactatcaagttggttaaaaagaaggtacatagatggtgactacacagctatagccaagccaaagactggttaattagtcaatgggtgactgcttaattgctcagggatatctgttctttgattaatcctggaatctgactgcttagtgtgacctttttttttctcagtggatgcatagtgccatgtgtgatatatactcacta

SEQ ID NO: 9559 - DNA, 1501 bp, Oryza sativa
ttcgttcggaaagtctcccgcaatcctcgccggcgccattgatggagtccgagatttccgcggccgattccttcctccccggccgccctctctccctcccaaccctatttaatcgctccccgtgcctctctcctccgtttccgccgctcgccgctctctctccccgtcggaatcaagcccgcgccgtcgtcctctctctccgccgtcgccgccgagctccggttcgccgccgtcgtcgccccggacctcctcccgcttcggcaccgcctccttcggcttcgccgcgtccttgccgacctcgtccgctcctccgtttcgcccgccgaccgtcggagcgccgccgtcctcgtcgctccgaaccgcgccgccgcctctcgccgcttcggtcgccgtttccgtcgccgccatcgacccggggtgagctgtggaccgctcctttcgcttcccccttccctcctctctctcgggcgccgctccgccgcgtcggtggtcgccggcggcgaccatcggggcgcgggtgcgccgcctcccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcacccggtccaccgtggaccgagaggctgtcgcgtgggccccactcccgtggacccggtccgcgcgccctctctctcggctgacgcaataaatccaattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttgtaaaattatgttgatttaaattattgcattatcgctttatttaaattcccgcgttatcactgttttatctagccatacctatttacctttgttatgaccttattattattgttattgttattattaccttgttcaccctaggttaaacaaaaccccaactagtgagtactctattcatggttccactagtatgaatttaggtagatgcttcgctgattaaataggacaacattaggtggtttttataactttagactttgggaattctcatatcatttggacactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 9560 - DNA, 1501 bp, Oryza sativa
aggcgctgcgctgtggcggggcgaggcgcgtctgctcagcggcggcggcggcttccgaagaggtggcaacgccggggacaggaaaaacaggggaaagggaggggaggtggtgagggtggtgtgggaagcaatggacgggccggggggggggggtttatataggcgtggggagaggtggtcggcctgatggcgatgggacggcgcggcgcgcggagagtgaggcgacggtgcggggctcggagcggcgacgcgacgggcgggcggcgcggcgcggggctcggcgtggctcggcatggggctcggcgcgacgggacgggcgggacggcgacaggcgagtggtgcgcggcggcagcaacgggcgcgcggcggggcaggggcgcggggccgatgagacaggtgcgcagcgacgggacatcggcggcgaggacggctaggcgcggtgtggcagaggagggggaagggctaggggaccacatcgaacacctaggggctaatgaacagtgactttttcctatttatccaattttagggcatatttcctattaaaacttgtcccataaattctatatttcacacaattgatgtttacccaatagatgtgttaatttagatgaaagtttactcaatttttaatattacccatattttatttttatatatatttttctattgcattatttaaatgaggtctaattataaaattaacctagataattttggaggctttgagggttctaaaattaattaaaatatcctaatgtggcaattattattgcaatagcacattgaatgaacttatttgtataacaatgcattttatgtgggtctattcattctataaatataaattgagactcagtacaacattaacctaattgtttaaattaaacactcacatattcttatttatatataaagcttaatttatttatatgaccattattttatatgagtgattttcatgtcatgagggactcggtgaaatgttctaagtatcaatctatatattccggtgaatttcttatttttaaacacgatcattatagtggtgatcatcatttcatgtgttcttatatttcatgtgagattggattcaaatgaattaggtttgattttactgtttcttttagctaatcatggcatcaagctatcagcatggttcgaatatttaatatttgatctataaattaaattagtaattaaccttccctttgtttggatttgctttctttgtgattatttacatttcggcaagcaatatcaaccataacaaccagcatgatgcaaaagttttaaaaagttcaaaatttaagtgatttttattgtcgggaattttcaggatgttacaatatgatgctagttttattcgtccttgtcgatatgctgagtgggtttctagcatagttcctgttatcaagaagaatgccaaggtgagagtgtgcattgattttagagatttgaataaagctaccccaaaggacgaatatccaatgccagtagc

SEQ ID NO: 9561 - DNA, 1501 bp, Oryza sativa
cccttgtgccgctgaccggtgggcccacttgccggcgccgcccctcccccttgatgacgtcagcgaggtccatttcctttgtaaaaataaataataattgcgcaataaatcgagtttaattatagaaatttatttaaatggctcaaaacttctaaaattcatatctaattcattcggactccgaattgagccattcaacttgcaaaattcatctaaaattgagctctacatgtttgtttagtttttatatactgtttccttggtttttattagagtttttcctcattttgcgtgccagcgtgtagaatccgtcgtttcggaagtccgcggtcgcgaggaaaagagttcggaagatcaaagtgaagaagcaaggcaagtcacacattccccttgagcatgttgttcccaatttataaatgttttaccgtttgcaaataaatatgcatgttttgctaattacacgggatcagggtttacctatctgctcgcttgtgccatgtttacttgatatctgtcctttgtcagccgtgggtaataaatcgcctagctggtgttactttgatgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcaccgatagcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggtcggccggggtgtccggttgtccagttgccggattcaccgcggcgcaagaggggaccgcccactgccttttgaggggtgggggtgaaaccttagtgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtccaggtgggttggttgggcctgttcaacgtggtgtagcgttgatcagtggagatttaatgttactttaattactcaacagttttactgttttgctcaataaaatgttttacaaccgccttgatgcaaatagccacaaacccctccttgtatccccttgcacgtccgcatcgttggtgtggcttgctgagtacggtggttgtactcagtcttgctattattcccccttttcagaagtgtagtgcttctgagctgaagat

SEQ ID NO: 9562 - DNA, 1435 bp, Oryza sativa
aggtgccggaagaggagcttgtggaggagtcggtgtaggagcccgaggaggagtcagtgcaggagtctgaggaggagtcggtgcaggagcctgaggtagagacggtgctagagcatgaggaggagacagtgcaggatcctgaggaggagatggcggagccggaggagatggtgcacgagacgccgcttgtcgcccagggaggatgatgtactgcctgcgccatagaataatggcatggcttgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccattgggatggccatgcccgacgccaccttcatgtggtgagagattatttattagtaatcaacatatataagcagcaactagcggaataggcaaatctaaaatatataaactacgagcttacctttattgataagttcttgaaaggaatatgcagctcacatggtgtccgttgagtgatgtcatcaacggggcaggtggattcgtcctgggtttgcatggcgtccatgctctatgatcctacttgccccgttgaggcgcagctgctacggtttcctgatgggctcaccattgcaggaggaatggtcggctggggatcatgggaccgatgtgcggccatgcgttcatcaaccttccttgtcacctccttttgcatgctgcgctcgtagctcgataccctgaactctagatctgcaattttcgccttggtatctctcttgcgcctcatccgactcctgtacgtgtggatgtcctccttgaacccaatcttccaaggaatcacccctttcccttgtgttcgtcctggatgctctagagtctgcagggcgagtgacagctcgtccctctctctgtccggtcggaacgtgccctgagaagaggcttccactgcgtctgttagtcgacgcgcagcctctcgatctgatcaccgaagaccagtgagccatcagctgggttgagcgttccaccatgagcatagtacaagaacttcgatcgttccagccaattagcggtggccggttcgatacccctctcaagcaagctagcctccatctcctcccacttcggcatcgcgacgctatagccgcctgaccccaagtggtgatggtacttcttcttggcggcatgttctttgattctttccatcatcgcctgcccttgtacacctgtcttatatgcaacgaactcgtcccagagatcccttagctttgggaatgtgtcgaagttctgtgtcttgcccttcaggatatatttctgccattgtcttcagagtccaccttttcactttgtcctctgtacccgcgggaagggtgaatgtctcgagcattgtggtccacagca

SEQ ID NO: 9563 - DNA, 1501 bp, Oryza sativa
ttatttaaaaaaaatttagaattattatttattttttaacttactttattatccaaagtaatttaagcacaacttttcgttttttatatttgatttaattttttgaataagacgaatggtcaaacaatgtaaataaaaagtcaaaatcccttatattatgggacgaagggagtagaacacaagtgcggtaatgttttctttttgagagagcgtatttttttaaagatgcagagtaaataattcgtgacaacaatctcggacaggttgatccgataagagacgaatactttgagcatttttgctacttctttcatcctaaaatagattttagacgaatgagacacattctagcaaaaaaaaaatttggacaaggtcccatccattcaaataccctatgggatggagggagtacctggcggcaacagtagtggtggataacagaaactaataatacatcatcgttgtcataatgtatttagtggtgtcataactagtagtactgaattactaatcatgtttgaacttgcaccatactatatgtgggttttgtccaggtcacctgacctcaccacactgtagatcccctcatgtttggctgtcatgctgatttcgtttaatttacttatggtctaggtaagttgtgttaaggaaccaagctattctactgatgaacacaaaaggagataaacatagaagctatggaacacataaagtatggacgagtagaaactttatttcttttgaatttgagtacaagctaaagatggaagataggtgttggagagagtagttgtcatcgccttcgacctcggggtcctatttataggcggaggaaatcaaagacttccatcgtaagctagcttgcgatgtaagttggtttgcaccataaagttgcttttctcgcgaaatggcttccacaacaagcttactttcttgcacgacgtaagtttcttttaagcgataagatatcttctggtataagctttcttccttcgcgataagatatcttctggtataagctttcttccgatgtaaccttctttcttctttctgtaggaaacttttcactcgtatcttaattcatccatattaaaataggcttcataaaatattttcttaatgagaaaacatatcttttttttaaagatgtagtgttaataattcgtgataatattctcggataggtcgatccgatgagaggcaagtacttgagcatttttgctatcaagcaacagtggtggataccgaaaactaatgatacaccatctttgccatatgtatttattggtgtcataactagtattccctccgtttctactttttagctcatgtttaaccgttcgttttattaaatatgtaaaactatatgtatacaataagtatatttaataataaatcaaatgataaaaaaataattaataattacttaaaatttttgaataagatgaatagtcaaatatattttaaaaagttaatggttgccgtcaaatatttagaaacg

SEQ ID NO: 9564 - DNA, 1501 bp, Oryza sativa
atttcgacgagttattgttttcgggttgagctgcatcgtttcgattttcaactagaggtaaacttgtcatgacggtttgcgttctcgagattagtacttccatctttatggtattctaatcttgtttatgtaattcgtcgagttatcgtatatactttataatctctgttaattgtgcttgttggtgacatgggaccgggggtatcttgactagaggtttggggcagctgcagtcacccacgtggcctgaccccctcgggggggggggggggtcgggcccgagggtgatgtggccgcccctccctctgtcttcccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccggtcgcgtcatcggcagacaaccgtgctcccacgatgcatctgcctccggtggagtggaggtaggtatgacccatctcgtcggatggtcatttggaaagcagccatggtaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaagaaaaaaaaggaggcgagaggggttctggagcctgaactctctggctctccggctctctgtaaatccttcacacacagatccaccagaacacaggagtagggtattacgcttctcagcggcccgaacctgtctacatcgcccgtgtctcgtgcacttgctctctcgcgaacattctccagatcgatcgagggcgaagaacctcacttagcgcccccggccgaaccggcaaaggggggcctgcgcggtctcccggtgaggagccccacgctccgtcatctggcgcgccaggtagggggcgcgtatgtttttctaagccctcgtcctctttcgtgtgcgccaagcttctcccgctcagcccat

SEQ ID NO: 9565 - DNA, 881 bp, Oryza sativa
aaaaagtacccggctcgggctggtttttttgcatggaggccctggcggcaagggttttcgtgcaaaaaaaaaaaccctcctttcctgtctgccgtcaccgtccgtccctcccctgtttgccacgtcagcttgccgctctagtagagggcggcagggtttctttttgtaatttttttgcgccgatggattatttctgtaaatattaaaagaaaaaaattcaaaaatgaaaaaaattcgggagaacatcacatcgcactcgctcgccacacgcacacgcagcgtgcgatcgcgctgggctttggctttggctgcgcgtgcgacggcgacacggtgtgtgggtgctgggcccgggcggtcacggcacggaagtagtagtggcacaaagcccattggcaactcgtgctcggcccatcacaaaaccgacccaaccaacttctccgattgcagttattccaacggtatatgccgtgaccgtgattagttaagttattattattctatcctatagtttaacaaatggtttcactcattcatcactcatcatatcacacatccaacggcccaaaatcatccaatccaacacctcagattaccccacgtctccctctcatcccctcccctcctcgcacccatcctcctcacgccggaaatcacgccgcattcaccctcccgcgtctcgctcggctcttccctcctctctctctcgcactcacccggcgacgccgacgccccacccgcgcgcggttgatcccccgtccaccgctgctcgatttctctcctctcccgcgccgcccctccgctgtcgtcgcatccctcacgtgctgcccctccgtcgtcgtcggatcgtcatgccgcctgccgccgccacttgctcgtggaga

SEQ ID NO: 9566 - DNA, 1501 bp, Oryza sativa
gacctgaaagcctcatttttctgagtttttgagggttaattgcataaagcaagaactgtggctttattaagaacccatttgcatgaaactggcacactgaatgttccattgtcaggagggcataatcattgtcatcactgaatattccattaacctttttttttgtcatcactgaatatgcagagcagaacataaatactgttctcatgcaagcaactgatcaccaattacctaattaacaactacaaaactacaataggctcaatgtttcagtgctataatatccaatgccaggttgtatgtgtcttgaggtataccttttctgttattctgttgtttgtctgaaactctgaatcatcctagttcagtagtacttcctgcctgaactaaagaaatcaaatggagtaattcattatagaactttatatcatgagaagcagccaagccgtgccaaaagagaaggtgtgcatgctctggcgttgttgcaccaaatgatgagtgattaagtactgttgttagtgttgtgtgtgtaggggcaaaaccagctgggccatgggatgtcgccaagattcgtgcgtgagatgcagaaaggagtcatgaacaaaatgatgccgggctttttcacagtactgacagagcccgccgaccaatggaatccttggcaaagggcagagctgaaaactctttgcacttttgcaggcatgtgttcaaagtctgaagttttacagaaattttcagattaaacagatgcatcttgataggaatatgtggaagtttcttcaaaatcagatgtcatcctgctaacttgtttccaatgctttggagtttggataggggaagaggcaggtagcaatctccattgtactgaaaaattcggataaattttgatgccagcctatatgtgctacaaaaataatcaaagctacgttttgatgctccatgatacatacatgttgcttgcacgcataaaaatgatgtgctatgcacctgttattgggtggaggctgcatgggcgtacatgctacggttgcaaaggcccatattttcagacaaattccagtaaaaaaaaatcctttctcatggcctaacttttacgatttctcttggacacatgaattttgtaggaaaacctgttccattcccacaaatatcagtaacatttttatggtgccaaaaagggaccaaactcttcatgcctctgttagaaaaaaaaacattacagttagcattcctaacctgggtcaaaagagagaaaaaaaagaaaaaaaaaacaggttgagtacacgatatctaactacggttgtgtcacatttttgccataactcgatcatttgttattgactcaactaacctaagtactacaaaaagtcaatgatttgagatgataattaaaaccatcaaaatcttctcatccaaaaaatgcaattaatcatctaatccacaactagtagtagtagcaggctggaatttacagcaattaaaagcgaatttatgaaggcgt

SEQ ID NO: 9567 - DNA, 1501 bp, Oryza sativa
  unsure (1)..(1501): unsure at all n locations
catcattgatggttactgaaagaattgccaaagcctgaagaatcatcgtgttgcacatgataaaaagaatctccatctgagccatggcttcactgaaacatgcttacagggctgactaaaggatcaccaaacttttgataagttgggaattatctacagttatatttcatcttatcatttagtaccccaagtatgcaagatacatataaaatcattgaatcactaaatgtcatttgaatcactaaatgtcattcagtgataggaattattgattcactaaacattgttcagtgataggaattatctgtagggattcagtgcagcaagtgtactactaaactttccatgtaacataatagaatactaaaaccttaaaatacaaaggtgcttgatagatgcaaggtaaccagaataatcacaatatgacaaataaatatggaaaacaaaggagcataataatagaaattgtatagttaggggaaaaaggattgtattgttacgtattaccgtcgaagaaatttccccataatagttcaacaacctgggtaaaatggtcgtggattacttaatctagtaataaacccaagacgaaatcaaagtagttaatcctgtgaagaaattgaagggaataattaaactgttagcgcaaatacagttatacagggaaaaaagaagggaataatttgggatactgaaatcggttggaaattgataattgaatcacgaagaaattagtgtgactacacaattagcatcaaacaatatgtattataaaaaaaattagctgaatggggaaagaagctatgctggaacatgtgagatcggcaagcagtggacaacctagagcagatcaatctagggatgtgcttgtatggaggagaagctacttgctggccgagcagattgatccagctgctgtataccacttttcttcagctgttgtgtgtatcagtatcatcatacgtagtaaataggacgggaaagaaggccagtataaagcaagcgacgtactgtttcaaaaaactgaagatgaatagatgggactcgaggatcgaacgccgaggaggcgaagaggctgggaggcggctgctggggcgtgagggtgcgacgtcgcagggcgactgcagctgggtgggggggggggggggggggcngngnanggnggcnntncnnccntgggggcggggggccncctgctgcgctgggggcntgactccngctctcggatgggggggaggcgattgcttctttcggcggcgtttgcgagcgtccagattacatcgaatggctgtgatttaacaggtgacgtggctcaaccagctttgggtcttgagtataatatatagaaagaagggataaattgtttttctcatgctttggtacaagtccaagatagctcttacacttatagtgacaatgtatgcccctgatggggatatgaataactatttcccattttgattttcagattagtgtcagtcagtaccgataatggtgaaga

SEQ ID NO: 9568 - DNA, 983 bp, Oryza sativa
aatcttgtaaaatcagatcacattaggtcccaaggcaatattactcctcggttttgatgatgtggcggctgagtcttattccatttatcttctctctcttcccatctcaacccaaacctctggggcatccgacaacaggaggggagaagagtagcggccgttgggcggcgacgccagtagaagcctgacggtgacggccggcaatgggtgggagaaggctggcgaccggcgacaagcttgacggtggcgggtggcgggaagaagggcggaagcgttgaggatgacgcgaccacagcgtggagtaaatggagttgacctcgaagatgatgcagtggagctgtgcgtgcgcctccgcgggggagagacaaagctcgaggacacctaaacaaatcggcttttgagcagctcagtggagatggctctgagtttggggaataagagcttgggcagcatgacgtggcggaagccccagcccctgtgtgtgcaggtgaatacattgcaattgcagttgggtgcgcagtcaggtacatgacacgagcactcccggctattgggagccacactagccggcagtctccgccgtcgagcttgtccccgccggctggcacccttctccccacccgttgtcggctgccctagaggtttgggttgatatgagaagagagtcgagagaggtggaagaaaattgatggctgacatgtggcgctcacgtgggccccacactgattcaaccgccatgtcaccaaaatcatagagtaatactgccttgggaccaaatgtgacatacattgtatcttggtatttcagttcaggaacggttttaaaactcgacgtcaagaaaagggaccttaggtgaactttttccgagatgaaaaatttcttctttccagcctcatgggcctgtgcatatgacccacaggcaggcggtagcagagcgctgcacggccccgccccacaatcgacctcctgcctgtcttgacttt

SEQ ID NO: 9569 - DNA, 1501 bp, Oryza sativa
ggtaaacatgcaaaataaccgaactgggtagccaggaatcaaacaaatattgtttggttggacatgcttggcacaatccataaaatcaacatggaaatgcgatttctagctagatacaattttaatgaactaaattccaacaggaaaagattatgcagctctattttctccacttttttgtggggatgtgagcgattgggttgtcagaggactggtttccgatgcggttcagttttacagctttacttttccacagccactattggcagacttaagaaatgcccaagagtttactactccctccgttttacaattaaagtcattctaacatttcctacatttatattgatgctaatgattctagacatatcatcaatatgaatatgggaaatgctagaatgacttacattgtgaacggaggaagtatttcttttttgtgaatatctggcctagctggacccaggtgtttaacatggctcatgctggacaattgtggttgggttgattcgacccaaccaatcccaaaatgtactgtattaaccaaacttcagatcacacatttggtatgccatttaattttgcacaaagagagatccaagcttgaagtccaacagtggaaaccatgtttagatatcttgtctcattactcattacacacaataagatcagtgtgatgtgacttacatctgcacactccatattccaataaacttcatagtatatcagatctacttacttcaatttctttttatcaaatgtaagcaaggaaaaaaaatcaaatcttattcacccagctcacctatattgttccagacttccaggttttaggcaccggttctcagtagtgatgttatgtcaaatttaaaatattgaacttcaaacttgttatgcagaaagaaaaaaccaagacattactacattccttcttgaattgatttgaaatcagattcgtgctgatctgaataattaatgttttttttattttgttgatacctcttggctggatcacccataggcatgcatttatcagtgactttccatctactgtgggtacctacacatgcagaatccactaatcagaaaaccaaaggcataggttataccatatgaacagtcgcagggccggcagcactcttaagcccggtcgatgtagagcatttcttagctgctgacaacttttataggagtttctgccaattggcagtattgatgccagtggcggagcttgagcagccgcctgatcagctgggagctggctttgccgttgcatattgttggaattaatagatgggataaggcacattctaagattaattcttagaaaaatcacaaaagcccacctcataagatagcatgcatgtggagtttagtaccatcttgcttattctaggagagggggacctccttaaaaacaaggatgccctcctagccacttgaagcgtgtatggtggagagaagaggggaacacacgcgctcgcctcgcctcgcctcgcctggcagg

SEQ ID NO: 9570 - DNA, 784 bp, Oryza sativa
  unsure (1)..(784): unsure at all n locations
agcgatcgggaggagagggggaggagggagagggcggggacgcgcgtagcgcccgggagggagagggagatgggccaatcagagtgagggatgggctggtgggaaggagggggtatagaatagttattctaagggagggatgtataataatgctatatatatatatatatatatatacatatatatacatatatatatatacatatatatatatacatatatatatatacatacatatacatatacatatacacatatacatatacacatatacatatatacacatatacatatacatatacatatacatatatatatatacatatacatatacatatatatatatatatatacatatacatatacatatatatatatatacatatatatatataggggtaagactattctacaccccctaacctttatcatcggtatcctcccatcctcctccaagcctccggattccccctctttngcttcacctccctcccntcatccggatatctctcttcttttttcccattttttctgttttttctccctaaaacattttttctcttttctacttcctccgtttcacaatgtaagtcattctagcattttccacattcatattgatgttaatgaatctagacatatataaggatggcaatagggccccgagaacccagttggggacggggacggcgaaaagtcagccccgaggccggggacggggacggggagcggggctttttgaagtgtccggggacgggggcggggtagcactatccgttgggga

SEQ ID NO: 9571 - DNA, 1501 bp, Oryza sativa
caacagcaaagggataatccgaccagcccagttccacgggctatcattagccataactacagcccaacgacaaataagattacagtaggcgatttaccaatttttcatgccggcctctaaaaattagcggcaaaccaacttttaccaaacagacagattgacccacaaatataataccgacagatcgtttgtttttattggtcaatattattacccacagaacatttgtcgtcgtataaagaattaccgacagattatctatcagaaagcattgccaaaacaagtaaagaacatttgacattaaatgccaatttttcccgacaatcatctgaaacaaaatttcagacattgatacatggtggtagtgatatcactactgcagaactgatctttgctgggtcggccaaaaccagaatagtcccggtttcgaaaagaactaggactaaaaatgttttagtcccggtttaaaaatttcatgggactggatgatcattagtcctggttgataatacaaaccaggactaaagatcattttcagtcccggttcaaaaaagatcagagcccacgctgatcaaacatggtatataatccgtaggatatgtcctctcctcccatcctcgcaaacaactcctcatcctctctcttctatctctccacacgctctctcctctatctctcctcctctctcctctatctctacctgcgctcctctctctagcacacgctgcagaggaagcgggaggggcagcggcagcctcccctccgccggatccgggaggggaggcggccgggcagcacatagctagccagattttcttttatttttctattcttttgctcttaatttgtggatgatttttgttaaggataatttgttcatttgatctataacttaaggatgattttgttgttgtggataatttgtgatgtcgggagatggtattttgttgctgatgaattgtgatgtcgggagataatattttgttgttatgatttggggatgtcggctgagatacgcaaaactgcaaaaaacaatgaaaaaaaaataactaccgggactaaagatctcgggtatttcaaccaggactaaagatccggattctttctcccggtttgtaacccaggattacaaggggctgtaaaccgggagagaagagggtttcttcagtagtgtatgtgtggaattagggtgacgccgatgttagggttaccaaatgtgtgggtggtcgccacgcaattttgtgccagtgagccccagaggcacacgtgccaaccgcccaacttctgttctcactgcaccttcataatttcaaaccaattcaaaacataagtactataaaatagaaataaaatagagaaaaatctaatgcattgcagaaatactccctccgggttgataatacttgtcgttttggacaagggcacagtcttcaaaaaaacaactttgactattatttttattataatatatataaaagtgtcgacgggtcatacccttagg

SEQ ID NO: 9572 - DNA, 1501 bp, Oryza sativa
gtaaaccacatccgcctacacgcgatatcgacaatccaaaatttcttgggttgatgtaataatataaatcttaaaaaatttttgctcaaaacacttgaaacatttctgtgtaaatatatctattggccttcaagccgattttacttctaatctttatatacttgttaatattttgaattttttggtctaatcagtggcaaattcatacaaactaacttgacaaactcacctgaacatatatcatgaacataggacttaataaacatattaactcacatagagtatattatatcttaattataaacattctcttaacataatacaaaatataaatacaaatcattaagcaagtaacttgtgacatgtgcatcatgaactgaatatcaaacctaacaacatcaccttaggtcaagaagagtttaaatataatttttatagatgcttagatccatttctaaagtgggaacacatatatagagataggctagatgaatttctaaaaattattggtacaacattaaatcttggcaaaattcacacaaatactacctaataattacaacccgttgtaagtttggttaaattttatcattcatccttatatcttgagtaaatcacttacatgtgtgggatgtcagaactgagcaaaagtagatgcggactttaaaaaaatgaacagtaatggctcgctcaccaccacctatagagcccaaagaactaggcccatatagtctagtacacaaaaaaaatagcccatacagacggcccatgagaagtatataggtctatctctcaacatgaatctctaaatatattagacggcccaatggattttctgacgtagaaatagaaattccgcattcgtatcatcgaaaaaacgaaaaaagaaaacaacaaatcttctcgcgagtagcgacatggaaaagaatcccgctcgcacgcacgtaacacctccccatactaccctctaaggtctaagctccaaaaatccctaaaaacacatgatcttaaaaagaaaaaaaaccaagctacaaacacccggtggcacattcgttatttatgaaggtacggtgcccattgacgtaattccgcaccacacgccggcacccccaccccaaattcttgccgagacaactccctctcttccacgcctactcccggtttacgcggtttttctcactgacaacgtggggccacgcgtaccacggatggagtacagtccataagaccagttccagggaagaggatcaccatgaagggaagcttcctccctttgttgagtaaagcacagaaaaaagctcgccgtaatggcgacgcgaaagtaaacgttgcgccgacgacaccaccgtccgccgaccgaccaaaaacacatcgagctccgcggcatcgcgtccatccgcgatctccacgcgcgagcacaggatcaaacaagcggtctcgaatctgaactggatgccggagaggaagagccggtcccggttcgcaagcatccggctaggtc

SEQ ID NO: 9573 - DNA, 294 bp, Oryza sativa
ttcacattagcctagaattatttaatgagagaatttaagtcctttgttttgggtcactctacccatataattatatatatagccaatttattttacacccctcccctagaaaaactaatttacacccccccttccaaagggcaatcccaacttccccaacctccatagggccaaatcccccctcccacctcagtcaaaggctagtcaaagcaccctcccaccggtcaaacccgagtcaaacccacccgttgactccctcccccgcccaccactttgttgttcacgtctcgcagg

SEQ ID NO: 9574 - DNA, 1080 bp, Oryza sativa
gttttattgcccctcttttcacataggaaacaataagaatttatgtacgcaacatgaacaatttttatttacaccaagatttctgaatggtgtaatactaaatggggcagattaaaaaaaattgatgtcacaccttgatgcatgaaattaccacctcctttttaaatatataacgttgttgatttttggacgtgacgtttgaccatttgtttaatctaaaaattatgtaaatttaagtcatgcttaaaagtccttctaagcatgacttatatttatatctttgcgtattcatactaaaattttgaattagacaaatattcaaatgtccaaaagccaacaatatcatatatttaaaatgcagatagtacatttgttgtttatttgtttcttaactcattgcatttataatttatcaaatattacacattggttgttttattacatatgtggattccacgtatacacttacattggcttattgaaatgcccatcctagctttggacgatataccaccgtaaatttgatttttgatataacatatttttacaattgtattacactggacttaattcatattggtcaagacgtgcattgcacgtgtaagattactagtagaattgctaaagaggcttaaagaatcattcaataaaatttgatcgacacttaagttgggtgtagtatactaaccttccaaagtttcgattgtgatcgtgtggtcaattggacgataaacctggctggctggtacaaattcctgcaagtagggatggcaatggggccccgacacctcacacccggtggggaattactctattaggggatgtaaatgggctaaaactaccatccatggggctgaaaacggcaaaaaagaaaagccctcatcgggtgggccgggggcggagccgttcaacagtccccaggccccgaatccccatgggtccccgaggtggataggccacgctatatttcctaagcccacaacccaattagactggcccaattaggtccacatatataatctgagcaaaccctggtctaccgtctccacttctcagtcttcccatccccctcctctcaga

SEQ ID NO: 9575 - DNA, 527 bp, Oryza sativa
aaatgatatgtggggctagaggggccacatctcaactactcccaccaactctctacttttcgtgggaaggaaaaaggatttatgcgggactaaaaaggtccacatgtgattaacaaatatgttcaacaattaagagatattaataacatgttaatgataattttttttgattaaaaatccggtgccacgcacaggccatatgctagtatgctataactccgctaacatacattttttctttttaaggtaggtcgaagagagctttatcacaaaagtgcttaattggccccataatcctgcacgtttctcattgacgcggaaatgagtgttcaaacttcaaataggtttacctggattggaagcctaagttaagctaggcagttactttatttttggtttcattttattagtgattattgataatccaaatccagatagaagcctgagtgcttgagcaagagtagggccaataacatgagtttgttaggaacataagtgggctgggctggctccgtcgcttccaaagc

SEQ ID NO: 9576 - DNA, 1501 bp, Oryza sativa
  unsure (1)..(1501): unsure at all n locations
ggtgaagcggggaacttgcacgatgcaaagcgcacaacacatcacacaggcatctatgatgggctggctcatgcgttcatactcatcaacttttgccccaaactaatacatgctatatactataagtttttcgtttttttggtgtgccggngcatacccggcacaccccctgggtccgcccctgtgctaaatgttccaaaaaataatcatacataatacaaatagatatgaaccgacacaatttttctcatcaatttaaggttatatggtttcaagtaattttacttttagtatagagtttatacgtttcaaggtaattagaaaaaaatcataaccaatgtccaaatcagttattaagcaaaacatgtttaaaatgaagtcagggaatatttcaacaatattattctaacataagcattcacaataaaaattaaagcaaaattaaacaaggtgtccgtgcatttctagttcgtattaataattgaaaccactcagtgctagaaaatcagtgcaatcggcaccaacgatcatcatagtcggaaagtcagtggcccttaaaaaccgggcactgacgaagtgtcctaagctattgaccttattttattttatttatttattttcaaaaacgtgataataaaaagaaaggatcatatcacagattcacagctactgctggcgcaggtatttccacattagttcggcaaatagtctagtgcagtcgtgcagacataatatgatgtgcacttgcaccttcttcaggtacaaacgtagttcaatgtaccatcagaatgtgcagtggcgaatgtacaacgtgatgaaaatattattggggctttatattaaagtcataatacataataattataatatactttttcaaaatcctacgcggatagggaaaaaaagaggattaaagactgaagtgaactgaaaaagattgaaattaataggtataagagcactgctacacatactagttttttcttactaaatctttactaataatcatctcaaccgtttgatttaggtagatggaagttatgaaaaatctagatgaactcgtagcatgacacttcagtgttagaatttagtaagaaaaagttagtacctatagtcttttccatgtataaaggccatgagctgcacactgcaacagctactagctagaacacaagagtaaaaataatctacaatataattaatgatcacaattcacaaatgatccagctagtaataaacagcctaatgttttttcatgcacatcatttctttcaccctgaacgtctccagccaactagccatcactgcttggccgtatgctggttgctgtgcaaattttgctggcactatgaactcactacgcaacagatatatgggattagattcctgccaaccagagagctggggctagagccccaaccaataacatgttcaatatgtaatttggtgttaaatctgtacggaatttctcaaaatatattttgtttcatgaaatttactc

SEQ ID NO: 9577 - DNA, 517 bp, Oryza sativa
ttcccgcccgtagccgagggagagggagggaggggccgagcgccgccgctgtattgtccgtcgccgccggtcggccgggagaggaaaggagaggagtggagtgggaggagaggagtggagtgggagagagggagagagtgagtagggagggaggcagtgggcggaggggcgcggaggatatcgctcgaggtattttcatgtacgggtcagttaacagccccgcacgcaaaaataagtttattttcatgtgcgggcctgttatgtgattgattttcttgtgcgggcgatggcctggcgtcggtcccccattttcctgtgtggttccacttacgaaccacatggaaacaaaacgggaggcgtctaggaaaatcaatgtagtagtggcatgatcatgttgttcagtaccgtcactagatctactcatattataaatatcatgtttattattatgttattatggattaaaatatgcagaattataaccatatttccaacaattactccccttttgccgcaa

SEQ ID NO: 9578 - DNA, 1501 bp, Oryza sativa
cgaaccatggcccaataatgcaaacggagggcaccgggaggtagagaaggcgacggcgattcttaccaacacttacgcgacgatggacagcgacggaagatggccggcgatgagcttcgaagggcggcgaggtactgtccacggcggcgatgattttccggcgacaacacatgaagatgatgacgacactagggccaaattagattagattggattaagaccctatggataaactacaccgatgaacgacaaaggagagaggaaagctcactgaggggcagcgtgacgatggatgatgacggcagacggccggcagcgaggtagaggcggcgacggggacgggtcagcgacggcagcgacgtttctgcaatctttggcaaagaaaaaccggtggccgggcttcaccttgctcctgcgaacccaatggagtcgacggcgaccgaaagaggcggctaaggcggctgctagctgcggctggaggcgcagcaaaggccgaaaccttctggttcgcgtcggcaagcggcttccggcgggatttggcacaaaggaaccaatggccggggtggagctcgactttgcggagccgagggaggtggtcgcgctgaccggcgacggtcggggcgatggcgcacggcggctggagcggcggccggaggtggagagagagggagctcgcggggagagtgtttccggcgacggtggagatagggagaggtggcggccgaaagaggagaaggagcgggctctatatatagccatgggagcccagggatcgagcccacgtcgacgggaaaaactcgggaaagtttaggatcttcgccggaaaaaggaaagattgatccgcgaaattggaaaggatttccatagaaacttgtgggatttcttggggaaaaggaagaggagattgagaggattccattcccacaactaatttggaaaaaggggcaacgaggtggccggattagtgggaggaggcggcacggctgcacaggctcgggacggctcgggctctgtctggaggttgaagatagagtactgtagcgtcagggaggtcaaacagacttctctgcgggctgagaggagaggagggaatgggctgaattcggcccaagactaggaaggaagattttattgcttttccaaataaattaaccaataagatgatctttcaattgttaaaaatacttccaatgctcaaataattccaagaaaaatcttgaacatacttggacactctaagtatttaacaaaattgaaaccagctcatttaatgattaatttaatatgtgaataattactgaaatgttctttgcattattaacattaggaattgagctctgaaaaaattcgagaaaattccagagagtataattaatcatggagaatttaataaaaattaaatccaaccattctttatatttagaaaattttatttcccacatttaacttcacttgtaaattaatgtacttttaatataaattctaataataatttattaat

SEQ ID NO: 9579 - DNA, 1501 bp, Oryza sativa
attatacgaacctggcttgtgatttattctaatctacactcagtcaatccttacttgcataagtctgacccgttacaaacacgggtatattactagagaaaaaaccattatactaaatcacggctcgtatactaacgacggctgttgcgagcttatttgtagcggagctttcgggtgtcccatagattaatctaaacttacatgggttatacattaaacaaaaagaacagaaattttacatgagtcatatgcatcatgttgggcttactacaccctcggtaaaaaagaaaaaaaaaactatgctcaaaattatgctaaaaagtaaaaagtacgcaactactcctatcaaacatatattggaggatattagtatgttgcatacgaggcaggtggtagagacgtgacagcccacccaattaagctctgcacatcagagtatactactgcaattaggtgttttttttttcatagtttactttactatgcaacgttatatctgctaggtttttcatgatgctaccgagtacacgtctacggtctacccctcattcattttttttctgtatgtgctactctattcgactcataatatctatgaagcgcatatagccatctctatgaagcgcacacacaccctataaatatatttgatagacttgggcaatatttttttagattggtgaatatacaaatggttgagttggtactcatgggaaaatgacaggggagtagtagtgaattgatttttggccttttgcaattaataggaggagggaacgcatgggggaggcatatcgatgtggcggcggcgctagatacggcccgacgataagaagacggacatctaaataaacccgaataagcatcactaacagcaacttaaaattttattcccaaattttttattatggaaatcctaaacagaatttatggtgttaaaattttcctttcaccaagagattgggtaaaattggttttcaaaaactaaaaaggcgggccatataaaatctccactggaaaaatttgttttgcacttcaccatatctcttcctgcgcgttaagtgccacgatagagagccaaaatgtgtccaagaaaaagaaacgacgatccggagtagggaacaaagaattctgggaatgagattagataattcattggaacaaatttttaacaaaaatcctcatattattagacagggaatgatataaagattattgaaaaaattgcgacttaaaaatagcgaaaaaaagcggacaaagaaaacggaaaaaggcgacgaaaaaaagaatatggataaaaacggcgaaaaaaaaggaggcgacgaaaaaaacggatggaaaaaaaagtagggcgaaaaaaagaagcccatatatattttttatattctatataaatatagatacgacgatccgtgaatagggaagggaaggagtgagtcagataagggagaggggcagggatggaatttcgcatgcccctccctctcttcttctttccagg

SEQ ID NO: 9580 - DNA, 1501 bp, Oryza sativa
tcttatttgaaaaaattatgaaaaatattaaaaaaaattagtcacacataaagtactattcatgttttatcatctaataacaataaaagtagtaattataaaaaaatttcaaataagacaaacagtcaaacgttggacatgaacaatgctaaaactgcacttattttggaacggagggagtataaaattagtcatctttacatacagagcactctagtttacacactttacatccacactagaccttgtcaatggttggttttaatgaggccatgtttagatcccacccaaaattttacaccccgtcatatcgaacacatgcatgaggtattaaacataggctaaaaaataactaattgcacagattgcgactaatttgcgagacaaatcttttaagcctaattgctacatgatttgacaatgtggtactacagtaaacctttgctaatgactgattaattaggcttaataaatttgtctcgcggtttactgacggattctgtaattagtttttttattagtgtcaaacaccccatgcgacaccctatataatatccgatatgacacgccaaaactttacacccctggatctaaacaccccctgagtatgtggccctgtcttttagagagtttttgatagatgatgtgaagttaatagttggctatgctattaatggtatagtttaatagtacagtcaactactaacagaggatgtgaaccttataacacataacttcttggagttcgtgcataacagaggattgtaaaacacaggaaatcttagaaataaccatttgattaaaccataggaaaaagtacgaatcggataagagagatagactcaaaggaaaatttccaagaggttgaagctcttgctaaatttccgccaaaatctctgtagaattgttcattccataggactttaataggataggatatgataggattcaatcttttgtttcaaatgtatttatataatttttttatataggattaaaattctccaaaattcctatgtttatcctctaaatcaaagaggcccgtaagcttttcatctagattacaaggatcaaaagctatagaatctagaaatctatacctaataaaaaatacatatgcttccacctataattttcgcctgtttttcttttttcccatctttttccgttttattttatttttcaccgttttccttttttttcttttcttttcactgttccctcttttttttctttcaccggttttcgggtttctttcttttgtctctatttttttcgtggttttttcgtcgggctgaaccctagcgccaccgccacgtcgatttgtctctccatgcgtttcctcctctaattgattgcaaaaaccgattccccactactctctcatcatattccctttgaatggagaggatcggctccgtcatggtacgggcacaggactagctcgatcggattatcagaattgatggaaggataggctccgccatggtacgggcacagg

SEQ ID NO: 9581 - DNA, 1501 bp, Oryza sativa
ctggacgttgaaaaataacaataggtactgatcatgatgcatgaatatattggaataaaacattgaatatattgagtagtgcctcagccacatgaaacataaaccagaaaagatggatggatggagcacatacctgaacgtggttcgctgataagattcaagcggaggaactggaagccgaaaattacgtcgtggggcgaggagcgagcttgggatggagtcgcgaacaacaagcgactgctgcgattgtcgcgaacgacgagcgggcgcaaagaagaagctcgtggatgttcggcggcgcaactgattggcgacgaagattgtggataaccggctgcgtacgtccaagactctcacgaacaatcagcagcccacgacgaagatgctcaggcacgtctggtagcacaacgactcggcgatgaagaagttcgccgacgtgcggcggtgtaacagcgtggagcccaaagtggagtgtgtattagaatgaaatgacatgtctactcgtattgatggaaataagcaaaaaaaaatcaaaaattagtggattcgatttagtgcaatctcagatttttggaaataaatattagcgtgataatgttaatatttcaaatatggaaagtcattttaaatttcgataatcaattatcacgcaatcatattaatatttcaaatggaaagtatgtgcatgaaagtttatatggaaacaataggagtgaacgtataaatggaaactcaatcacgtcagtacatgcatgcatgcaaatcatgcatgcctattgctgatggaaagatctaattgggtttaacccgttaagatgtataatactccggtttatgtagcacggatctcaaagcacgtatacggtggattctattagagcccatactccatggagcacgagtgtatatatatatatatatatataatctaaaagttattaataagttagtggtcaaagttgaaacatatatgagcttacattaattttccggtcaaattgattaggcaggaaatgatccgctcgggcggggaggggacggctcggaattaatggaattataatctagaaagtccaccatccacattcaggactgcgcgcgagatcatctagttcgaggcacatcgtaagatatactccactccattatgccagctagctagatgagttagctcaattactttggttgaaattactagctagttaatgatctgctatggaattgatcaaacctggtaagtttctacattaatgtggcagggggaggacttgagaaaacataaataatgcaggattacaggtgatgttttcagcttactcccatgcatgtgtagtgtacgtacttgatcgatcatgcaatctatataaaccctagcccctcctccaaaaccaaaccaaaccacaccgcgcacagcacacacacctctaatagcttcgagtaataagctagctagctacattaattagttacactaggtaactaattaagtcgttgattaatc

SEQ ID NO: 9582 - DNA, 1501 bp, Oryza sativa; identical to SEQ ID NO: 6778

SEQ ID NO: 9583 - DNA, 1501 bp, Oryza sativa
aaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactatggaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgagga

SEQ ID NO: 9584 - DNA, 1472 bp, Oryza sativa
ggttcaaggacaatattgtaactcgacaacaagttgagggaccttgggtgtactttttccccaattggaccacaaattctttctttctgttacgtgcggcccatatttgttgggccgtaacggaatttggaatttatgcggcccaagaacgggactgggatttgttgggccctcccgcaggtgcgctcagactcgccgtcgctcccccaatcggccgccgcctccgccgcgtctcgtccacttgaagagcaacatctctttcactcctcgaaccctagcacctccaaatcaatcattctcgatctccgcgcgagaatgagatcctcctccacctccagcctccaggtacgcccccgactccattgctctcatttgtgagggttgtatgacatccatctgcggcggggcggggcgggtggagacgccgcccatttcttctcaacacggctagcatgcgacagaggaagccctcaaactgatgggctaggatgcttggcttcgattcgatgttggtgctatatgattatcacaagacttcgtgttaatctttctaatcattacccatcaccaactgctacttcattttacacttgctgctttaatttatttaccttacattttgctactcacataaactttgttccagaaacattgtttgaaaatatggtgatttttttaactattgttgataaaaacttggtgctgttatggacctggcctgatctgtggtggcgaatgagtgaggggatggcatcactctatatatgcgaaaagccgaaaacagccatgtgttctgctctttgttcctttttgtttaagttttgttgctgggataacactttgtagcctgcctctcatgaatcatgatggaaatggaaggggtctccctcttctggctataatacatttgcttctcaaatattacagtacatttctaaaggaaagaaaaaaaaagatatggtaaattgaaacttccatgcctttttccatatctatttataggttttgcacgtgttgtccaaatgtgatcctttatagaggtcacacctttatccaggtttcttatccgagctaatcgaaatccaagaacaaaaatactactgtggcaaaaaagaataaggaagaacataaggaactcccacatgtccaaaaatggaagcaattagtttggtttcaatacaggccacaaaagaaatggtcagctcaactcctacggttgaggctcacacctcattcaccctgtcctgagcaatcctttttaggctccttcctgcaaggctgcaactatataggccgatgaggacagaagggggaaaaaacacaggcgcattctaccgagaggcacaggggttgcaagaagtcgcctaattctcctattgaattaggcacatcttcgcccccacattgcctctcattgtaaaatagtatcaactgataatccacaggaactaaacaacaattaaatccaatta

SEQ ID NO: 9585 - DNA, 224 bp, Oryza sativa
atgattcgatcgagcagcaccgacgaactagccgccgatcatagagtcaaatgctcacatctcaaaagcttcaatccacgtggacgaatcaatccattaaacttgtacgcatgcacatcacgcacgaacaccacaacacaagaggacatgaagcttcacctgcaaatctctctataaatacatggcaaaaccatcaacctagctagcacacagcaacttacaca

SEQ ID NO: 9586 - DNA, 1501 bp, Oryza sativa
cccatagtataattgcaaaacaaatgcgatatttgaaagaaaacattaggacatttgcaatataggatcaatatgatcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacattttccttgatttactgagacttgaatgggcttaaacggagctcggatgaattagttatgaattttagaagattcactgtgtttattactataaaagaaaaaccttaaatcatttattgcgcaatattaaccagggctgacgtcagcgagggggcgcggctcggcgccgacaggcggggcccaccggtcagcgaccgggagagagaggaagggggtggcggcgcgcgggcccaccggtcagcggcacggggaaaggaggggcggcggcgccacgtggcggccgaaccgacggccccgatctaccctcggacggcggcgcgggacctcgcggccggggcgcgcgggcgcggcgcgagacagcggcgaccatggcgccggcggcgcggcgctcacacggcggcggcgcgcatgcggcagcggcgcaaagcaacgaccgacggcgatcgtccggcggcggagagcggcggttagcggctctaggaggagaggaagggggaaaagaagggaggggatgcctcaccgagggtggccggcgcggaggaaggcgatggcggacggcgacggcaagtcacgggaggacggcgtcggatagcggacgagctccggcgtgccctaaggaaggagaagagagggattagagagagagagatggaccatggcgatcgggatccatggccgaaggcggcggtagaggtgacgctcacccgtgcacgtggggagggggttccggcgacgaacctcgacggaggaggggtggacgaggtggacctcggccgcgcgaagctaacggcggcgacggcgtgagacggcggcgagcctagcggcggctagcggcggccggagtagcaaaagcggcggcggcgggtggttgcacggcgcggaggcgttggggggctcgggagaggtcggcgcaatggggaaaaagcgagagggggtgccggcgatgcttaaataggggatgggggaaccggacgtggccgggagcggcgggattcgacggccgacgtgggggagtggggaggagagagaggcgggattcggttttcgaatcccggccatctcgggcgcgggcgcgagtgggagagagaggggaacgggcgcggggaatgcggcgcacgcgcgggcgtggtcgacgtggcccggggaaggcggagacgtgggcgcggcgtcggttgcggcggcggcggcacgagcgggatcggcgggaggagggagacgggtccgacaggtgggccccacctgtcggcga

SEQ ID NO: 9587 - DNA, 1501 bp, Oryza sativa
ttcaagggaaaaatcttgtcgcttgtttaagtgagatttttcaaaacgagtcagtctagggttttagtaaaattattgggagtttttcggcagtcagttgggatgtgatgggtgaaatgcattaggtcctagctcggtatcatgggttgcaaggtgtttatacttcgtttgttattattaatatgtatctaatttctcattattttatcgttatgtgagtctgtcttatttattcgctctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggtgaaggcatgatcgactttgtggcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacggcacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctcatgaggatcgtcgctctgaaggacgagatagcgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccaga

SEQ ID NO: 9588 - DNA, 1501 bp, Oryza sativa
  unsure (1)..(1501): unsure at all n locations
cggcaggcaagcggagacggtggcgagcggcggcacgcaccgaagtctggagaagcggccttccgagcagccgtcctctggctcctccgcagagtagctggggtcggcgccgccttctccaccttgcgcgcagcggcggtctgcctagtggtcgcagggggttgggattggcgttggcgtggccctcgcgcggcggctggtactacgcagcgccacgcccaggttccgttcctcacgatcccgcttcatctcgtcctcaccctcctcgaagtccatctggatggcctccagcgacttcaccgacacgcggcggccacgggggagtgggctcccgtgctgctgctgctcttcctcgccgaccgccgaggcggccttaaagccgacttcatcgtcaacctgctcggcgtcgggaggcacagcgccgtcgtgtcgatcttgtggatcccatccacctaatccgcaaccaacacaactcatcaatcaccaccaccataccaaatcacacgacgaacatatacacgagaaccccacacaaaatcatccaaactctcgaaatgggcagatcaaacaacgcaatcaatcaatcaatcaggggattcttaccgaggggagcaactggagggcatcggtcatggtggcgttggtcatgttggcatggcagtcgttgcgcttgcacatcgcntgcagctcgcggtgggagagagtgcgtggaagtccatggccgtcgtcgcctccaccttccatctcttcccgtcacctacctctccttctgatttgggcgcggtggatttgtgaatggcagcgccactcccacgtctccgccgctcgcgggcccccgcgccatgcccgcgtcttcgccgctcgccgccgtctctgcttgcctgccgccgctccgccctccgcgggagaaagagagagggagggagaaggaagcgacgatgaaggagaagggacacggtggaggggagagaacgagagaaggccccgtatgtcagtgggttacatgatatattttttaatgacaaataggttccacatattttttaattcgaatgccaccttaacaccacgtggagcaaaaacgggtgaataccgtcacgtaggcgccacgtcagcgataccgccctctaaaaccataaaaggagtcaaattgcaccggttttaatagttaggggtccagacatctggaattgtcgttcagggatacgaatctgattcggttaccagtttagggagtcaaagtggacttattccaaaggggaaacccatcgtccaaaaagcccttcccaacgcccagttaggtcatctaaagcccatgagctttttggcccataaccaaccgactaacgcccacaaagcccacgactcccacctcttcctccacacccaacccaacccgagacaccgacgccaactcaaaccccttcgaaaacctcctcctcctcccccacctcttccgcctcgccgccgaaaccctaaccctagccgccgccggccgcca

SEQ ID NO: 9589 - DNA, 1501 bp, Oryza sativa
gaatcgcaagtactaataacgcgacgtcggtgctaaaagtttaatagtttgtctaacttcacgagttctgggcgcctcaaaattgatgttctctgtcaatatcaccgagttgcctgttgcattgcttgagctggctccacaatgttctttgctagcatggaagtccgcatgttaagattcttcaagctttcgataaactgctcgtggctgcaatgaaaaaggatatgttggaaaaactccctcgtaaattgatgatagaaaaatagatcagtattcaagtgatgcttgcccagaagttagcatgaattgcgtgtatgggtgattggctgaagaaacttacatgttaacatgattggtcgtcatgataagagttccagacactgaatcaatcttggcatcgagctttgaatttctaactaagttcattatccacaactccccttcatcatagcgcatgttcagtttctgagagagcatgctgttcattgcaaaaaaattgaaataacttcttagatttgaaagaaattgcattcctacatggtccatataatataaagaataaaacgcatgaaccctgagaatttaataaactgttcctaactgagatgacagaacagaaagatgcaacagataactgccaccatgtagcgcattacagttcttttttctttttcctttttttttttgccgctaaacatgaagtgttgtccctacaatatggaaagcagctgactgacaaaattatgcaagacccaaccaggcacagaaccgatttgtgtattcgatatacagtatgatttagtgaattgataattaataactgcagttccctacttttcatctataggggacttttgcatgttaccagaaaaaaaaagtgagtagtaagacaaaaacccccacccaatatcaatggaccgatgaatacggcagtaagtttcaaagaataagcaaacaagcattttcaaggaattcatctctcaaaggaacagtgatggaattcccttcctcaatgcgctttcccaggaaaggatcattcaatatgacctacaaaggcagccattaggacaaagaaatgcaagactgcaatatgatcaccattgagaagacagtgctattagatatcgtatagaaatagcctagaatttggtagtgcaaaatcaccggtatgcccagagaagtggttctcatttaatttaaggagggaaaatagaaaagtaacaacaatgagctaatgacctaacgttcaactctggaaattttacaggccaggacaccgtcagacaccctcagacaggcctttctgatataaggatgtgaaagctgaactttgatcgcaaaaaaaaaagttaggcatcatatagcagtagtgtgtgaacatataacttttttttccaaacaaagaaaaagaggggaaattatctttcaatattttatatttcaacaataatgcattaagtaaaaaacagattaatcatggggatggacaaaaggttcaaga

SEQ ID NO: 9590 - DNA, 1501 bp, Oryza sativa
cagctagcagcagctgcacggagacgaggacggcgtggaacacgccgctgcgaatccgacaacggaggcggcgcagcgagacgacgagccggcgaggaggaacgaccgaccggaggagtcgtcgacgaggacgaacggagacgacgataacgaacactggcggggttcggatggaggggaggcgaggccgagggcgaccttgccgctgcgatgccggaggtggagacggcgacgtcggccggcgcactggcacggcggacggggctgccggaggaactccggtgaggcggagggcgagaccgacgcgggcgacggcgttccggtgaaaccgagggcaggccggggtggaggtcgacgcggcgacgccgagggaggagacggcgcagccggcccgcacctgagcggcgcggcaggggcggctggaggcagtacagtggcggcaacgccactgttttgccggcgaggacacgtctccggtgatttccccgcgaaacggagggctgaccgggggagagaaggcggctgcgaggccgagggcggcgacggcgcgaccggacggcgctcgggcgaggagggagaggcggctggaggccggctggcgccggagagagagaaggagaaggcggggagaggtgatacgaccacggggaggctcgggaaggggctaaaacgatagaacgaaggatggggattccattttataggcgtggggagggatccggccacgggaggagccgggaacggcggcggaaaagccggccggcggccatggaaggtggccggagttggcgcgtccgttcccggcgattgggggcgccattcaagggggaattaagggggaaagagagaggagggaaaggggattaattccccctaataaattttggaattcccggtttgaatcacgtggattttggggaggtttggcgctaggtttccggggagagagagagcaggccgtgcgggaggaggaagacgaccgcacgtgctgcgcgcgtgcgaggagcggctcggcgtgggccaggtggctgggtggcgcggcttgggccgggcgggaaggagggaggggaggggcggcccagaaggaggaggagaggagggagtgggccgggaggggaagaggaggcccaagagaaggagagggagagaaagagagggaggagagagggacttcggccgcgggccgagagggagaggggagaaaccttgggccagacttggcccaaagggaaggagagggttatttttaggtttttctttttaataaactctgataattgttgttgttgtttaataaatatttttggtgctctgaaaattcaagtaaaatttgagggctccttttagaccaaggataatttaacaaaaattctccggaccacattcaaatttttctggcacgtattttagtgtttgtcaatttcttttcgaattttaattaattctattattccttttagaaaatgatttttattttgggatgaatttatcaggacgtgac

SEQ ID NO: 9591 - DNA, 1501 bp, Oryza sativa
ctggactattcgagggatgtcatagctagaagataatcaaattaaatcagaatcagcacacttagtttcttgtgaggttacctggaacacacatggtctttccagacttaatttgttatcaaattaatctttactagcatatagtagtcaccaaaataaaactttaacgactaataattttcattgctacacataccataaaatatagtcaatcctatattcctagtagtaaataaataaaacattgtaatatcaagtactatgtccatccgaaaaagatcacttctataaacaaccatttgtctagattcatgtaaaaaaaaaattagagagagaggtactagtagttttcgtgtaaaaaatatagtaaatttcacaaaactacaagtattttacataatttatcataaaactgtagatttagtgtctccgtttatcacaaaattataggtactttgtacaatctatcataaaactatagatttaataacttatttcataaaactatatatttagtgtattcgtttatcagaactacatatttagtgtcttcatttatcacaaaactataggtttagtgtcttcattatcacaaaactataaattttgtcttcctgtagttttgtgatacaaaacctgtagtttgtgataatgaagatactaaacatgtagttttgtgataaatgatgatattaaatatatagttttgtgatatattgagcaaagcatctgtagttttgtgatgaatgaagactctgaatctgtagttttgtgaaataagttcttaaatctatagatttgtgatagattgtgtaaagtatacgtagttttataaaatttactcgaaaaattaattttttttctaacggagtagattttcatagagaactataggtagagcatatgtgagggaaagtatggagtgcaagaaatatactatatagtattctttattagaggagtgcaagaaatgcaaaaaatattttcgagagggaagtgaaataaatgttatttatttactacttgatattacaatgcaagaaatatactatacaaaaatgtatgcacatttttgtgtcttctagccgggcacgtgaggcccatcgttcacaaaaccgcaaatacaactactcccgagtatgttttcgcaaaaatgatgcaacgcaccaataatagcattccacgtggcacatcaacctccttttccctaccatttttttcagtttccgtttcccttttgaggacacgtacttcgcttgctcgcttctctctcctccggaaactcccctcacctcaccctctctctcctagtctagagagagaaaaacacacacgaggcacgcacgcgagcgagcgagaggagagagagagagaacgagaggcgggtggagagcttggaggcggttcgtcccttgcgctcgcggagcatattccccgcccggatcccctcccccccgcgagcatatacgtgccacagagagagagagggagggagagatgg

SEQ ID NO: 9592 - DNA, 1501 bp, Oryza sativa
cgacttaaatacgaatgacgtacgaaaattctaaccaaaatatctttattttttataatactagaaaaaatacccgtgcgttgcaacgggtaaaaacatttttggattgctatacattatactctttgattttgggtcaaaaactcattttcttccttccttttcagtctcggtccagcccgctacctccctcctgcttgactgtttctcttttgacctagcccacaagtagaactataggcctagctcacatagtcggctgccatctgcttctctttgacctagcccacaagtagaactataacctagctcgcatagtcgactgtcatcttcaacctccgaaagacagtcccgtgtagtacgatgccagaaccgatactcccatcaaattcagtcgaatctttcgattgagggcttttgattcactcaatctccttatgtcgtttttatcaaaattggagtgaatccacaaaactgtgggatataaacagtgacttctaaataaagatggaatctggtgaattaaagcggaactgaaaagaaaaaaaatggggaaaatgatgatgtagtagagggcatttttttacaatcaaatagaggaggaaaagcactaggagattgatcaatgtggcggtggtgctaaggttcggcccgacgaaaaaaaacgagtagataaaaaagaatcctcaccatatacgcacacccttccgcataaaaaaaatatgaataaaaaatagagacgaaaagaaaatggatgaataaaagggaaaaaggcgatggcaaaataaccggaaagaacagtggataaaaaatacggatggaaaaaaaaaagacgaaaaaaaagaaaagcgaaaaaaaggaaaaaaggcagataaagagacgaactgataccaatccgtttttccacatgattttctttacagtcggtgattttttttaacggtcagcctttttttttacccaaaattttttgctatttttttatccggtaccaatcggacttcttatttcctctgtttttctttcgcgttttttatggtgtgttttcttttccgcgtgcccttttttatgttacggattttgaggagtagagattaaaaccgaaaaaaaaaactaaaaccgactcaaacacggatgatttatgaaagtaccgacaaaaacatctttaatttttataattgtagagatcagaggtaattcctccgtttcacagtataagactttctagtattgctcgtattcatatagatgttaataatctaaacactatatatatctagattcattaatatcttatataaatctaggcaatgccagaaagtcttacattatggagtatattatatctcattagtagagtgatcgagatcaatggatcaactgttcgttttatgaagcactgtagccataatactcgaaattatatgtcatatgccaaaatttataactattaccacagcattcggatcatgtaaaatttcatcgagattttaatgactgt

SEQ ID NO: 9593 - DNA, 230 bp, Oryza sativa
ccccctccccctcggttccctcctgccttgcgcaacgagctagcaccgccccccaccaaccttggtgccagaacggttggtgtcgccccctcccccttagctcgcttcctgccttgcgcagtaggctggcgctgccgtcctctccccttggctcccaccttccttgtgcagcgacctccctccctcttcgactcccctgtcctgccttgcgcggtgggctagcgctgccc

SEQ ID NO: 9594 - DNA, 1501 bp, Oryza sativa
agacaaatttggtcgcatgatagaaatttactgaaattaaatataactttataaatttgtatgaaaaatgacaaatttaatgtacttactttattaatatatgtgggtattgagtgcttgtcaagttaattagtttttaaggctggtgattgataaaatttcaatgtaatttacgtagcgggagacaattttggttttgtagaatgttcaggaaggatgcagcgggttattgccctaggaaactacctccactggatactaaccgtcccatgtgttggtgtggtgacgaatgtcgttttgcaatgatcacaagacacaccaccaaaggaattggatgtatcgcaactctgcgtacaatctagagaagcctaagccgaagcctaaggcaaagaaaaagaaaagaaatgtggagaagacggtggaggtaattttttatatttctgaggttgcgatcctaaaagcattgtattttgtaatgaagatcctttaaatcgtgaaatgtgcaggtaccgaagacattgcctcctctgtgtgactttgtgaaatggattgacacggagattgatccccacaatacggaaatgattcatagggaacacgaataggaagaggaacagctcaatcatcgtctcagacttgcggctatagagaacactaagaggaagaggaatgaggagagggagcttaggaagatggcaagggagtttgcggagaagaacgagcgtgcaaaggaacgggcgggaaaggtggatagggcacaacatgccaaggaggctggtccagaggccactagcaaggcgcaatgcactcgttgcacctagtagttcagttggaggtcgaggacatttttaaattccctaagacatgtaataatggcagtattgaatgttgtgcattgaaatgtgcacgagtatgccatgcatggtgcaaaacacttaaatttgagactttaagttgatgatgatgccattgaacttttctcgtgttttgatccacaaaagttatcgtatttgttcggcatcaaggaagtatgacgtgcatgtatgagagtgactttgtatgtttttttaggttcgatttttgtctcctgagtatttgaagcccatatcgtggccttctccatgtcacagcgtcctcccccctggctggcccctctgacacagcgttggcatcccctcatgcgtcgataaaccagagcggcctacccttcctgcctcggctccccttctgccactggcgattggctggcgccccctcccccctcggttccctcctgccttgcgcaacgagctagcaccgccccccaccaaccttggtgccagaacggttggtgtcgcccccctcccccttagctcgcttcctgccttgcgcagtaggctggcgctgccctcctctccccttggctcccaccttccttgtgcagcgacctccctccctcttcgactcccctgtcctgccttgcgcggtgggctagcgctgccccctccctccttggtacgtc

SEQ ID NO: 9595 - DNA, 1501 bp, Oryza sativa; identical to SEQ ID NO: 1213

SEQ ID NO: 9596 - DNA, 265 bp, Oryza sativa
gtgacacgcgcccgtgaaaccgtgaaggcggctctgataccattttgtaacgccccgcctctcccaggccaggcccacttattgtaacgccccgcctctctcaggccaggcccatttacatctggcagcggctctgatactattttgtgcgacacacgcggccgtgaaaccgtgagaggctgctctgataccattttgtaaggccccgcctctccaaggcccaacacaagtccaacacaagtcttttttgtacactttgtcctca

SEQ ID NO: 9597 - DNA, 1501 bp, Oryza sativa
accaaaacaattattgtatttttcttgtagagttaaatttattttatcttttttgtgttcatttaattactccatagattcatcctcgatgaccacatgataattttgaaattaagtattgacatgatattaattggctttgtacataatatttattattagatgcttcaaataatactcacagagtagtatagagtggtgtaatataatgttatagtaattaaattattaaatatatatcatttttgttattccaatttacatgtaaaccataaaatcctcattttatttattctgcacggttttaaataaatgataaattatgtaccaactgggttaataaatatattattgtgtttaacttcttgccatattaattagattctgatatatggaatgaaattaaaaaatattgtatttttcttctaggggtaaattttttttatctttttttagtaggccctgtcatttttatttttcaagccgacatataggtgtcggtttttggtactagcatctatagttgctgccatgttcaaggccgtccatcgaccggcacctatatgctattataagtgccgattgttgtatagattcaacagttatgatggctgccacgtaacagtcgggttatagaactagttctttgttaaaaacaacacctatctagtattgtaggtgccgattctataatcagcacgcaccaatgacaaagttattagtgccacttgaggggtgtcgactaagaaatttaacacctatgacccattttcaaccagcacatataagcttttatgtggttgcgcggaatggttaggtggtatatatacagatatatacttagctcacctagttcaaccggtagacttggctttagtgttcagttaggatgtgcgtacccgccccttcgggggacgtttaatttctcctacatttttttcaagcatgtttacatgtagtggtgctcatttcataatatgcatgcatacaacacgtacataaaaaattacacgtgggagttaactatatatgggagttaaggcttacagcttgttcgtaaaagttttataattttacacgtatatccttttccttccggaattacctggccccttctcaggcgagaggacatctgtgctttcatcacacagaacgacagggcatccgtaccaacggaaggaccggtacaggggataagcatcgtggagaaaccatggtgcgcgccgcctgaagaacccaactgctggtcgtcagaatccgcaggcagcttcttggtcacttgttaccattaattcccaagtttaaaaggccaacataaccatggctttctccacattctgaaaacttcagtctttctctcttcagcatctctactctcgctccatttctgtaagcatcccattactatatgatcgatcataagattgtaccaagcgattactctgttcttgagttgcttcgtttctgtttgttttggctcttgcagaagggatcgaaatga

SEQ ID NO: 9598 - DNA, 1501 bp, Oryza sativa
ctgatcaaggctgaggggcaaacgtgtcagtaatcgccgcctggtgaggaacggtgctatctccttgtggcggaaaacacctccatcgtgtgacactgcggtaccaacgaaggtaagccccatagtaactcccatcgtctggaggtgtctaaagtgccaagttatcagctgcgtgctcccactcttgtacagtcggatgaaccgtggtcacaataacaagctcgtaggaaagcccgagcccctttcgggaatacctgcacagcaagaaatggacacattagcaaaaatcgtacatacacatattttttgttaaaattggattaagcaaatgtaatgtgtaccaacctatgaagactatcagccaaagcacgaccaactctgggagggaactcttgatacatgcccaactgtttaagaaccctgtggacattgtgtggctcgatgtgcacgtccagcacgaggtgacaagtcgtcctccagagttcttgatcccgcgtgcaaaggtccgcgagacagtgcggtgcatgatcattgacatcgtgctgtgtgtacgaagtccaccgcacacggtcaggcataagctgatcaaagtcagctacgaactgtgtgtacacacgacgcgtcgtcccgctaacccacttcagctgcaacaagaagatagtacttatgattagttatatcaggaaattattcaactagtattgaaccggtcataatgagaagacaaacgaattaaacaaaaattatctcacggtgtgtccgcaaggattccatagtgggacgatcgtcgaggtcaccaaccctggacttgtacatctctcgcaatccgtagtttgcatacgagtccagctgaggcctcccaatgtcgaagtgctcgtgcgcccacaacatgagtagcaacgggcatccagggagttgtcacgtcctgataaattcatcccgaaataaaaatcattttccaaaaggaataataaaattaattaaaattcgaaaagaaattggcaaacactaaaatacgtacaagaaaaattcgaatgtggctcggagaatttttgttaaattctccttggtctaaaaaggagccctcaaattttacttgaattttcagaacaccggaaataattattaagcaacaaaaacaattatcaaagtttattaaaaagaaaaacctaaaaataaatcctcttcctcctttgggcgaagcccagcccgaagtccctcctctcctcctccttctgggccgcccctcccctccctccttcccgcccggcccaagctgcgccacccagccacctggcccacgccgagctgctccccgcacgcgcgcagcacgtgcggtcgtcttcctcccccagccggcctcctctctctctctctccccggaaacctagcgccgttcctcccctaaatccacgcgaatcaatgcccttctttccaaattgagtggggggaattaatccccattgaatcctcttcagttccccccaatttcccccttgaa

SEQ ID NO: 9599 - DNA, 1501 bp, Oryza sativa
ggtcaaaaagaaaagaaggccgaagatgtggagaacaagacatgcaataatttagagcctcgaacagcacctaggcaagtgtggagaaccaaagaggtaaaagttaagtgatcggtgatttcccatagtagagataaatccaatttgatgagagaagaatcatcggtcattagagataagtctccttcacatgatgctatggatgttggtgcggtgttcgtcttgccttcgaaatcgcgcaatctagaaagccgattttgctcggggggcaagacattaatatgctcatgaagaaatcaagagagatgaatggcgatggatacaacatcacatcttttgagccgccgtttgttggatgttaaggcaaggtatgagtttattgtgtttaccgttatatgcctatgccatgttagaacattgcttgctatctagcacatgtgtgtttttacttatcaaattgatattatacatacatgttgcaaatgccagttctaggtagtagaattggtaggttggcatataatttgtttgaattatgatttggctcatgactctttgatatttatttaaagccaaatcatatgtgtttttatagatcaccatataagatatagatttcatatttattgcaccatgaaagtttgcttactagtaattcagctaatgtcaatggtcaatgtgatgatttgctctagagtggttttctttaggaacattggcattgttaatattttacatacatgttcaagttgattacttacatttgtagtttattggaatctatgcatgtgacacatatgactttggtgattcattattgatcatacttcaattggctaagtgttttgatgccatgatgattattgtttcaaaagccatttgaattagtattcatctagacatattagttggatattataatttttttcatatgtctagagagaaggaattttggtccaataatttgatacaccaagcatctggctattatctgaagaaaaattatatattaaaggccgatgcttgatttcaaaagtttggacgaaattggcaaagtcatagaccaggggctgtctgaccggcattgcacggccggtctaaccgatggtaccggcggtctgaccggctttgcatagccggtctgaccgatcccaaacaggaggctggggagcatgttacaattgattaaaaggccaaattaattgtgaattcggacatttgtgcccatgagttagaaatggcttggagatttccttcgattagatatttgaaagatcctacacttaaggttgatcggaagattcggcggcaagcgcttaaatattatatcgccgaaaaatagatggagtattacttagataatgatcaatctaaagttgctaggagagtagtacatgaaggattcatgaaactcatcaatcggcccgtaagataaattggttgcttaggagagtggggtttcattggccgaaaataattgatgattgtttcaaacgttata

SEQ ID NO: 9600 - DNA, 1501 bp, Oryza sativa
tgtgttgaatcctatcattagactatggctgttccgaggttgggctttggatttcattggtcaaatttatccttcgtcatcaaaagggcattggttcgtgctagttgcaatggattacttcactaagtgggccaaagccgtgccgctcaagaatattacttgtacggaggtaattgattttattttgaagcatattgttcataggttcgatattcctcaaatgttaaaggagtttcttttatgtccaaggatgtgagaagtattgccgaatcttatgatattaagttgttgagttcttctctttactacgctcaggctaatggataagccgagtcgagtaataaaacattgttgaaattgccgttttgccagttgaggtaaatcttggctttcttcggtatttcaagcaagacgacttgtcggttgaagattacaagatcttgatgggaagcaattttgaagacgtcatcgacaagcgtttgaagactttgaaggagatgaagacacttcaagacggtgttttcagagagcaattaatgggaaatacttgaagaaatatttcccgagcatttggcaagatgcttaggaagtcctatggccagtaattggactatcgccctaagacaacatgttccatgcttttagattcacggtgttcatcaaaaaggtagggggcatgtgtttacaaccaaatttgacacctatggacgaaatagaggaaaattgccaaagtgtcgggtttccttcacagggccggtcagaccgcaggtatatgggcgggtctgaccggctagtagggccggtctgaccgcaggtatgtgggcggtcagaccgtcaaggtccgagtccgagtctgttttcgtcgggtctcaggtttccttgctcgggaaggcatgtttcgtgtttccattggtttctatcccgagttggacgtggaggagggcctgtagaaggcaagaccaacccctatataagggacaaggccggttcattgtaaaacccccgaatacaatctacttgaattgttcttttaccatgttttctattttaccatagtttagtccatctttgtcggtttgcgccgtaaaccgtccgccgccgctgcgagagtgcgacacctctttgtaggtttgtcctgaaccgttttgcccacgagacgggtagttatcctcatatcaatccaaatcggcctagaggctgattttgatctctaaatcggctccgctagccaatttagcttttctttttgcaaaacccatcttgatttggccctttggctagatcgaggtggttggcgactccatatcaccgcaaggtgtttaggtgttgcgatcgtgcttgtcgacttgtcaaaaaagttgccaacacctacatatgccaatggtcattaatttctgcacacaggaagaagaccgcaaatgtagctacgtaaagtggatcgatatggtccgaagaacttccatagcttcaacgataactcaacctgagacgaccacacaat

SEQ ID NO: 9601 - DNA, 414 bp, Oryza sativa
tttttttccaaacagtgtgcacgcctcctaaactgttaaatggtgtcactgctaaaaaaaaaatttcttttgccggctagaattagtctttcctagtggttaggctaatcacctgtgactaaaggtcagagaaactctaaagtcttcacatgcgagacatcaaccgtcatcaataattgatttttgctgaaggctgtgttattggacggccatcgataatcgatatttgtcgacggctatgttaagccggccaccagtgataatcaatttagcggggaaattgaaaatacccacgtgcaatttccctctaaccacttacaaagattagttttgaaaaacaacaatgaaaatgaccacgtgcagctgcctgcattccaaaatcgacattcccaaattccaaatccacataacaga

SEQ ID NO: 9602 - DNA, 1501 bp, Oryza sativa
atgaaaatgaccacgtgcagctgcctgcattccaaaatcgacattcccaaattccaaatccacataacagagcacaaattccaaaaaattagtcatcacatcccgaatcaaaatccacatcacctctgtcgtcgtcgtggtttgttgggtcgaaagccttgctccctcctggatctgccctccacccgccgtgaatgaggccaccggtgtggtggacgagctcgcacgcccacgcgacttgccgacactgaatccatcacgacgcgactcgtcactggcaaatcttgcgttcagagggatgggagggcacgttgaggtcaacgagggagggaggatggactcggcgaggtagggcgtggccagccaacggcagaaccatcactcttgaggcccgctagagccgtatctgttctctcttgactcgccggcaccggatttgcttcctcgctactctccaccgtcccattccccgagccgctgctgccaagcgtcgctgtcgtccccgccccctttctccctctcgagcgccgctactgccgagcgctgccattgtgccttcccccgctctgctgccaccaagtgttcgccatgccccctcccccactccatcgtcgccgcccctttccctgtgccgctactgctaagcgtagtcgccgccgagctgagctgctacaccccatccatagctacggatctgggagagagatgataaaaggagggagagttgaggcaggggaaaaatgatttgattccaggttggtcaatgtgcacgtcttctaatccttccccatgatttttgcaagtgatgctctcaagaccccgcctaaaaaaatcaatttttactcaaatggccgtattttcgcaagcggtttttaggaccacatgttattgttgcaaggaaagctttttcaaattcaccgatgaaaataaaactcaaatgttatgaaaaaaatatttttctaagtagtgtgttcttttttaaaaaaaaatatgcatggaagttgctttcaaaaatcatagtattaatctattttttttaaaaaaagttaatatttaattaattatgtgctaataagtaacttctttttgcctgcacgagagattagttgccaactcattgagccgaacataacctaattgattacgcattagctattaaatacttaaaaatgagttttttttttcatatttagtgaaactatttgataaaaagtttgttcataagtagcaccgtttagtagtttgttaaaggtgcccgctataatctaaggcgatcgataccactttgtcggagctggttagtggcgcgtgcgatcaaatcattaaaataattaagttatagatattataaaatcggaaaaaaaatatttatttgattttttgaaatgaactttaatacgtacttcctccgtttcacaatgtaagtcattttaacattttctatatttatattgatgttaatgaatctagacatatttatattgatgttaatgaatctaga

SEQ ID NO: 9603 - DNA, 827 bp, Oryza sativa
ctttttgaataacgtttgaccattcgtcttattcaaaatttttatgcaaatataaaaatatttatgccatacttaaagaatatttgatgataaatcaagtgacaataaaataaatgataattacatagctttttaagactgtacatacggtcttaaaaaaaagcgtgtgatgaatactctcgtgcttgcgcttttgctgcagaagccacgagctcgcagttaaacaattaaagccattcctgaccaaattaaattaattaaaaagaaacactagcatcgtgcactgattatggatgatttttaccatagatttgatcactaacaccaccaaaaaaagagatgcacagatacatatatatgagtccttcctttcttggaacgcacctgcatctccagcgccaggagcgtcgggaacaaaaggaagctttcggccttttgagacctgatctgagcaccggcccgccccggcccggcccagcccagcccacagttgagaagtgaacccaatgagaagggggggtggttcatacgcgatcagctgcgcgcgcggggggtcagccgcacccccctcttctctcatatgtactatatacatcatatatacatcatatgtatatacttatatacatatgtgtgtatatatatatttttatgaatatatttcaatgcataaaaaaatatacacacacaaagtttgtatacgcactaaaaataaaaaaaatagaaaatatatcacgtatagaaagtttgtatacgcatatacaaacgttctatacgtacgaatacaaacttggtatttataaaatctttaaaaaaaaaagaaaaaa

SEQ ID NO: 9604 - DNA, 1501 bp, Oryza sativa
ttgcgagatagaaatggtttgcatgatacacattacctttcatctgtatagaacaaagtatcttgaactgacaatggtaataagcaaacagagataactgcacccctaattttcgcaggaacccataccttaagctatagattctaccatcataagtttcttatgttataggatatcctatcagattttttttttgggctagccgccaaggtgaggtcgattcattggcagacgcggaacagatctggacacgaaccgatcttggtcgatcgaaacgaacgatctgggacgagtcgaggggcgagccgacctgggactgggaggcgttggcggagagggatcgagggcgacggagagcggcggcggcgggggcgggggcccgcagcttaccggcgaggtagcgcatcgccatagcagacggagattgatcggcggcggcgggctagggtttgctcaattggggacgaggcgaggcgacgatgcttgatgcttcctcgactcgaggggggttcacttctccgttggatccctttctatttatttattggaattacgggaaggaacacgactgtgggctgggccggtcgtcagaacggatccaatagctccaactccaacacggactagttgaccaacggatcaaaccggtccaactcctaaatttagctttctgtagtgaagttgtggagctgtctaaacctagctccacaactctagttcattttgtgagagagctccacctagctccactcccagttttagtggagctgaaacggtttggttgagctggagctggagttggagctgaagttgtgccaaacatgccccaacattttcttttcatttttcttatattataagtcatttgactttttatttctaaaccaaacatttttcagtttgatcaattttataagaaaaaaaattaacaacatcaaattaggttcattaaatcaacatttaatatattttgataatatatgtttcttttgctttgaaaatgttgcaatatttttgacatttttctaggtcgaacttttttagatttgactaagtctgtagaaaatttagcaatatttatcaatgttatagataaaatatacctaatatttttgtgttaggatctacagggcttaccatatattaagtcttctacggaatccagcctcatatatgaaaggtattccagataagaaaaacatgccgagttctacttgggcacggcaacgactactcggatcatatccatactcgattttcctagttttacttggatatgggacacccagagtataaatacaagaccccaaggaggagaggagacacgctaagacaaatgcgaaggcaagcaacatgtgagagctctacgccactatgctgacagagactaaaccaggtcattccaaatattatactcgtatgatactgatatatgtataaaggtaacaccgacttcaaccaaccacaaagtatggctattacctgtcagttaggggcctaa

SEQ ID NO: 9605 - DNA, 1501 bp, Oryza sativa
tgtccgtcttatatgaaatttttttataattagtattttcattgttgttagatgataaaacatgattaatactttatgtgtgacttatgtttttaatttttttcataatttttcaaataagatggacggtcaaacgttggacatggaaaccaggtttatctttttttaggacggagggagtacgtaacaaagtgtattttcttttaaaaatactatatatataaattacttaaaaaatcatattgataagtttataaattttgtaagttaatatttaactaatacattaatagtgcgggaggtggaaggccccatcatttagctttttttctaataagccgaaagggaataaaaatcaatttatagataaaacttttatatatttgttattggtgacttaaaacctaatgctgaaaaagaaaccacgttgaaaatatctcaaaattaaatttaaaaacttaaaatttgtctttttctttagctgattaggctatcggatgggatccggagactccagaacagcagtaagggtatccacaatgtacttcaaaaccaatccatagccaataaaataatacattcagctatctaaccacattgtgaaagtagttcataggagagaaatagcaaaagtcatccataaacatatgggctgcccatatagaataaaatatgtcatttgtctctatttcctctctcctcctcatactacatagtactacccatatatattgtgaatgttgcaatagttaaagtccacaaatgtgggacatctatatggactactttagctatatacattagtgttgccctaagggcatcacaatgtattctaaaagtggtccataagcaatataatatttgtttcagccacctagcaacattgtggaactagtccatagagaaaaaattatattatttgtctctacctcttctctcattataatactatttgctatccatatacacggtgaatgttataatagttaaagttgttgatataagtagtccagtgtgaccgttgcagccaccatccctggcacgtctccacaacctttgaagttcacccgtgcgtgcaccgcggcgcacacactacaccaccatcccctccccccctaccgcctcgtttcgcacacctctcctcccccccatcccatcatcaattcttcaatcaatcatccctcttctcttctcttcccatttcaattttccttttcccctcataaaatcactctccctcttctctcttcctcttctccccccaaaaacctcgcctccgcccgatcgcctcgccgccttaacccccacccccgatctccttcctcaccgacgacgcgcgccccactccccccacctcaatgcgcgcttcctagggcatatgaccggtactacgacaaccatcacctctcgccgtcaccgtcatcgtcgggatggagctcgccggcagcaacaacaagcgggggagggtgagggggcccaacgacgacgacgacgacgccgg

SEQ ID NO: 9606 - DNA, 1501 bp, Oryza sativa
ttgtcctataataaatcactgatcatctttaatatactccctcggtcccaaaataccaggaatttaggttggatgtgtcgatgtgacacatcctagttctatgaatctggattaagatgtgtcccatccaaccaaatctcttatattttaggatgaatggagtattctttagttcctttattgtttgcttttattgtgaaaaaaaaaagcaaaacgagacatgcatttacctgcatgcatctatgcatgctcccatccgtccgatgaggttggaacgcatggcaagaagggtagtagtacgcggtacgatcagacggttacgcgtgatgtaacgtgtcgacgatccatgatccatcgactaggaggtcatcaccggggcccacctgccccccgggagggaggttgcgttggtgggcccgggggagtcaaacgacggcggagatgagacggagagggccccgccgttatgctgtcgggctgtcggcgcttcacacagtggccgtccgtacgtgatgtcgcctcctccagccgtctccaagtacagctatactagtagagtagtatactactgctcctatactgtacagtataccccgtactgtactagtggcaatatcactcaaaacacatggagcattatgtatacatacaaccatcatgaatatatattcttctagaaacgaaaaaagcatgcacatcgcccctattttggggagttagttaattagaatattcagctgataggaatctttaaaagaatcggataattaattaaccataatttctgtcatgcagggtatcaaatgtaccacattaaatttttctagcaatgtaaaatctatgcatgcaccacactggacagcgaaatatatactcccttcgtactcataaagggaatcgttttggacagtgacacggtctccaaaacacaactttgactttttgtttctataaaaatatttattgaaaagtgatatatgtatacttttatgaaagtatttttcaagacaaatctattcatatattttttatattttcaaattcaacaatttaaaaattattcatgatttatattctcaaggtttgacttaaatattatcctaaacgattttctttatgagtacggagggagtatacttacaattttgtacctctcgagtacgataaaatctctctccagattttgtgcgagaatatctgaacggtttgtagctgcattatctagaagatctcttgaaaatgaacatagttcatatattacctcatgtatgtggtgctatatatatatatgtttcactggatggttaattacttctgggaaactgttttaacatgcaacatgtactagctagctagctccatttctcttcattccattccagagagctcctctatttcttttactaatctttttcccctatcaaaaagccaccagctttctagtaagcaacactagtcactttaacctcctcccttgcttttgcttactacaccttgcatc

SEQ ID NO: 9607 - DNA, 172 bp, Oryza sativa
tttctttagtcctggttgttgttacgaactttacacccggatgttctcaccaaccgggactaaaaatctgggggtatatatattcccggtgctccctcgtcttctccaccaacacttagacgtttttccatcgagatcgatctcggcttctccttcgccaccactgcctagg

SEQ ID NO: 9608 - DNA, 1501 bp, Oryza sativa
tgggggtatatatattcccggtgctccctcgtcttctccaccaacacttagacgtttttccatcgagatcgatctcggcttctccttcgccaccactgcctagggcaaccccgcgccgacgccgccgtcgtctctcgccgtcgcttggcggtcctcgccgcctccgccacagacgccgccgccacatctcttgggtgagagccgccgctgcctctctctctctctcgatctcgatctctctctccaaacctccgccgcctagctcgttgccgacgccactactacgccgcggtcaaacgccaccgccgacgaccgactttgacgccgccgcccccgcctcgagctcgccacgccgccgcgccacgccgccgggctgctacgccatgccgccgcgacgccacgccgccgccgggcccccacgctaccgccgcggcacgccgccgccgggccggcccacggcaccccgacgccgccgccgcgccgccacgccactgccgcgcgcgcccaacattgccgaacgtgattgaaacgtgaccgaacgcgaacgaatgtgaacgatacgtggacgactgtgaacgaacgcttaacgaacgtgaacgaatgcaaacgaacgtgaacgaaacgttaacgaacgcgaacgagcgtgaacgaaatgcttacgaacgtgaacgaaacgcttatgaacgaacgtgaataaaacgcttacgaacgtgaatgaaacgcttacgaacgcgaatgagcgtgaacgaaacgcttacgaaacgcgaacgaacgtgaacgaaacgcttacgaacgtgaatgcacttgtactaaaagtgtgagaacgaacgcgtttagactaatacattttcctggtaatacatatatgattatatatatgtaacttggcccgtttagactaatacattttcctggtaatgttgcagagaagacgttgtcatcgtccgtcaagccgaagtggtagctagccatcgaaggaattcgcgcaggcaagtgatgcaaagaagtgattgttagagatttaatataagattgttagacttagcatatatgattattacaattttaatataagatttgtagcgatttaatataagtttgttagacttagcatatttgattattacatttttaatataagattagtagcgatttaatataagattgttagagatttaatataagattgttagacttagcatatatatatgattattacaattttaatataagattagtagcgatttaatatgagattagtagagatttaatataagattagtagcgatttaatataagattgttatacttagcatatatatatatatgattattacaattttaatataagattattagagatttaatataagattgttagactaagcatatatatatgattattacaattttaatataagattattagagatttaatataagattagtagagttttaatattacggttagcaaatatgacctatagatctaacaaatatt

SEQ ID NO: 9609 - DNA, 559 bp, Oryza sativa
tatgtccaatgtagataatgatataaaggcaatcggttgatgatgataagtaataatatagcaatataatccagtataaaccaatcggctagcaatatgatatagtagaacaagtattgattcgaaggttaaagcacacatcggctggaggtccgatgtcatgaaatcaacaagattagattaaacagtgaaacctttgttgtcatcggctaaatccaacttatatgtatttataatccttatgagtcgatcaacgtccagataactcaccggttgaaaccccgataaaacccttattggtaatcaagaagcaggctagagattatggttctaagcactacttagtagatcaaacttaactgatgcagcactaagtatgaaaagaaatataatatctagaaaatcaagccgttgacttagttttcagggtggtagatgtctaagctaatctaatctagcaatacgatttagccgatactggcagaaaccctaaaacgagaagcaaccaatagagctaaattgatatgctaagactagattaacagagacatatgataaa

SEQ ID NO: 9610 - DNA, 1501 bp, Oryza sativa
attttaatgcacattctgcttggaattctattcgggaatttctgggcgtgacaggcagccataccactgacacataatatcgaccgccgactaacccacaagcaacaaacctaaaatacggaaactagcaagcaaacagactaagaagacgataaagctaagggcgatgactctgaagctcggagcggcgcttgcgattgagaaacaggtctgacacctaagatagacaagagataggaatcaacgcatgctcaaatccacatttaaacaaaacaacaattgactcaaataaataaccaagcatgatgatttttatgcatagaacatttttcctaatcccagataaagacactaatgtaactaactaaacaataaattaatgcataaaatagatgcatggaaaatgatgtgcataaaattgccccatcgaacatagacatgacctaatgcatctcatccgatatatccccgactgactgtcgaatactccaaataaaatttttctaaaaccctagacttatctaattttaaagatccgatccgaatgaacgaccaggatttttcccaaaaatcaaagaacaaaccccaaattttcccgaaacaaatccaagtgcaaagagcatatgcagatgaaaaggggttcagaaagctcttagggtttccagttggcttgaactacggtcaaggtcggctctgataccaacttgtcacgcccagaaattcacgaaccagaatttctaagctgaatgtgaattaaacccctgtccaggaccagctagggtacacaaacgacaattgttgacatacagatccacatcttacaaaaatataaaagattacagatgcagcggaaaaagataaagcgagctaaacttggaagcttgagttttgtagcggggcgactccactccacaggcaatccttgacggcagcgacgaaaccaacttcgacaagacagctcccactaggaagatcttcagctctggtgtgggggaaaagagagcaagactgagtactacacactgtactcagcaagtcataccagaagaggaagtatgatgcaggatataaccgaaggaggctaggggttcctttgcaataaagcagtagttgaaagcggtaaaacaattgtggtaattaagcaatattaaccaatcactgtccaacactacaccacattgcaacaagcccaaccaaccacctgtactacaccagttcattaaactaaactacgggtgagactaatcacagtgaatctggttgatcgcccataaccgcgggtatggctattcgaatagttttactctggccagaggtgtacaactgtacccacaagacacgattccacacatgtcgccatgccccgaagtatcaccgtgatactgcaaagggggaaatcgtgacaagaccctccgcataaccctcccctaaccatccacaccacactaaggtttcacccccacccccaacgggcagtgggcggtcccctcttgcaccgcgg

SEQ ID NO: 9611 - DNA, 1501 bp, Oryza sativa
gaggaaaagaggcggcggtccacggcttaccctgggtcgacggcgacgacaaaaaaggcggccggagcggaggaaggcggcggcgcagctcgggtggatggggacgacggcgctccagcggtcggcgagctcggcgagggggtggacggggtcgacggcgctgcggcgaagccggaggaggcgacgccggggcgggagacagtcccagcgagcggaaaaggccggccggaggtcgtcggtgacggaggagagagagggcgacggcgcgagctcgattccggcggggagacagcgcgccaaagggtggaaacaggcgaaggaggcgcggggagggtttaaatagggttggaagggggagagggcggccgggagaggaaggaaaccggccgagaggtccggccgccatcaatggcgccggcgagatttgcggaagcaaatccggccgtttgaatgcgagagagagagggaaaaatggggggaaagggggaggggatcacggggaatatttccccccacttaattgcacgcgggggcggcgggatgcggcggattcggcggcggcggcggtgcttggcgcgggcggggcggcgggagcggcgggaggatggggatgacgggtgggccccacccgtcagcgagggtggcgggcgggcccacccgtcagcggcgcgcgcgcggggagaaggccgagtgggccgcggggagaggagagagagagggggagggagatgggctgaaccggcccaagagagggaaggggacttttagggtttttctttttataaaacctttttaactttgtttatttcttaacaattataatttgtgctctgaaaattccactaaaatttatttacacattttaggcttttaggaaatatacaaaaatcctctaagccttatttgacttttactctgcacattttaatttttggaggctttcacacggattttaattattctaggcataatttaaaggatatattttagggtcgttttgggacatgacagggaactcgccactgagcggcggaacagtcgaatactctggcgcattggggtagtccaccaccagtgtcatgcgagccaactctgccacaaagtcatccatgccttctccgcgatggttgagtgggtgatcggccatctagagaagacaaaggggtaggatcaatgcatgctcaaatccaatttaaatgaaacagtaaaagactcaattaaaataagcgaataagagcggaattttatgcatagatcatttttgcatgaaggcgaataaataagacgaacttacatagcgataaaataatgagaaaattagatacatactaataacaataagagcataaataccttgcaacccatattcctgagttaggacctaatgcattcctcccatcaaatcccgactgactgtcgaataaatcccaagtaattttactaaaaccctagactgacctgatttggcaaatcccacttaaacgggcgaccaaaattttcc

SEQ ID NO: 9612 - DNA, 1501 bp, Oryza sativa
ctatctccaaaccaggaatgtaccattccaaactaggagctaaattaattaccatcaattaccacattatttttaatgagtagtgtgggactaatcacgaaagacattgttcgacccgcccataaccgcgggcacggctattcgaatagtttcactctggccagaggtgtaccactgtactcacaagacacaacccaccgtcatgtcaccgtgtccgcgcagacacgtcaccatgacgagtgattatgacaagacccctcgcataactcaatccaaagcagtgcactattcccggatcatagtcacccccttataaacaaggcatggactccccagcgacccccgtgggcttatctccaccacttctcagtctagtgctccgcagggagccttgttatacaaagtgtccagccgttgcccattctggcttgtggttggcacggtaaatgtttcacaaccgaaaatcgtgaaccggtccttaattgtcatgagcactaccatcaaaaccatgtgctcacaacccaccattatcaagttttagttggcacattaattaatcaaccaatcacgattgaccatcgtgagctatcattaaaccatcattaaataatagtgaagcattagttatcccaattgtgtgctaatgtttctaagcatggctaaacaattatgtctaacatctagctgaaccaatatataaagctcaactagtcaaattataataatccaaggtatcaaggaatacagtaatcaatgcaaactggccttaacaacggaataagttcacaccacccggtgacattcgaaaataaatgcacagttgaaataaatagagaatttaaatataggatcaacatgctcaaaggaattgtgtttaggatctgtgtgacttgccttgcaataactggtcttcaaataatcttctcgaacacttccggcgcactcgcgaaccttcgaaacgacggaaacgacaagctaacacgcaaaacaaggaaaaagactaataaaaaccaaataaacaatacatataaagtaaacaaacatgtagatcataattttagatgaattatgagacttgaacggcctcaatctgacttcatatgaatttattacgaattttacaagattaaatctaattaaagcctatttaaaaaggattaaataaatttagttcaatttatggataattttaatatgtagatctttattttatacaacttttgcaacttgaaccacattaaaccgagttacaatgaattagttatgaattcttaaagattaaaccggattaaagcatttatatggattttaattgaattatgacgcaataatgaattatttttgaaaaggaaaaaggggattattgcgtcagcgggtcgggttcaaggtggaccgggtgcacggcggcggttcacggaaatgaacggccggaatcgatctatccaaatcggacggccaagatctaaacggtctacgaccgatctacggcggacggcgtcga

SEQ ID NO: 9613 - DNA, 621 bp, Oryza sativa
aagagaggatatagagagatcaccaacgatgaagttcgcggagttgttccaggagttcaaatccttgaggggattctactctccgttgaggagttcactaagagccaggtctttgctaaccctttcctaaagaggttgtactaagcactcctccttccactaaggggtatctctttccttgtggaggcaagatccggccttcgcaaacttctccctgccaaccacacgtagatcggtggctcgggagtgacacctagccgtctaggagtcctcgacctcgaagagtaacaaacaccacacaactcttggtcaaaccctagtgctcaagatcgagtgaaacacacactaggtcctcaaacaccaaatccacaaccaacaagatccaccacacaaagaacgaggaggtatttgaaagagggagaaagagctcaaagatccaaagcaccttagcaccaaactcaacccaaagtgaatgagaatgaatgagttgggtaaccctagaaaaggtgggggtatttataaatcccccaaaaagtggccgttaggagagactcttttcatcccacctcggactttccgaggtgacatcggatagtctaatgttttttttgacccccaagc

SEQ ID NO: 9614 - DNA, 1501 bp, Oryza sativa
gagcaccggagttgccgttgaagacgataggctcacgaatccacgagaagaccaagggatctgacaaagaagaacaaaagggaaagatacgaagaggaaggatggatctggaagagtggaaggaaggcgactcaggcgaccatgcatggccagtggacctcatgcgcccctcgtgcaagtcaggcgaggcatcgatcggagacgaagaggaaggctggatctggaagagtggaagggaggcgactcggtgtcggtgagcgcctgatcggcggaggcggagcggcggacggtggaggaggagaactggtgggcgggggagcggtggaggcggagcggcgctgcggcggaggtggctgagcagtggccgcgccgccgctggcgtggcggctagggtttgggttagggtggagtggcggagagcgagggtgggctggggaggggacgccgcttatatatgggggcgcgcgcggtgcggcgccatggcctgcctctgtctgttgggctgggccgtgctcgtgcctaccgttggtgcgagccgtggtcgtgccgaccgttgggccgtgccgtgccgggccggcccatcgtgccaacctcggtccgtgccgtgccgggccagcccaccgtgcctagccataggcccaaggacgggcccgactgctaccaggccgtgccatgcttgggccgggccaaaatcccgtgccgtgggccgggccatcgggcctccggccttatggccaactatacccatttccccggcaaaacaattacaaataaaataaatggcatgctcaaaccattcttaaaaataaaaagctacacccagactagtgcggctaggggtcctatcttggtgggtaccgtgcccaccttcatcttcttatgggataagtatgtagcacaaggtccgcctcgaacctggcattgctctgggtctcgagcttagttagctcgtctagttacacactgctttgtgaagaggagtgttgagatatataaaatctatgtcttaagaatgtaacataaggtctgccctggacccggtcttgtcctgggtcccgggctcaccttagtccttataagacctacgctactcagtaagagaagcgtagagacatataagatctacatcttaagaagtagactaaggtctgcctcagactcgaccatattctagatcccgagctcaccttagtcctcataagtcacactttttgcaaggagtggagggtggaggcatatgattagaaggtataaaccaaggtcttcctcgattccagcctcgtcctggaatccaggcacgccttagtccttgtagtttttgcattcttctacaaagaagagtgtcgaaacatacaaaataactacattatctactcatcaaagacatcttcgagaagctcgtctgagaatagatgaatcatgacaaaaagcgcgagggcgcgacctcagggccagttggggtgatgggcgtgctacacaggctgttgtgaagcagtcctct

SEQ ID NO: 9615 - DNA, 1501 bp, Oryza sativa
ggagattggatggtcggctgcgactttggaggacatgaacacgtagaggacgacgagacgaacccaacggtactcaccctcgaaccaaacgacgaacgacgacggccggcgacgaggtctattggcggcgcggcttcggtcggcggtggcgacggggctccggtgaccggcgacagcggggagagagcggccgggcttctccacacctcggcgcaccttacggcgatgacggcgaccggcggcgacgacggaggcggcggcgcgacgcggatggagctcggccggcgacgacggcggggtggagcacgtggcggcggcgctacgaggcacgggagaccacgggagaggggcaaacgaaagaggaggactagggggtcctatttatagccttggattgaagagatcggactcctcccgcaagaaatcgatccggaaaatcaaaaactcggttttggagataaactcgaaaacgagttcgattcggataagatactcaacgattagctccgatttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgttgagggaggcaaattagacttttcgtcttgggctggctgaaaacaaagcaaagaaagaaagagaagggggaaactcggctgggccgactagggctgcacggctgtgcacacaaaagaggggggatgggccggaaagggcccaagactaggaagaggattattattacttttccaattaaattaatcaatgaaatgatctttgaattgttaaaaatacttccaatgctcaaataattccaagaaaaatcttgaacatacttggacactcaaagtacttaacaaaattataattagaccatttaatgattaatttaatatgtgggtaattactgaaatgctctttgtatgattaaaaattaggaattgagctccgaaaaaatctgagaaaattccagagagtataattaaccatggagaatttaataaaaattaaatccatccatgtcttaaatttaggaaattttatttcccacatttaacttcacttgtaaattaatgaacatttaatataaattctaataataatttattaaataatttataaatcctgaatcaaaaatcagggtgtgacacctaacaacaaaacaacttaaactcaactttacttcacaattcattattacatacataacgaattatatgtttgaatgttatatacctagaaccaaaatctaacaaaaaaaaagttcaaactcagttcaaacttgtttgaacaagtttgaacttattagtaaagaagttaatgttcatatctaaacattttaaaaaatttcatactcattcaaattgggtatatactcaatttaaatcttggagcctatactccatgtagcaccagttaa

SEQ ID NO: 9616 - DNA, 1501 bp, Oryza sativa
ctcttgatttatcattttcttttgttcgggctccgattcacaatatttattttatcgtttatttataatatttttattataggcttatttggtcgtttcttcgtgtgcgcatgttagatcgtgttgaagattccaccggattcacaggaactgaagtggacctagaaggctacgctcaagcttcagaaggccacgttccacaaggcaagccacagttccaatctttgatcatattgaaatatagtagagaaccacttagttattttctgcattgagtatttataaaattattttgcgtatgaattattttttaataaacttgttagtttagttattacccattattacattgttattattggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggtgaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgct

SEQ ID NO: 9617 - DNA, 1501 bp, Oryza sativa
ttggccaaatccatgaattgctatatcacgtcctttgataacctaggtgtagatttatatacttcacaataatattctagtggataagaccaccaaatatctatactcatatacatggtttacccgtcgtcacgtggtagcgtgtcgggtgatataaaatgtgttatttgatatgactcactcgcctggagtgatatggaagaacaattccgggtgaagatggatgctgtggtatgtgaggccgtgcatattgttataatattttgtggaaagtgtatattacacttgaagtatgcacggacctatgctagttttggtggctttccccggatataaggactaccctcttatgccatggaaaatgatgtaatttgcgcccatccacaggactgagtaattagacttagcctagtacattgtcccactatatgaaagactgtagggtggctctatgagcaggtttggggtggacatgtggaaggggcttcggccaggttgacatgatccgcaacggtggaacccgtgaaagcagcaaccgtctagccttgcttaggcccagcaagtgcccgactgctaggacggatcaatatcccattgggcagtaactagtagtaagtgggactctcgagtggctatgttgtcctcagtctagctagctgttgacatcaggtgggtaaagctaggcagtctctacagagatgagtcttaaatcatttgaatgtgctgtgcttccggttcagaagctatgtcattgggtgattcctatttatcatggtatgagtagatttttaaattaaaatatagaatatgacgaagatgaggatgaatggtgattaatattgctgctattttaacatgatgatttacaactgtttgcaaatgaaatgttttacaaagtagggaaaaactatttataataggcttgttatcaaacctccttgatgagttcggacgatcaatccttcccggaggaggtgcaggcaggggaagaattctatggtgctgatgagttcttgttctaggtcgatctgctctcaggcgttgcctgtggtgtttttatcctattttgtgtatgggtcttttgtttgtagggagtgtttttggcctgtcggcccctaaagcctgtcttagttaaagatcgctaccaatccgggactaaagatcgctatcattagtcccgggtgaaataaccgggactaaagatcgatctttagtcccggttggtaacaccaacgggactaaagatggctcagccacgtggccggatgagccatatttactcccggttggtggagctgaccatttttttttttcatggccctgttgctgcatggtttatatatattttatatatatatataaaccatgcatatatatgtttcaatacatatatatgcatatataatatatgcatatatatatatattatattatatttatatatgtttcaatacatatgtacatgcataatatatatgtatttataaatatatatgttatg

SEQ ID NO: 9618 - DNA, 1501 bp, Oryza sativa
ttgcgagaccgtagacggtaagccaggactccggattggtggtgccgtcatacgtctcgattccagttggcttgaggccggctggccaatccactcgacgcaggtcgttagtaaagatactccatccatgtcgtcgtcgtagcgatctggtgaatggcattgacctcgtgctgcacggcgctggttgatcgtatcgcgaagatcgacaggacgccggcgaagtggggagcgaggacgttcaactcggcgctccttgtgtcgctcgggaggcgagtgaacagatcgctcgtcgtggcccctgctcctgcgattggatcctgcgccggcgatgctgaggcttggctggtgataatgtaacatactgaaaattagctattttctaatcttgcatcatgccgggttttatgttcttaattacctctttaaacttaggaaaatataattaccgagacctcctaaagctaacctgcataaaatccctctttgatattcaaaagcctttgtgattttcatttaaaatttatctcgaaatattccttaatttggttttaatctaaaaccttctttcgcctaaaatttcctttatttaaatttagtttgaaaaaccctttttactattatgaattatggtccaagaaaccatcctatattgtgctagaacctaaaccaaagcaattccgattttattggaattaattgttagcccatcctttgatcttaaacccatcctttgattctcaatccaaatatccaaataggactccttttgatctagccaccaatttaatctctgtggcttgatttcctctttggcacaagaataatattgttacaaatattgtgaataattgatcttgtgctaagtgaatagactttatccctccgtcccaaatccaaaaccttatttagcccatatctaattctctaaatttcataccacatattttgggctaaaaatttatttactctactccctccatattccctccacatactcaaaaatattcaaatctagagccaaattatttatggtgttgaatattttgaatttctatttgagtgcattaaataaactccctctccaaaatattgcactcaaaccaactagagaaatatttcttttggaaattatattcaaatataatttccttctaaactctctctcagtcaattttccttcaaattcaaattattcaaatcctttttcaaaatctagccatccaaattcctgtaaatctattatttgaatctctaggaaaattagacttcttcctttttaactttgagccgaattcttcttctctctcgcgcggcccaagtcggcccatagctgagccgcccctcctcctcccgcaagcgcgcatgccgtgcacgcgcacgccgccgccaacgccctccgtcgtcacgaagtaatcggcgccgtcttttcttccttcacgccagcatcgccgtggtcaagccgtcgaccgtctccagaaccgcctctctccaccgcctctcc

SEQ ID NO: 9619 - DNA, 1501 bp, Oryza sativa
acgtagataggcatgttagcaatacaagtatggttacttttaattggaaaataccacgtagtataactttcaaaacaagttatgttattcttcagctctattctagtttggattttaggttacatatcaccttggtaagcaaaaaaaataaattagaaaaaaatcattttcatcctctcatgttactagtatttactgcaggtgaaaaccatcgtctaaatccccttgcacttgcttgcgtcctttagtcaccagcgctggtatgtgaaccgtcatcttacgcctcatttagcttggctgccttgaggcagactctggggcggagtcctacacgcaacaagcgcgacaacaaaaacaagtaaatgtcccacgttccaaccgatacgtgaggccaacgttgattggtgtgtctctcctagctggagcccacatatgagagacatgtgggcacactactcgcgcgcgcctgaaaaattggtccactcacgcaacacatggttgggcacgaagtacgaaaaaagaaaacaagcaagcatccttatgatctcactagctcgcagaggcaaaaagagacgaacaatcacattaaaattgctaacatccgtcgtggacatcttaacgatcggcccaacgtgaacaccttagagaagttaaatgttgtattatctattggctctgttcagattccttggatgggaactaatccctcccgcacggaaaacggagcgatcaattagtgcgtgattaattaagtattagctattttttttcaaaaatggattaatttgagtttttaagcaacttttgtatagaaactttttgcaaaacacacaccgtttaacagtttgaaaagtgtgcgcgcggaaaacgaggaagattggttgagaaacttagtgccgaacacaccctgtaaatggctctttttccaatgtcatatataagggtgtgtttcacgtcaaaattgaaagtttggttgaaattggaacgatgtgacggaaaagttaaaagtttgtgtgtgtagaaaagttttaatgtgatggaaaagttgaaagtttgaagaaaacgtttggaactaaactcatcctaaaggcggctggtgttgtagccaattacaaattcaacacctaaatttaagcaaacacatgcaaatacttagataaatttaaccagaaatcaccaaatggtaaatttaagcaaaggtttgaatcaccaatttctcaaccaaaaaaaaagaaaaaaaaggaggaggtttgaatcaccaaaacaaccgtggccccaccttggcagaagccttctcctccgttccctcccttcctcacctccttttccgatggccacaagcctccaaatctcagttatatatccgccgtcccttgctccttaccagaccttttgcccccctcctctcctccgcctcctccacacacgagcgcgtcccccgacgccgcgccgagatctagggttgggcgcgcgcgacgccccccccccgcggcgaggagga

SEQ ID NO: 9620 - DNA, 1501 bp, Oryza sativa
aaaactcctccaaaaaaaaaagaaccgaaaacacctccaagactccaagtcagccggcacatctatgggatcacaacccccgttcttcctgatcactagaatccaaataccaccagagcaggtggaaattttgttgtacaatgttgaattttttttctttgtttgattggaccattttataattgattttaccaaaattatagttcagtattgtatgctacaggttgtctggaatgagaattaagcaatattacatcagaaaattagacatgctgagtccttccctgcaaaagaaaaaaaaagtgagtcaatttaccgaaatacattaagcctgtccagtaggagaaaatccaactaggtaggcaatgacatcaggttgtataacctttctaatcgccagctaataaccattatcctatgccattatgctcccaaaaggtcattagcataacagcaatgtagtatgtattaaaagcgagagaaagataattctcccagtaacagtcatccatgtccggttttttccacgcagatatgaggaggaaatgagaatatggtactcaagtctgaacagctaattgcccattagcgtgtctttagcatgtaatgatatcgaagtaattttagtgataaatataacaaaattataactaaatgaaagttcaaatttatgcgagctaaaccttcggtgtttaggtttcttgaggtgaaaactatctttccaggctaagtattaaatttaatatgagtgcttatatttatggttaattatttttttaaattgataagtgatatacagtacctcttaacagcgaggccattaatgattaatctcaatgtatgccaagtcaattctacttttaagattcaactatattatacgcgcttcaatttgttttacttttgaaatcaatttcaaagtatgccgagaaacccgggctaggctaggggaggttagcctgcgttcgtaccatgttttcaaaaaaaaaacaaaatttactaaagtcttttaaaaaattgatttttattagctataaacagaagttctttgaaaaataaaaaggagtactccagtatgcacagagcagaagtttggaagcttccaaagtcaaaatcaggtcatagaaaattttagaaacccacggatcacaacatcacgtgaaaaaaaaaagaagaggaaaaactagaagttgccgagagccgcgtggtgttcgtccggtctccggtccagagcgggaggcggccggcaatccgcgacctccacctcctcctcctcctcctctcgtcaccaccaccacggcgaccccgtcctcctcgcccctctaaaagcctctcccttcctttctctctccccttctcgtgggatcttgtattcttgcgtcgtcttgggactcttgtggtggtcaagaacgaggacgagagaggtcggagagcgaggcggcggctgtgccgttgcgcgtgcggtgcgggtgaggtagctagcgagcgagaggggagatgg

SEQ ID NO: 9621 - DNA, 1501 bp, Oryza sativa; identical to SEQ ID NO: 3213

SEQ ID NO: 9622 - DNA, 1501 bp, Oryza sativa
ctggtgatattttttaatacttcggtggtagccttacaataattattcaaacttctaatagcgtcccataaatagagattacacttatactctctctgtcaaaaaaagaatccaatcttcgagatgaatctggacacaatatatgctcatatttattcttagaattggatttttatgagatagagaggagtatatttgagtggtgagaaattgtaatagcagcccataaactgacaaacagagataggggactgctaatgcgcgggtgatcgctgggaacgatcacccgcacccgctccccctatacgtacgtccctcttctccccctctcttccctactacagtaaaccacaattttttttaaaaaaaaataaaagttagaaaaatttatgtaaagaaatactatatataaaaaatttgaattcaaattcaaatttgaatcgggtatataaacttttgacttacaaactttgggtctataaactttaggtgtataaactttagatgcatagaaatactatatatagaaaatatttgaattcaaattcaaatttgaatcggatataattcaaattcaaatttgaaactggtatataaacttttgacttataaactttaggtctataaactttaggtgtataaactttagagtatagaaatactatatataaaaaaatatttgaattcaaatttaaatttgaatcggatatataaacttttgacttataaacttttggtctctaaactttatatatgtaaacttgaggtatataaactttaggtgtataaatttactaaaataggaaagtaatgcggtaccaaaaaaaggaaaccaggtggagggagggaggggggaggtgatcgccaccccatccccagggcgatcgatcgcccaacagcatttccgacagagataacatttccatctatgattgacgagagtatgaataatcattgtttctgcgcagtgacttgtaagttagactgcttcctccagttttaactacctgtcaatgttgatcaatataatttcagcttggatcatcaacaaattttgattggtcagatcataacgtgataagtatttcaacccaaaaattggtagtcctacatgttattgagatatcgatggtatatctcaaactttgcaaaattataatagcatggttccaatttaaaaaaaaaaaagctacagtacacttatttgccgtgagactacatcacgagacaaatttatagctacaattatcattgtactcaaaagttgttgcgacttgatcacatcccagatgatgtttacttgggagccaacaaggatttctagaattttaaaatccgcgcacgaggagcgcgagctgcaacgttgcaccttagaatgacgcgcgacaaagctgaaagctccttaaaattatggacgcccacgacacacacggacacgcgttgctacctcgccattggagaaccagtttgctctagctgctccggccgcgacgccgccgtt

SEQ ID NO: 9623 - DNA, 1501 bp, Oryza sativa
tcttcaaattgtggttggtgaaatatgagaggaactatattgagaggcaaagttttcaactatggtgatttgctcatcgagtgagttccacaagctgatccatgtactgctcctgagcccacaacttgcccttcttcctccaccataacgcgctgcacggctgcaccactgcggcgacgtcagtttcggtcgagaatgagctgttgtcatagacctctacgccgacgcctctctccggcattggcgcattgctcaacgaggccctggttactttacctatcttcactcatcatggagccgcgcgtagtctaaaaatgttatttgtcgtacatacgttctagtgcacactttcatatgaaagttttttatagaacttcttcaattaaagtatttctatgaaatatatagataaatgtttttccgggtgaaacttttgcggacaaaaaatttttggatgaaagtttttagggggaaaaaagggatttgttgggaacgcaagtgcgttaaatagtagtccccatacaatcaccaaatcaccaagaccataaattgacacatcgcatgccaccagggcataataagattataagtcatcgcaacaatattcaataatctctacgatatactatattttaaaattttagactcccgctatatgtttcgtgccaagaccttcaatttctaactacgaccttatgaatcataatccgattactaggatcatccaacgcgtactgccactttccagatcggtgaaatggccatagttgagaactttgcctcttacaaaatagtttctcacacgtttcaccaatcacgatttggagagttagagttctcaacaactatctaaaagataagtaattgatgcaacgggataatgattatacacggaattaccaccgaaagggcctgtcaatctctcactctgcgtagtcgtttttttacggtaaccatgagtagtcactagtgattaatactgcgttaacagtgagtcagagactttttttttttaacccttcaaatatttttctttcattctcgaaaaaaaaaatcctttcatcacctcttgtatagcatgaaaactctactcatcccttaaggggatatcctattcttttttcatgtcacttaaaaaatcataaaaaataaaaaaatagtgatatatcacttcacaaacatacatatttaaatttaacttataaaagtagaaacaaaaataataaatttgactataaatagaacgtgtaatacacgatcaaaattgttatctttattttgaattatataagtcagattttaacttgtatgtttgcgaaaagatatatcatatattgatctatcttgataaattttttaacttttttataactttttgaacgtcatgcacacaactagagtatgtcccatcggagggacaaaaatccacttcctatatagcattgcacccgaatatcaacctcgtcaccaatggagtgcactgaagccatgtcgaggacat

SEQ ID NO: 9624 - DNA, 1501 bp, Oryza sativa
ttatttttaattctgaatttcagctatttttaaattgtattcctacttggactctcattttcttttctaatattagattttattttatttttatttcgaattttgattaatctagtattggattcttatatggaaacttctttcaatattgcttatttttaattccgaatttcagctatttttaaattgtatttctacttggattctcctttccttttctaattttggattttattttattttatttttatttctaattttaattaatctcgtattgagttcttatatggaaacttctttcaatattgcttatttttaattccgaatttcagctatttttagattgtatttttacttggactctcctttttttttctttttctccgattaatgtgggaatttatagcccacacagcgaacgtggtacctcattttaaggctttttaataatataatagatatataggatttttttttgcataaaatgtatcttgggaaacgtgcaaataaaaaaaatcctttttaattctagtgtgaatgatggattaatactaaccacaagatagttggacaatatcacctagctaaaagaaaaacacaattacacaagaacagttctacaactcaaagtatggttggactgttggagtaggagccggtagtctgtaaggagtaactattgaccgaactttttacattttcaacaaggtattgttaaccagagttactataaagaatcatcgagggatacaaatgggactttttccaccaacggacctgttgacccatgtcaccaccctagccacccaatcgaccttccccatcctctcaacctcgactcccgtctcctcgctcgctgcgcgcatcaatctccatcctaccaccagcaatgatgcgggtatattattccgcttccatcacacttttgtctcgaatttgaattcaccatctgcaccgatctccatcctacgagcgccggcggcaccggcatagccaaacggtttccataaaatacccactcatatagtcatatgtcttttttttaaaaaaaaagtttggtactgaaacctcaccgaatcataatcagataatcctaagttctaaccgattccgatttgaacaaatttgactattttcagttaacccttacccaacaattttaatttagtttcaattttcttttatggttcatctagaaatccctctaaacgatcttttttgtgcgatttctttttcaaagtaaaaacgcggagctgagagaagacgacctgaccgcccgcgtactccacctctaacctttgccattcccctgtcttcttccatctccaaatccttcttccctaatccccctcgccggcgaagcgcggcggcggcggcggcgccttcttccctaatcccctcgccagcggggagccgcagggcggcggaggcgtgcgtcggctgctgctgctgcgcgggcgggggaggtggggagagatgcacagatccgcgggcgccacga

SEQ ID NO: 9625 - DNA, 1501 bp, Oryza sativa
aatgtgggatgggtcctattcctcagccacatattggttaccttatgccattgataacttgggtatcaaaatgactagatgttggcttaggaaatgcttagccatgcttagttcaactaggacacaaatggggatcacattattacatagactctgactatgggcatagctttagattggtgccaccgcaagggtgtcagttaattaaaatattctgaatggcgggctatgagtgcatggttttgctggtcgcacccatggcagttaaggaccggttcacgggaaaccctgggagacttaccgtgcttaccacaagcgggagtcggtaactgcttgatctgaagtatagctcgaccctttcctaggcaccggtggcgagggtgggcgtgatggagttgggtcggccgaggtgttcggttgtccagttgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttagcttaatgaactggtgtagttcaggtggttggttgggcctgttgcaacgtggtgtagcgttggacagtgattggttaatattgattaattactacagctgttttactgctttcaaccactgctttgaaatgcctgctttatgcaaaagaacccctagcttccttcggttatatcatgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacatcccctcccctccgctgggccggccgaaggccaaggcccagctaggccggccgcctccctcctcccacccgggacgccgacaggtgggccccacctgtcgggcccgtctcctacctcgcgcccgcgccgccgcgcccgcaatcgccgccgcgcccacgcctccgcctcctccgggccacgtcggccacacccgcgcgtgcgccgcacctcccacgcccacttccccctctctctcgtccgctcccgtgcccgaga

SEQ ID NO: 9626 - DNA, 1501 bp, Oryza sativa
tccctcgtgccccccatcgctcccgcgccgtgcaaccacccgccgccgccgcttccgttactccggttgccgctagccgccgctagggtcgccgccgcaccgcgccgtcaccgccgtcgggttcgcgaggccaaactccacctcgtccgccccttccccgtcgggattcgtcgccggaattcacatcccctcgcgctccggtgagttctacctctaccgccgccttcggccatggatgccggccgccgtggttcatctccctctctctaatctctctctcttccttccttagggcaccccgaagcccgtccgccggttgccgtcgtcctcccgtggctcgccgtcgccgttcgccgtcgtcttcctccgcgccggccaccctcggtgaggcgtcctctcccctctactcccctccctctccctcctagtaccgcgccgccgcttcaagtcatgcgccgtcgccttcggccgccgccgccgcctcccgtgccgccggtcgccgtcgccgctagccctggccggccggccggctttgatgccgagccgagcccggcggccgcctctatcgccaccgcccgatcggctcggggccgatctgggccgtcggtcccgtggactggcggtggaccacccacgtggtcccggtccacggtggaccggccccccctttgagccgctgaccagtgggacccgcctgtcggcgccgcccccctgatgacgtcagccctgggagttattgcgcaataaattatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagtctgtttgcaatgtttgccttgtatgtcgctagattccggttcttccgacgctccgatgtacttcgaaatagtcgccgaggttcctccagcagcagagcaaggcaagtcatgcttgtcacttgatcatgttgatcctatattgcaaatgttctaatgttttctttcaaatactgcatttgttttgcaatatcactatgggatgtttacctattgttacagccatgctattttggtaccttgctcctttgttagctcgggttataacatgaatagacgttagactaggagttgcttagccatgcttagttcaactagcacacaatggggaaatctcatttaaaatatagactgtaggttcatatgataatgttggtttagtaccaccgctttggtgttggttaattaaaatgaatcacatggtgggctgtgggtgcatggttttgcttgtcgcacccatagcaattaaggaccggttcgcgggaaaccctggaagaatttatcgtgcttaccacaagccagcgtgggcaacggctgggcttgtagtgtagcttttctctagctgatgcatccaggcaagggtgggcgtga

SEQ ID NO: 9627 - DNA, 1501 bp, Oryza sativa
gccccactccgcccgcggcccgtcgccactctgaccacccgctggccgctccgcccctctgctctgctcacgacccgccgccatgcgccgctcctttccccgccggcgataggggcgaggcagggagtccggcgaggccggcaaggaggtggctgatccgcccgcttccgcccctctgctccgggcgtatatagaggagaagagggagtagagagatgacatgtgggtcccacgtgtgttattattttttgtaaccgaattgtcacgtaagcgccacatcaatgccacgtgggatgcagacctagtcaaaggagctacataggcgccacatcaactaaaaccatggtcaacactgccgagggaatttgttcgcatgattttgtaagttgggaatgtgtcatatcggttttccgaactaaggacgaaaatcaaactagacgacaaattgagggacctagagtgaacttattcttcaatcgaatgacaggcccgtatttgggccgaaaggagaggcccggtgacacaactgcctggttgccctaccatagtctattcagtattccgtctgtctgcactctgcaggagttcatcaaaaaaaaaaaaaaaagagccgctaatgttccatcaaaaaggaaatctgttcacgcggtacttgagacatgaatgcatatggctaattggccggcatgcggcatcaattcgaagagacgctttgcagtttgaatggtgagcactgagcacggttgggaagtggatggtcaggaggatacgaagccctcttcaagacggaacagagtacggtgttaatgcagaaactctcaggtcagcctgctcttttaggtacttacggaattgtgctggttccagcatctcttagcgcaaacccgtgatggtggttgattgatttcgagcctaattctgttattctgtggggacctgattgttgtgtttgtctttgccgatatttgtagaagggaactttctgcaacttgcattttgcaatcctggggccttgtttggcttaatcccctgtgtagttgtcttttgtcgaaatcgatgatcaaacgaatcagagaaacaaaagaaaactctaagttagacttgctgggtaaagtctttcactgatttccttgaatgcctcttaaaatgcgagggtttggttccaacaagaagacctcttaggatgcgttctaaagagctcttttgctaggcttcttattcatttattaagagcacgcttaccaaactgctaaactatgaatatcgtgaataaagttttctttaaaaataaaaaaaatgtttttaaatttataatagttattaatactctgtacagattcatagtattaggatatgtcacattcatccaaaatctcttactccctccattccaaaatataaggcacaactacccttaacccaaagaccaagaaacaattattatcatctcctagtttaaatcaccctaataaatataatgcatgcatccaataaattctga

SEQ ID NO: 9628 - DNA, 1022 bp, Oryza sativa
tcaagcacatgatgcatgtaattattgagtgaatacccagataatagatcctgcgtccccaggtgccattgtatccttaaggtcaccattggatctagttgcaccgaccttaatggtatcaggctagtttgatgaaggacgaagggaaaagtgagggaagcagtaaagcaccaccctccctaaacattgctggtgcacactgagtcactgactggtcgtggttgactctatactgtggggcaccaggcaagcaacaagattgaaactaactggacggtatttggcagattgggcgatcagcggctatgggcaaagagtttaaggaggggagcatgatccctcatctacatcgtgctttgatggtcgacatgctttttgaactccacatgtgtctccgttgctaagaaagaagaggacactactagaaaaatgtttttttcaggctgccaaaaatgattttttccggcgggggaacgatccatttgtatgccgatgattttcgcagggcgacccagtcacccgcctgtgaaaatcatctcgacgaacaaaaaaaatatcgccaccaccccacccgcgcccctaccaatctccggctgatctagggttaggggaactgccgccgccgccgccgccgccctcccccagcctcactccggccggatctgggagggaggggaactgtcgccaccgccaccaccctcccccggcctccctccggccggatctgggagggaggggaggggaaccgcgccgaccccgccgcctcgctgttgccgtcgtcgacctcgcgcctcgccgtcgccgacccgccgcctccacgcgtttctaccgcccctgttgctggtcgctgagggagctgagggagaggagaggagagctgagaggagaggtgaggtgagacttagaaaaaatcgcggtgccatgtcgtgtctatttatatccatgccaatttccgcaggcggatcacataagaggtccgcttgcaaaagtaaagggtatttttgcatgcttacttttgcagg

SEQ ID NO: 9629 - DNA, 1501 bp, Oryza sativa
ctcgaagggataatggcaacagattaccctggaaggcaggcttgaccacttgaccgttcgagagtttgaatcagaagttcagatttcagaggcacgctcctgtgatacaaaaccccgtgagcacagacatgttgtagttgcgtgcattcagttgaagcaaacacaaccgagtattcagctacctggcgtgcgttttgtttctgcgtctttaataagagccggtgaagcaaacacaaccgagtattcagctaggggggaaaaatgagcattacgctatcgactatggaggtgaattttacgcgtattcggaggggtaatctagagagaaacttatcacaaacaattggcgtgcgtgctcaaccgctgcctcttgtatgcgagggacatctcggcgaattgttcatgactcaccaaacttttgtgggtggccacgaaaagctccatgccactgaacccaaacgagcggcagagtcacggccggtgtttggtcgcagtataagtgtaaccccaccttgcttcaacagcacgcgtccgcccgaaccgatgaaaggggaatggaaatctgctagggaattgagctaaacactaaacaaaaggaggtttcctttaatattttttctctggttgttgtgcgggaaaaaaatcattttaagtaagaattggatagttttattaaaattagcccaaaaaacttcaaaaatccttgtgtcccaaggcccttttgaaacatatatgttttactcgattaacgcaataaattaatattttgagaaataaattttatagatactcctgaataaatggtctaacatagtactatctccatatcaaaatataagaatttttaaagtttaacacgattattaagaaaatatgtaaaatcaaatggtgattggttgagaaatgatggtaggtggagaaattgaacggcaaagggttatgattggttgagaagaaaatatcggtggagatgttattatattttagaacaaattttaaaggctaatagttattatattttgggacagatggagtagaagaattatcgtacttttagaagcatcgagcaaataatccgcgacaaaaatccaaaaagaaaactgaaaagagcaggggtcaaaaaaaatccatatattattttcctagtacaaaaactaatacaaaaccaaggaggagaagaaacatactgggtgtgtgcttcaagtcaccaaattcttggtggaaaatactgggttcgctgaaactaatactagtaggaagccgattacaaccaaacaaaatctgaatctagttttgctaaaagtcaccagccatacgaaacttgcaaacctcatccaaaaggaagtagagatagaaaacggtttcaccaagaaaactcataaaaaaagaggcggacaggagagagaaaacacagtgttgtgatttgtgaagtccggattaaaagggagactactgtgcctcctccgttttcctcttcttcccttctgcagctctcctcttc

SEQ ID NO: 9630 - DNA, 1501 bp, Oryza sativa
ttaaaacaacttttcaaaagaatttttttttgccaaaaacgcatcgtttagtagtttgggaagtgtgcgcgtagaaaagtagatgttttctcctcaatctcccagcaatctctcctgctcgaacggagccatgcttgtctgcacgggtaatggctactccctccgtctcataaaaaaccaacatagtacttcctagtacaataaatctggacatacatatgtccagattcgttctactaggatatgtcacattctatattttagatttatttttttttggacggagtgagtaacgagtaacgaggctacggtattaacggctcggaatgtttgcctgtttgtttaacgagaataaatgagactgacaagtgggcccattaatttcgcttgctaacacgagtttaatctgccaatttgggctccacatgacacacattgtcaccacccagccaggcccacgcgcgtggtcggtgaaaatgctaggcctacttactgtgccagcccaaattatcctactaagtacaacgtaaggaagcgggctggagaccggacggaatggtatacctgcagtactgggccttctcaaaggccgtgttaccagccgacaaaatttttggtccactagaaaatgttaccccaaatgttaatgtattatcccaggaaaaagagaaagtgcctatgtaatgtgtcagttctatggttggctagcgaatgaaaatctgccgtactaaaataaatagaaaatattttatggacttggaaaaaatggtggcgtggaagtacccagacaactcgatctaaatgggcagcacatactactccacatgtactacggacactatcaatttgtttgtattttaacaggccaaaatcttctagaatacgaattatgctacagttaaattgcatggtacaggactacagttacagggagtataattgtaccagaaaaagaagaatgaaaatgaaagtagatccatccaaagaatgcgaaaccacaccacacacacaggtggtactcagagaaaaggagcgagcaaaagagaaagcgccacatgtcaccctccaaaagcacaaacaaaaaatcagggtgtgtgaaaaaagagaagaaaaagaaaaagaaaagaaaaattcggacagcatcagcacaagtagtagtagtgcacagctcactcgcacagtctcactgagccactagcccaccaccaccctcatcctcctcccagctcacaaaaacctcaaacccccagccttctcgggcctccacagaaagccgaggaagagaaaaaaaaaatggagctcttcgtctccaccgtcgcctccgcgcgcgccaccgcccccttatgcttcgcctcctccttccaccaccgccgcgctgctcctcccgccgtcgccgccgccgccaccctccgccgcagcaaccgccacctcccgactcgaggtgcccgaacgcgccacgattttttttgattgattgattgattatctttctgacggtttt

SEQ ID NO: 9631 - DNA, 1501 bp, Oryza sativa
acaaacaaaagtcacaactaggatgaaacatatcgttgttgctagtaaaaaacttcatgaaagacaagcacatcatgaagcaagtaaagttgataaaagaaaattataccagcaaacataaggcatggtgttcataattgatgaatatctttgttgcagccacatatgaatcgagtattgcttaacaggttgttcatcaatagtgaaaagccttctgaaagctgttcctagattattaatataacactgttttgcatagtctcgtatctttcaaatcacgagcagttgatccaaatgcaaatgttgaaatggattagcgaggaaaacagaagtattagaagaactcagggggttacatgactgctgccactcagcagatgcccagttgaatctgaaactggacagaaggcagaaatcgctacggagcatcaggactgaagcaattgaacaggctgcctttgtgcataccatccttcataaataatccaccatattgaatctttattcagtggattcaacagcccatcacagcacaattatacacgaagttcccagatggccgcctggcaatcaaattccacacaggcggccgctcatccggggtccatgaattaagctcaatcgtaccaccaatagaagtccttgggccgccgatgacaatcaaccgatcaccacatgctcggaaagcaaggccccacccattcattgacacagaccgttcaggcaacttaccaagagtgatccatttattgttttgcttgtcatacttcttcacatccttttcactataatcagcagcataaagctcattgttaacaacagcaataagtggaggagcaccagtcactccgttgagaccctcagacatgttttcgatcaccctccaagatcgcctcttcaggtcatattcctcaccgcatgtcaacaccttgttgttgctggcaacaccaccaaccacatagaacttgccatccatgaacaccccggagcacatcttccttgcccgattcatgctgggaaggggtgtccaagaatgtgtctccgagtcgtacatttctgcagagctcaatatcctgccagaagaatcagtgcccccagcaacatatgcctttgccccaacacttgttgacccaaacaagcaccgtggtgagatcatcggatcagcccgtgtccatgaattggttagaatgctatatctgaacacaatgtgtgccatcgcaaacacaagaagttcagtgcccacagcaagtgattccttgtcagaacacatgaagcattcatctggtggcatcttgggcacttggatccagcgctcgcgatatgggtcgtaagcgtcccactcgaggacgttacaggagaagtagacccagtgctctgccaccccactctggcgacgcaggcggtagatctccccgttgcgcacgagcgaccggaagtccttgttcagggaggccaccgagccatagtctgaccgtgacagccggaggaggcaattgatggt

SEQ ID NO: 9632 - DNA, 1501 bp, Oryza sativa
ttaattatttttaacataaaattttagttatttgtgaattatatatattcctatatggactctagactcatcttttaatatttctttttttaattccgaattatctgtaaattgtatttatatatagactctaggctcttcttccaataatatttagttttatttctaaatttttgttatttctaattgtatttctatgtggactctaaactcatctttcaatattctttaatttttaatttcgaatttcatttacttctaagttgtattcctatattgactttaagcttttcttcccatgtttttcttaatcacgaattttagttttttgtaaattgtatttttatacggactctaaactccactttttaattttattatgttttttccgaattttagttagttttaaattcctatgtggactctatactctacttctaatattccttgttttttaattctgtatttctattttttcttaatttatttctatatggactctatactctacttcaaatattccttatttttaattctgaatttctattatttcctaattgtatttctatatggactctatactctacttctaatattcttttttttaattccgaatttcagttatttcctaattgtatttctatatggactctatactctacttctaatattctttatttttaattccaaatttcagttatttcctaattgtatttatatatggactctagtctcctcttctaatattccttatttttaattcctaatttcaactatttcctaattgtatttctatatggactctgccttttatttttctccgattgtatttatatatggactctagtctcctcttctaatattccttatttttaattcctaatttcaactatttcctaattgtatttctatatggactctgccttttatttttctccgattaatgtgagaatttctaggccatgagagcgaacgtggaggctcctttttctattcctttaataatataatagataagtaaaaataatatgtaaaatagctagataatataagattatgtaagttaacatgatttatgataattttaatgtaaatggtatatagaaagatggttcaaatgtaaaagtaaggtgatatgattttatgagagaagaaaagtagtgaaatggtttgaaccgtagattaatcatctaaaagctaaaaacaattgtgacgatatggcttaatgagagaagaaaattagagatataatttggatagtagattaatcgtttaagcactaaaaaaatgatgcaatatgacttaataagataagagagaaataacattaaccaagtaaggatgatctatttagatacataggatattataaaaaataatgaaaacatatattgaaatattatgtgaattatgaaagatgatgatttaacgtgcttttattttaaaagctctaaaattttataaatttcaaattatagatagtatagtatgtttgtataat

SEQ ID NO: 9633 - DNA, 1501 bp, Oryza sativa
cgggaatgtgtaggcagggtgggcaagtgattggtgagaggagatgccgctggtgattctggtgaaaggtagcgtgggtagcgtcagatggcagcatcgtacggagatgtaaagtgtggccggaacgataaaaagttgataccttttggttttgtttctacgtgcaccgatgaggttcctcacggcatgcacatgtacaaactcgcggtagcaatcgagacatttctccggctgaaacaagcaacgtggagtatgactgtatgaggcaatggcggcccacagctcgaagctggttgggccgatgcgtgaggctctgtggcgcagaacagaggaagcctcttacccacggcccacagctgggtagacttttgagttttgtccattcggacttccgtatacaggaacggaagggaggaaagaaacttgaaagtcctgaacgattggcgaacaaggatggaaatggaagcctaacgtatgaggcggtggcagtgacatgcactgaaatggagcggaaacgaaatgttcaaagttctgtctccatctctccaataggaccaatacaatccggtatcaatacctttcactgatattagcagaaacagcaaaacaagaaacatatgaaagaaatttgtaaggaaaaagtacaaatccccccgcccccggaactataacggccgatcgaattacacctctaaaccataaaaccagacatttttcacccccaactatgcaaaccaaaaaaataacccccttgactcaatcagcggtggtttttatcctacgtggcagtccagtcagctttcttttataaaaaaaaggtgggccccacatgtcagtttttatctctctttcccattcctctctatctctgccctcccctcacctcaatccccaccggcggtggcgagctgaggatggcggcgcgcggggggcggagccagttaggggtggcggaggagcgccgaggacggtggtggccagcgatggaggcggaggtcgatcgggcgtgcggggatgcgcggtgggcggcgggctcctcctcctcgtcgtgggcgcgcggtggaccaccgccaccaccgcgggctcctccttgtcgtgggcgcacggggacgcgcggtgggccaccgttgccaccacgggctcctcctcctcctctccctgcttgctcctgccactgctcgcccaaccgctcctgtcgccaccgaccgattccccttccctgccgctcccactgccgctcgcccagccacgcccgtcgccaattgccgctgatcggagtcgcgcccgctgtgcgcgtagctgctcgcgtcttaagttccaacgccacaacacacaataatagaatgacttgtgggtcctatattttctttattttattttttgctgattggatttccacgtcggtgtcacgtgtatgtcacgtaggattaaaaccgctccagattgagttggagggtaatttgtccggttttaatagtttgaggtttaatatgtctgtttt

SEQ ID NO: 9634 - DNA, 1501 bp, Oryza sativa
tgtggtcgagcacgtcgcagaggacgccgaactggcgggccttgtaccgcgtgccggagaggatgtcgatgacgtcgttgtacgtcgcggcctcgtgctcgtagccgtcctggtgagacgcccagacgaagaaccggaaggccagcttctcgtcgtaacggaggcgatgcagcacgtcggcgacgagcggggtggtcagctcggcgcccagcgcgtcaagggccgcctccgtgccctcgctggaacccgccgcggtctcaatcacggcgtcgtagatcctatccgagagagccgcgaaccgctcgtcctggaggtttgtggggaggacgacgtgcgtggtggagcagagccgtcgagcctggagggtcgggagatgcagctgccgcggcggtggcggcaccgaagtggggtttagccgtggggaggagcggttagcggagtgcgcggccgcgagcgaggaaaggggtgcgaccgcgagaaggcggcggaggtggcggagccggagggcgaggtggcggcagttcatgtggccgtggagcgtcagaacggcggcgcgccgcggccggcggcggtggggggactcgcgttgcggcggaggtgcgcctgagaaatcgcgtggccaacggaccgatgactgggccgtccgaatggcccatcaaaattggatagctgatccaatcggaggtctggcctgttcagatcccgttcagttcagcacttcagctacttctataataacgttataacacactaactcctaaatcttaacatgcaaatatatcaaatcatcatctactaacaagctgacacattatcatccactgacaatcattatatttaaacattatacaaacatactatactatctataatttgaaatttataaaattttagagcttttaaaataaaagcacgttaaatcatcatctttcataattcacataatatttcaatatatgttttcattattttttataatatcctatgtatctaaatagatcatccttacttggttaatgttatttctctcttatcttattaagtcatattgcatcatttttttagtgcttaaacgattaatctactatccaaattatatctctaattttcttctctcattaagccatatcgtcacaattgtttttagcttttagatgattaatctacggttcaaaccatttcactacttttcttctctcataaaatcatatcaccttacttttacatttgaaccatctttctatataccatttacattaaaattatcataaatcatgttaacttacataatcttatattatctagctattttacatattatttttacttatctattatattattaaaggaatagaaaaaggagcctccacgttcgctctcatggcctagaaattctcacattaatcggagaaaaataaaaggcagagtccatatagaaatacaattaggaaatagttgaaattaggaattaaaaataaggaatattagaagaggagactag

SEQ ID NO: 9635 - DNA, 1501 bp, Oryza sativa
taccgggaccagttgtaggcagtggcacatgaagcacatcactatcactagtactaaagcaaagataagccatatggattaaaagcagttaacactaactggaacgatacaaagtactagcgccaaacatgagaactaacaataggaacacaccgtaacaatgtcagcgaaagcaaagttgtcgaatcaaaacaaaaggcctgcgaggacttggaatggcgttgttacagaaggggacaaatcaaagctaaagctgaaacaaccaattgcaacgtgcagacacctgaaaatactatttccatcgaccaaatggaccatgcaaacggatttgtgttggatttggggatcaacttgctcagcagtaaatgtgctgcaagtgtgcaaatgttcaccgcgaggtttgtgcggaaattgcgctaagtaacaaagttaaaatggcagcggtactgaataaaaatctatggaacgcgatagttactgaatcatgcgaacctctgtgagcgcacaaccaaatcataatcgtcaggtggaaatcgcactagtacgcaaacagcatcaaattcatctgcgaaaccacacaatccccaactcggatagcttaaacaccccccaactacgatcaatcgcaccgcagccggcatcctctcacgcgtcgaccctccaaggctgcaaccaggaaaaactacgggtagcacacggaccgccaaaccaggacaaaccttgtagtgaagcggcacgccggtggcggcgctgacgcccttctcgccggtgcagagcgcgcggaagttctccgccgtgcgaggggccacggaggcgtagagctccaccacgatccgcccctccatatccccgccgatgctcacgtcgaggtagcacctcgggttcctcaccaccaccacctccgcctcctcctccttccccgcagccaccgccgccgccgccgcggcggtggtggtgccctccccaccgccctccatcgctgctgctctaaaaccctagagggcgacgcgcttctcgaggtggcggcgttgcctcgtgttccgctcacggcgagaggagggagagggggagggggagggagagagtcgtggcctcgtgggctgtgtgtgtcgttgcgggacggcgcctgtgtgtactgtgggatgggggaggggcggtgcggatgattactcgattcaaatgagggagggggacagcagagggggcggagggggacctctgcgtgggcgtgagagcatctccaacaaggatttcccttacggcggtaaccgcgtggttactgggcttaccgcagggtacggtaatataaatattacagtaacctccttaaattcaaataaatttaaaaaataatttgaatttttgataaattttgcacggtttttcacggttttttgcggttaccgcggtaaccgtgcttaccgccggggcgcagtaaccccggtaccggcgatttgggaaaccctgtctccaacagcctctccaaatcgaactatataaa

SEQ ID NO: 9636 - DNA, 1501 bp, Oryza sativa
taaattttagccattatagtaaaaaaaatgtcctccaacaacatttccaactggccaaaacccttcctccactagccaaatttggtcagccaaaagtcactaggcaaccgtgggccctacacacattcctcctcccatctcctctccggctcctctctcgcatcggctcgacaacacagttctccaagctctcggcgccgtcgcttgccgcgacctccaccgtcctccacaccgtagccagccacagccgccgctatccttcgcgccgtcgtccgccgccgtcctccgtgccgtagcctctgctaagtagctagccacccccaacgtctctctcacttctgctagtgctccgctctcctctgctgctcaactccacggcgtgcgcgtctctctcactgtcttgtcttcgcaccgatgccgccggagcgcgctgtcctctcaagccgcaccctccgttgcagatgagctccaagcaccgctccgctgccgctgctgctcccgcggctgttgaagacgttgtcggggtctggtggcggtggcaggcaaggtgccagtgtcgaggtacgtgctgaggttgtcgtcgtcgcccgctacgaccgccgccgcctccactccatctctaccccctccccattgctgaggtcgtcgtcgtcgccgcgagcctccgccgtcgttgtgagcctctgcgcagtcgccatcgccgcattcgaggtagagggcgtggggaggagacagtagtacatgaggaggaagaagagagatatagcgaaggatgacaaatgggtcccatttgtcaaatacttataatggggatgatatatggagaggctgttggagcgagtagctagtttgaatagccaaattagatggaaagttggttatataggtgtttatatagttcgatttggagaggctgttggagacagggtttcccaaatcgccggtaccggggttactgcgccccggcggtaagcacggttaccgcggtaaccgcaaaaaaccgtgaaaaaccgtgcaaaatttatcaaaaattcaaattattttttaaatttatttgaatttaaggaggttactgtaatatttatattaccgtaccctgcggtaagcccagtaaccacgcggttaccgccgtaagggaaatccttgttggagatgctctcacgcccacgcagaggtccccctccgccccctctgctgtccccctccctcatttgaatcgagtaatcatccgcaccgcccctcccccatcccacagtacacacaggcgccgtcccgcaacgacacacacagcccacgaggccacgactctctccctccccctccccctctccctcctctcgccgtgagcggaacacgaggcaacgccgccacctcgagaagcgcgtcgccctctagggttttagagcagcagcgatggagggcggtggggagggcaccaccaccgccgcggcggcggcggcggtggctgcggggaaggaggaggaggcggaggtggtggtgg

SEQ ID NO: 9637 - DNA, 409 bp, Oryza sativa
cgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttctccttcccttcttcctcctccctctctctctcccttctctctctttctatttctctcccctttcgccttttgcagg

SEQ ID NO: 9638 - DNA, 1213 bp, Oryza sativa
ccccattagatacttcctcagtttcatattataagactttctagtattgcctacatttatatagatgttaatgaatctagacatatatgtttagattcattaacatctatataaatgtgggcaatgctagaaagtcttataacctgaaacggaggtagtagtacccaaaatagcctctacaaagatttgatagttctaaaattttcttcgatataaataaagtaacaaaccagatacaattcacacaccttaacctacttttttttacacgattcacacatcttaaccttagctacgttattaaaatttggcattgcggttgacttaatagaggggctattcatattgatgttaaccatattattttctagtaaatttaccaaagatgtgcatatatttagtttttttttccaaactttagtaaatacgtaagaaatcctgccaaaatttttggtaatattgagtaatattttggctacaatctgccccgccccagaaatcaaattaagggctgttttggattgctaccaaaacttagccctaccaatattttggtagtttaaatagtacatgtgcttgttttgattgagaccaatttattggtaatgcccatgctagatttggcatcaatttagaacaatcttcactagaattcatgtgctggctttatatttgtagcaaaccaaatacaatcttaccctaacaaaaaaaaattggtagtaccaaaatttatctaagttttttttaaaaaattggtatgataacaatccaaatagaccttaagaaaggcttctcaagtttgtgtagggaactgatgcgaagagagcaaacttgtgtgatttctagaaagctccacaccggaggtcggaggaggaggagagtccaaagccgagttccagccaaccaccccccctccaccgtcaacgactcttcgtctcttccgcctcataaaacacgccacgcctcatctgactcttcttcccccttcctccctcccgagctccgcccgcccgcccgccgccgccgccgtcgagttcgccgcacctctcgcacggcccccaccccgcgcttccttcctcgtcggaccgcccgcgaccgcgagcctgcctcccgtccaagttgacgggaaccctcgccgcggaagaccgcggagaggtggggggccgcgtcccgaccccggcggtggtcgatcggttccggacgagaggagcga

SEQ ID NO: 9639 - DNA, 1501 bp, Oryza sativa
aaattaaagttctgacaacgttcttggtgccaatagcccaaggaatacaataaacctatttcaattaacaaagaaaagaatccagatcttgctgcagaaccccaacatgctcatcattgaaagctagattatactagggtggacggttggtaaacagttgttaaaataaattatttgagaccaaagctattagtaaccatcttatggaggaagccattcaggaccaagcgtcaatgatgagaaaaaaaagagtaacgagtgttacaaggcagcaaggtgactgcttgtaaatttcttcactctgcagtaaataatcatgccttagtgtttgtgagacaagaaagcaaatacataggtttccagcaaagctgaataggagttgaatgtgttgagatagcttcaggaagggaattcaaggaaagggagtggagattaagggaaagcatggaggtatacttgtcgtcttgtcgacaccaaaagcttcagacaacatttcatgcatgctgagtgcatatcacgtctaaatgttgttgtttatatgtttcatccaatcaaattgtttcatctaggaagcggcaggcaatggttaatcagcattgtcaaatgaagttaataactattttcatggtaataatagcaacaagttacctgaccacataaactacaattgacttctgtaacatacttctcgcactaaactaccctgggtttttggacttttagggtataaaacacaacatagtttctccaacaacatgagcacaaactcagattttcaacaaatatatgacgagacacaaaagacccaacacttcgttgctacattaaaattttaacaaagctgtcatagcaatttaaggttttgcaaagaatttcgtgctagggaagggaacacataaacaatcaaagctaggtacccttatagcctcatcttgttaagttgattcttactaggtaaatagactaaaagtagcacaatatgtgatgtctcataaaatttcagcccgatgcgcgattactgattgagaattgtaaccatgtaatggaaactcaaaataatggcaattggcaagaattttaacaagaaaatgcttctaccatctcatgtatcctctaataaaagtgcaatgaaactaacgtgcaaaaaaattgaagttttttattatagacaattagacagtggtaagagaaaagatgctaccaacagggtactcataagtgtagtactttataaagggactctgtaggcaagacatttgtcatcagtaaaacgggaaaaacaatcagggaaaacagttgcaacctatgagtagatggtggactgaaggatgctgacatgcaaacaaaatcaactttacacagaacctggtaaaatcccgtgacaaaatcgaaacataaatcagagaagcttcatacccaatgattgggtaattagtgaatgaagctttacattgtttatgggaaagatgtttcctgtatcaagacttttatgttcaacagc

SEQ ID NO: 9640 - DNA, 1501 bp, Oryza sativa
gcagggcaagtgtaataaggaaattatacctactattagctgctaatatcagctctttttcattgctggaaggaagagggagtggagagagaagcggtcgactaaaagcaagtttaatagtatagctaactattatctccaattcatctatagctaatataatagttcattcacataatagttatctataaatatatactacatcactaatatatagtctcatcttttatacacataatatattagagtgtatactacagctagctataaatttatactttgcttcccttctctatcttctattatcttctccgcgtgaactcgcagctgactcgtagccttgctatcgtactcgctctaaattgatgacagcttcggacgggtgcctggacacaatgtacctgcgatggaagctgtgattggttaaaagatttggtgagagataattaaggtgggcccacatcgaaagagcataagtggttggtagatagcctaggagagagaaccaaggcttgcccacattgagaaaaaaataatgactagggccgtgtttagatttattttttttctaaaaacatcacatcgaaatatggacgaaaaaatcaattgtacagtttgtatgtaaattgcgggatgaattttttgagcctaattacgtcatgatttgacaatgtgatgctacagtaaacatttgctaataacggattaattaggtgtaataaattcgtctcgtagtttacaggcggaatctataatttattttattattagtttacgtttaatactttaaatatgtgtcagtatacttaaaaaaatttgatcaagtgcctaaacacaaccggattaatttttatatcacctttaatgatatgaaaataacatgtaagtagatggctgcttactctcttagagttgcccttaagcatgttcgttaatattactgtacgctgctgctgctactgtcacctactcctctgaccacatgcatatgtgcatattgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatgtcaattagtcctaattgatggatggttgatggttgtgtagtggaggatggttcatggctagttgatgacatttagttgctctattcctcttcctattccattggtaacttacatcaattactcttaattgattgttggttgatggttgtgtagtggaggatggttcatggctagttgatgacaattagttgctccattcctcttcctattccatgactcttactcttcatcttccattcctcttataaaatgggaatggatttgatctcccgcgagaaaaagaagacacactttcatccattttccaaagctgttgttgctacggtaatcccatcccga

SEQ ID NO: 9641 - DNA, 1501 bp, Oryza sativa
atttcagagctgaatggacagtcatggcacatggcagtttgagccgtagcgtccaaatacaagatacagatacaagacaagccttcaggctaagtttgatgtgtacaacagcacaagatcatcgtaccaaatcgaagtactgatctaaaaaaaaatcgaggcatattttgcagtacatcagaatggttgtgtggcaaacagaaaaatatacactttactacggaggtataggcaataaaaatcactaaaatttcgaactttttaaaacttttgcatcatgttggtgttattcgtttctctattgcaaatatattgtttaaattaaataatataagataagtaagttgagatggaagtcaaataataaaatccagaatatggcgaaataagaaaaacataatacaaatagaatattagttattgacatagggtgtaataaatcaaatatgaggttatagaaaaacaaaggttagaagctataaagttgagaataaaggaatataggtcaagggtaataatattaatccttaattcttgggttcaataaatcatgaaattagaagtatatgatgtgggtagatctataatggaaataggggtagtgggctaaacaaaaattccataaaaattgtcattagaaaaccctaattgtgatttttctcgggttgctactgttcattgcgcgccaggtgttcgatctgtgcctaacccgtctgaacgctcgacgccgccccctccaaccgctgccttgccgcgcgcccgctgtcccgacccgtgcgccgcattaggcgtgcccgtgcgccgcaccgcgccgcgccacgtcgcgtgggcccgcagccgaccgagccgccaaaagcccgcgccaaagctgcgccgccacgggtgcccgcgtcatcccatcccctcgcgcgtcgccctcgggatggagtgataacggccgccacgacgaccccgcgtcaccctagggcatagccctgcgcccctatccaagccgttatctctatccgtcgtcgtcgctcttgtcgccgtcgcgtcgccatcttgtcgcccccggttgagaccgctgggtaatgcggtgcccctttgtccagctagcgatacctctcctgcatactaccgcgtaggcaatcatgccacgcctgcacattgaaccgaacctgggtgagatcgaaccaaagccgagtcattgattatccttatccattaagaaatcgcccttcctctcgctgttataagctcgcctttagctcgactttatccaagatcaacccctcatctgtttctctcttccccaaagctcttgctccatctcagaggaaagaaaacacgccgccgccgggtgtcgaacacctggtgggcgggggccgcgccgccgccgcagggcctctcggccggtgtgggtggcagggtgtgttgaggaggtgcccgcgttgctgttgctactgttggaaggagccaggagccgctacgcgagggaggacgagcgtcaaacacctgcaaa

SEQ ID NO: 9642 - DNA, 1501 bp, Oryza sativa
ttaaaaagttcgaaattttagtgatttttattgcctatacctccgtagtaaagtgtatatttttctgtttgccacacaaccattctgatgtactgcaaaatatgcctcgatttttttttagatcagtacttcgatttggtacgatgatcttgtgctgttgtacacatcaaacttagcctgaaggcttgtcttgtatctgtatcttgtatttggacgctacggctcaaactgccatgtgccatgactgtccattcagctctgaaattccatcgactgtgagagtttttacactgtccttaacactgtaatccatcaatttgtttggtggtccttaatctgtaacggcttttgcttggcgcgatcttttgtgggctatgtgcatcttgtacagtgctaaatgtatctagcgttgcacttcctctggttacaaaatattcactactccccccgtttcacaatgtaagactttatagcattgtccacatacatctagatgttagatgttagtgaatgtaaacacgtacatatgtctagattcattaacatctaaatgaatgtgggcaatgctagaaagtcttatattatgaaacggaggaagtagtaatattttgaacgagatttagcaaaactcttgaaacttttagaaagacctattttaaagtgaagggtgttatttggatttttgtgatagtttggagtgtaaaatggagttactgtacatgttagattttataaacttattattcaaatataaaattgatggtcatttttaaaagcttaatcgaatttcatcctaataaacattaaatattaacaaccaaggaagtagcagcatcttcgtgacccctgaggatgttttcagacaggatggttttaatgaaatccatggatttcattttaagaagaaaatatcgggcagggcgtccgtattcaattttctttttactgcaataaccattacaaattcaaaccattttgtaatcatcaaaaaacaaaaattacttatagatgtaaaaaaatagtcatgaaaacaacccattcggattaagcccaatattacacctgtgctcgtatttatagctaattatttttttagtggtaggcaacatatatgtacacagcgagacgtctacagtgacttcgttgatctcaagataagcatgcctagtattttggagatgttcatagactcatagggtaggatatatttgcgcgttcatagaatgagtgtgcgcgttacgagcatatgcatttatatcgtgttctgttttttttacatgaaaacaggggtagagagtacgcatagcagtttgctctcaatgtcgtccggtcttacccttgcggtcgttttttccataaattttcctcccccgcttcccttctcttcccttttttcgctcctcctccactcgcgctccgcctctctctctctctccatcgatccaagcccccccccccccccccccagatccccctcgccgcctcgccaccgcgtcggcca

SEQ ID NO: 9643 - DNA, 1501 bp, Oryza sativa
agagatttgccgttggtctctatcattatctcaaataggcaaataccttcacattacaatctttgtagcccaaatttatatgagaattgctaaagaaaacgacgattttcccccaatccccctcccaaaaaaaaaaagaattgtaaccatcaaatcgtatcgagatttgtgcatgagggatctacgcatgtgaagggattaattgtaactacattatagctacagtataattacgctataaatataccgtagttatatttaaactttttaaagaaattttgtgacaatttattaagtctcattttaaatttccactattgaaaacccagcatatcacagcaaccacattgtacacaactctgttcggggcaaccctcactccttggcacataaaacgaagcaacgttttagtgcgtgattaattaagttttagctattttttttaaaaaaaataaattaatatgattttttaagcatctttcgtatagaaattttttgcaaaaaacacacaatttagcagtttgaaaagcgtgcgcgtagaaaatggggaggatgagttgggaactagtactaccgaacgaaaaaaaaaaaagaactaatcctaccccagtccggccaggtgttggcgtccaagcaggcaaggacgacggacgcgtccacaggaacggatgaaaccccagccccaaccagtccaccactccacattcccctcctgacaaatcgacattctctgttgccgatttgttcgcttgccgtgagtatcttgcatctctctctctctctctctctctctctctctctctctctccaaccactccaacgatcgatccgaaccccaatgcaccgtgtgtgtgcatatgccgcctttttctctgcttaagagtataaacaacagtaattataattatataatactaatagagattgaggaagaaagaaagagacagcaggtaagccattttttgcttctgttgatttaactttgtttttctacagtacctttctttctccttgagaagacaaattttcttcttttaggagaccaagcaaaaacataatcataatactatatactactagtactactacctctttgtttctctctctatatatacctatccaaatttctttttttttaaattttatctgcctacctttctctctctagaatttggagtttcttctttaactctctctctctagctagagtttggagtttcttttacctttctctctctgaaaattgcagccaccaactttacctttgatgatccatccatgcatttgcctttcttcttggcctcctccttttttgctctttattcctttgcctacttgctgctgctgctgctttacattgctctccatttctcctaagctccaagctcttctctcctccttccatttcgccattgcaccacaccatttgcattgcaccaagaggagatcgaggtgtagagtagagcttgctcgccggcggcggcggcggcggcggcggcca

SEQ ID NO: 9644 - DNA, 155 bp, Oryza sativa
cacgcggcgcacgcgcgcgggcggggttgggacgcggtgcacgcgcgcggctcgcggtggacgcggatgcggcgggaccacgcgcagcctcacggctcgcggtggaacgcgcgcacggggagggaccgactggggtcggctcgacccggtctagg

SEQ ID NO: 9645 - DNA, 484 bp, Oryza sativa
atttctgcacggcattgcgttttctatactccattgcgtgagttattagccctgtttggaagtaaatggagttggttatgacttatgtgccctgtgaacccatatgcttgtcctgggatggaccagacggtgagaatcagttagagcaaggtgaacatagagtaggggcagtgagctggctatatttttttgcgagatttttcttttttgcgagagctggctctaattttattcaactcatttacagatctgtatagtcaatgatagtagggcctttcccacccaaaaaactaaccaataagataacatgttccgtcacttatatattaagtcaattgtccttatgcaaccaatgtcgaactattcaatatatagcttgtgtataaaatatatagtaaacggtagaaattgcggcttttatctcatccaatctatatctcgacagtagccgataaaatcaaccaataattttgacacacacagt

SEQ ID NO: 9646 - DNA, 665 bp, Oryza sativa
ggtggcccgatttcgccggccgacgtgggagaggtggaggtggagagagaggcgggattcgaatttcgaatcccggccatctcgggcgcgggcgcaggcgagagggagggggagtgggtgcgggaggtgcggcgcatgcgcgggcgtggccgacgtggccccgaggaggcggggatgtgggcgcggcggcggttgcgggcggcgcggcgcgggcgcgaggtgggagacgggcccgacaggtgggccccacctgtcggcgaccccgggtgagaggaggcaggcgactggctcgcccggctcaattgggcctcggccttcggccggcccagcgggaagggggagggaaagggagaatgggccggcggcccattcaaaggaaaaagagaaaagaaaaaaaagaaaaaggaaaatgaattttctagggattaaatattgcttgtgctcaattttaattggttaaaattatttctagagctctgaaaattccactaaaaatcttgttagcgtatttcgacatgtagaactcaagaaaaattccacatgccaattcctattattatttgcattaatttattaaggtttactcttgctttacactggtattttcttgagaccatttataacttcaatttaggcttgggaaagaacttcagggtgtgacaaga

SEQ ID NO: 9647 - DNA, 1501 bp, Oryza sativa
agcatatgcagatcgcttcaagcggtgaatctgaaatgcctcatctccagcttctggtattgcacttgcaagctctagagtgtccatcattggttccgttttgctctgttgaagtcaattgcaacaacaaagaattcactactccatatcaattcatttattttatgatgaacaagatttggaaattatgcacaggtgaggagatatgaccagaaaaattagataccaagactatcatagaagcatgaaaattgtaaaagtaggtgcgacatgtcaactaaacgctgtaaacatacaatagacagtgcccttttcctgtacaatgatgacactgaaacagatagtggaataaacaaaaatatcgatcatccttataggatttccctgtgtaataaataaagatgaaaaaggtatagacccaggaaaatctatccaaactgcacaatctttccaatttgatagttttcagccagaaatcattctggaaaaatccaccaagttcaaagaactttttgttcagacatatgtagcacaattctacaagtccatatcagagacccatcatccccccttccactccagaaatcaacacgctaatggcataacagaggaggtatcgcatcaattacccagcagattttgggtcaccagggaacaccaacgctacacctgcacaagcgagcgcccccccccccccccccaaagcctaatcaaactcctaggaacacaacattagaaccctaagggtgcagaactcgtcggtgagcccagtcgccggcccggaggagaagcaccctaatcgaagagcgagcgtcccctaccttgtgatcgctacctcgaactaattcaccgccctcaatcgcgtgcgatcggagctccgccaggggacggggatgggaggggagggggtggaatctgagaatctcgtaccagcggaggggggtgcgacggcgagacgagccggaacggactccttccaccacggcggcggcggcggcgagccactccggcgtggcgaggcaaaaacctcaggcgaccaaactctccccgctgctgctgcggtttccccccctgcagaaaggcaaatttcaaaattttgaatccacctaccagccataatacgcattctcccaatacgctttctatgcgaagagacgtattttcgccacataaaccccttcaaggctccaggcaacacggcgtattctccgaatacgctttctgaagggaagcaacactgcctcgcgccaacgtcacgacgagcaccctgctggtcgccggccggtgatcgtcggcgctggaggtggcggctcagccttcgaatccgccagttggaacctgcaagctatagcctgacgccactccactgtgcagtatcagaaattcagactgatattcatcagtacaaactgtacaagcatgtgcattcccttcattcatgatacagaaacaaagttctggatacagaaacagagttctgcataacaaatctatggcaagt

SEQ ID NO: 9648 - DNA, 1501 bp, Oryza sativa
tacccctcatcagtggactgtttttttttttttgggttagtgctgagtgcttgcaaccactttgttggttggtgatatagcatatgttctgtattggcagtaatttaggcactaactgtttctcttcttctctttttttcccctttttggttcaatatcataggtttaattttttaattgttccttcactccaattttcagcatgatgcttgctgttgcactcaatctgtctctgttcagtgagcgtgtgcgtttacctctaggacagatttataagtcaaatatagtaggtgaggatatctgagattgaaaggggttccaataaatatcagtcaaattgcacctatcttgacaaatttcaagtaattcgccctgggggcatcagcaagttaatgtcacatactaagatgtccttgtcatggtgcgttaccaattgtttggtagttccaaattgtggaaacgaggtcttattcttgtggctgttcaaaatccttacgcactacttcctcaataattaatagccatgattctgtactgtgagactattaacaacaaaggtagtgtggtcatggatgcatttatgaatagcaggatattgaagatgatttgtacaaaaagagatcttgatttaatgcacagcatgcatagcatcttgttctctagctgatcaggatctgctgtactccggctcaactcaggtgctgtcctaagcatttggatatgaaattcataaccaattgatggaggtagtgggtacaacacaatatttagtagtatctgtgaaaattttggatttatcattttcaaacccagttgggaattcagttcttgcctcgatcaaaatatttaatccacttcttacacgccaagtgtgaggaaaatagccattcacttgtttcaacccttcttgattttgagataaaaatgatgatcttcatcatggcatttggacatgtataagaattagaagatgtgtcacagttatagtactgttctttctgctcttttgccaggctatggttccttttattggtttatatgtctataccacccaacattttttttcaaagaagcattttaggttaatatttattttataatgaaagtttattgtggtggttttattactgctgagaaatggagaataccaacaaaaattctagagggagggagaggtatataggctttaatttggtggatctaagttaaaggcccagatatgatagttgtttatatattgattttctgaaagaaccacatctcaatcctgtcacttagggagatttcaaataagttggcactaattcaacagaatataatatcccaaatttagattccgtttgcagaagataattttaattcacttcacaatttgcacagggcaatcagctagtttactaagaataacatgtatactgctattttgcttctcagtttaagttggttttgaagtctatcttcaccctgctattgctgaccatgcttctctgttcattttagt

SEQ ID NO: 9649 - DNA, 853 bp, Oryza sativa
tacttttcccaacccccagagttcgagtatgtgtcagatgaaggtttctccgaggagtaggcttcgtccgtgccgtcgaggatgcctgtggagtggtgttcccgctgcagttctagtcaaggcttagctcctgttgtctttctttctttccgctgcatttatgtaagacttttatgatgtttgtaagacgtggatctgaatgtcaacattgtcgtttgtgtaccccggctggtcctggacggggattttaatgcacattctgcttgaaattctattcgggaatttctgggcgtgacaatagatctcttgatgcttttgaaatttttggacaaaacctcccccccccctctttttggatgagcaagaagaagacctcaaatcgtgagctagtgtgggggggtatatataggctgcaggctaataggtgccagttcttgttaaaaaccggcagctatattaaaaaattgacacctatactttgcatcataaccagcacctataatcctccccgacctatatgatgcaaaccggcacctataggtgttatttgtgctggtttttgaagccttattggtgtcgttttactaaataaccggcaccttttatataggtgccggtttttttgcatggctgccacctattaaatttttggaccgctagcaggaggatttttaatgccggttttagacaaaaaccggcaccaatgtcccttccaactaaaaccgaccacaattaaccgttatatgtgccggttttttggtctaatggcaggaagcgccttataggtgctagtttttagctaaccggcacctttgtggccgatacctatgggtgtttttgtagtagtgtgtga

SEQ ID NO: 9650 - DNA, 1501 bp, Oryza sativa
aaaagatacatgcattaataaaaaaacacaaatggctaaacatatgagaatttctgtatgtttctagtgtctcatcttagacactgatacaaatagagaggggccaaagataatgaagaattaaaacaggaggctccaattcctcttataaacatatataacttaaaaaagacaatagttgactaggccaatcgatattctataaataaattaacttatgtcaaaacctttttaaaagctaagctgaactaataaactatatacataagttcttaaacataatcaatagtcgcacaaagcacgacgatgtggctagtaatattttgaaaataaatgtaccaatcgatattgtttttatagatagtcacattattttaacttgctaacttcaatttttagaaagttgaactttatatattctaggtgagaagtaaaaggggtacactcagtttgtggttgttatgttgcctcgtgctcatatttttaagttgttgggaaaataaagacaataattgtttgtagtattgttccacagacaaattaaggctagacaaaatattattatcctttgcatcataacaataacaagttcaaaacaattgtacccaacgagatgtctagagaatagtatccaatgcaacaccaaatggagccttagagaataattgattggaagtctagcctttctcaatacatgtgcaagacaaagcacataaattgtagaactagctaaaagactttttgaggttttcaatattgtcttcaaaatcaatggctgggaggaatactaattaaaactgcaggggccgaaaaagctactcagctaatggggaaaaacacagtaagattagttgttttcaacaaccactcgatcaaaatttcggagtttgaactataaatatcattcgaattgtttaatattaatttagtgtataattaattaaatattagctgaaataaagttaaaagttgattaatattaatttttaaagcaattttcctatagaaactttttgcaaaagaaatgtatttagtagtttgagaagcgtgcgcatggaaaatgattgagtaaaagttgggaagaggtggtaaagacgaacacacccttaatgacatgcatttgtgactaagtgttgattagaattttagcatcttgctagagtttagaccttgagaatcgatctatgacaggatgttttgctgtgatatactccatccgtttcaaaatatttgacaccattaactttttagcacatatttaaccattcgccttattcaaaaaaatttgtgaaatatgtaaaactatatgtgtatatgaaaatatatttaatgatgaatcaaatgatataaaaagaataaataattacttaaattttttgaataagacgaatggtcaaacacatactaaaaagtcaatggtgtcaaacattttaaaacggagggagtatatattatcatgtaggagtacgaaatacgaggaacttttcgttcttgcacctca

SEQ ID NO: 9651 - DNA, 1501 bp, Oryza sativa
gctttaaggcgatcagtgtaagaatgttggtatccaaccgggtggcatccgctttgcaaaaaatgtctatgtaaatgtaatctcatttttttatgcatggacattatgtctttttttatgcatggacataggtttaatctctatgtagattaagaagtattattgtctgaaaatatttggtagctgcctgaaatattatttgatggttatgttaataggatgtacagaaattatacttctcttatctggaattgcaacttcaactgtcatgacgttcaccatgcctaagatgttgctgactaagcttatgtcctaatctaggttctgaaattgtagctagaagtttgaagaaatagtattttgtgcaaatacaactgatgagcaactcagacaagaacccatatcaggtttgttttctcgagaaattgcatataggaaaggggtgagattagcagtaatgtttctttattcttctaattgcatatgcccgattgcaagcggtgttgtcacaagcaggaaatggtaagaactaagagaagtgtgtgtatatatgtacatacattatcagttactttaaaggtcagcaggtcacaaccagaaaattgattttctcaatgttcttgcaagaacatttaaaattttgcttcacattgtaaatttgatgtgtgattgagcttccagggtcatcagcttcaagtgattgagctgatatactgcatactgagattctgcggactaaagatagtatattctttcatcatacaatttatcgagcttcatttatttggctaatatttcttatggaacacacatgctgatttcagtctttccaatttgttctgccctttttggtacggaatttctgttacagcttaaatgatccttggaacacctggcaagttctttcctatggtcctatttaacaagaatcaatcacatattttgtgcaaatagaacatgtgttggcaatggcaagttcattggtctacttattacttaacagtaatcagtgaaatactctcagcaaaatttaagtctgaatttgttatatgttgaacactgaaggacaggggcggagccaggattaaaagccaccggggtcatcaacttaaagcgtttgacagaatggaaaagaagaagattaaagaagacatgcaaaatgagtttattgttagcacaagattaattgagtattagttattttaaatttggaaaatgtattaatatgatttttttaaaaacatttaaagaattttttttgaaaaaatatacaccgtttagcagtctaaaaagcgtatacatgaaaaagagagcagaattccggtatataaatgaacaccgctataattttgatttaactaaaagactaggtagatcattctgttctctcgattaatgcaaaatcttttttaaagttgttcttgtgttttttatcgatcaccagcaacgaatgaatgataattggaataggctaagagcgtttcctttcatcatacaaaga

SEQ ID NO: 9652 - DNA, 1501 bp, Oryza sativa
atcataaaaaatgtgatatcactgtcttcattcatccattaggactgaataaagaaagagaggaacatagttaaattttaagtaaagaataagtcatgaaatcatttacaaatacaaacagttatctattcgaactatgcacaacagtacggtcaaatactcaaaatttgtgaaagttcaacttgaaaccagacattaaaatatagagaaaaaactattcaagattaattaaaaaatttcaagctttatgttggtacatattacattaactgaaaacaaaagaaattaaggatgacatgggacaaaaggaccttgcatctgctcacttgctctagtgcccggttggcatcattggcttgccatgtcgggctgttggagaaggcgacgccgtccagtcattccacgaggagatggtgatgacaaacttagactctcctcacagtgctcaccctagccaaatgccaacaagccaataactataaggcaaaatcacccaatcaaagattcaagagcagcagcgaaagacgaaatcggcatggcggcggcacagtgtgacggcgttctattttagccaatgggcgacggcgtggcgtggcgattttggccaacaggcggcgggccggcggcggcgcaacgctgagtcgaggagagagaggaagaggtggaagatggaaagacgatgcgtgccgtgcccaacgattgacgttggattaacatgtgaagcgctagctgttgccttgttgggccttggtgtcttgcagattttgggctgaaggccagcgagggggttcctgagttttttactaaggggtgcctgtatggtggatttataggggtaatagctaattttttgtttcggcccgggtgcctaggaaccccccgggcctattgggctccgcccctggaagagaggggtggtgggagtgagggagaggagtaggaaaaggagagggaataggagagaaaaggtaaggggccagatgagggaactgaggggagaaaaaaatagagtggaggagtacggctattgtaggggttggagaagatggagaagataaaacatcgttgcgacgggacttggccgaacatcccgaatgaattttcacaaacagatctctttttagcccgattgtgaaaataatgaggtattcgtaaaaatctaactattctataatagtgctttttccggggacactttagaacttaagaaacgacgtacaaatgttcaatacaagcggttcaaatcctgtagtagtataatttagcggtcagttatacttatccttgtttcatcctgctatctcacgtagttcatgcatgtaatattcggtgaatagtctactgttctcgcgtagcaaagctatattgtgcttgcgggtgcacatgaacccccaaatttctaatttctcacttaaaaaaactagaatgtacagtattatactgaaattttctagattttcaatagtagtgcacatctgttttgatgctagcttcgcctctg

SEQ ID NO: 9653 - DNA, 558 bp, Oryza sativa
tctattagatcgaccctctcatggggtatatataggagtacataggagatagagacttggagtacaatacaagtaagagtagatttatctctaggattctatctttaggatatatcttatctctatatttgtatttgactcttatctctaactaacatatctatacttctaaccgttactagcgagcttcattatgtttgatacataaatcgaaaaatatggtaggatccatattaaatgctatatatgagagaagattgtgagatgtacaccaagtaattttcttgtggaggtgaggatgaaccttcgcaaatttttctaagctatccacaaagattggatatactcgcgggtaacacctagctggctagaaggagaacctccaagagtaacaagccggatgtccaaagcaggttgtcgatccacaaatgctcaactaaactttagctcacacactactatgaaaacgatttttgcagatgtggtccttttttctttctttgtgggtatgttttttgtaaccatagatctgcctgcaaaatggggacaggggcgaga

SEQ ID NO: 9654 - DNA, 1501 bp, Oryza sativa
tgatctgtaagtctgtagtgcctcagtcaacttagaaactctagcttttccattctttaatatttaactagttttgattgtacaaacaacagttttaggtacactttcatatattctctgacttgccttgttaatttaattatacacggaactagaataagaataaccgaccatgcatgcatatatatatatatgcacaaaaaagttttccatgcgtccaaaaatgaacatatatccaaactgaattattacctatatatatatgtatgggctttcagctttctcgtgcatatatgtgctagctaggcatatgtatgcatgtgtttttcatggcacatgcgtgcgtcgcaaacaagcaaactaataacccgcagtttacacatgtaatgtaattaaaaaaaatatacacagcgcatatgcgtgcgtcgcaaacaagcaaactattaagctgcagtttatccacgtgtaactaaaagaaaaaaaaatcaaagcatgggatcgaatcacaccgtactagaaatatcagacatgaaaatatgcacgcagttcatgctagttctcaaccgatatatttataggggtaaacgaaatttgatgaaatatatttattttgaatgacttaagtattgtggatactgataagcattttcatatctttgatttagaaattttagattatatagatttgtgaatttcgttatagtatcttgcaagatactaataatagggcatcatatttttgtacaccacactagtcacatcgtattttatatcaactcctgaattgggcaggatatttaaaattgttaactatattagggtatatcacctttataggatatgattagatgctttttggctatagctagaaaattgccttattctattcgtcgtatttagagcaccatatatcacgtaatttaaacggcaacatatcctatgcacacaggccctcacgtgtacacacgtgcacaccaactaaaaaatatcacaaaaaaatctagaaaaaatcatacacatactttcaattgtattacacctagggttaaaatcttaacatcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgcgagggcctgtgtgtataggatacgctcccaacttaaacagctataaacttgggctccttgcctttagaacatatggattttaaataaattagatttgttcccataaaatttctgcaaattcatctattccaaagaggccttagggtgtattctacactcctattcccaagtcccaactctactccctcattttccatgcgcacgctttctgaaccgttaagg

SEQ ID NO: 9655 - DNA, 1501 bp, Oryza sativa
ccaagtctcccagcgacagagatgtcgtaaaacacatgtggtatagtataatatttgatgctcctgggacaatgagccccgcaaattataccggtgactttatgtgattcccatgcatgactccctatcctttaatttgcacactttgttagaaagggccttgagagatggatgtgaagctgtaatgcaaaaaaaggcgaagaggatcgatggatgtggaggtgctggtgtactgtcagaatgttgtaatgcaaaagaaaagccatatatgtacaaaaatgagtatgcaaggaaggttttatgtgggggttgtatattctctttactcacaatcatgcagccaaggtccatggccaaggccagcccagccatccatccatccattgtggtttagatgccccttccatcttgcaatgtccacacaatccgctggctagtgtacatgtaagatacacgcatgcacacatttgaacgtgcttcatcggtcgatatctaagtttgtgttactatggattcatatcctttgccactataatcagataaaaatatcataatagtctataacaaaacctccggttaactaaaattgtactatatatatcatccaccctcattgattaatcgtaaggtgcagatataattgtgcggacttgtgaatttttcctacatagacagagcacacggtagctagataaccgtcaacatcatcaaatgccagtggaacaatgcacatgcttgctctactatagcaagccagagagctcggatagatggctgtctagggtcgccgggttctcaatccaccactgatgatattatatatatgctaatataatatgaatgtaaggttctctatataagtccggagaacttgggccgttgagttgtcgatcacatgacggtcatgctaagcttaagatagagggaatgaattgagacacaatctcgtagctagctaactactcccttcatttcatattataagtcgttttgatgtttttcataataaaactttattaaatttgactaagttaaaaaaaacaacaatattttaaacaccaaactagtttcattgaatatatttatatgtctgttttatattaaagagtaaattgcatcggcggtatacaaacttgtcgggtgggtggaatctagtgtatgaacttgtaaaatgctcgttttggtatatgaacttatcttgtgcgtgcgaactaaggtcaaaaggacattacatgactaattttgtttatttaggtgctgattaggatactatataaacatatatatgcatgagaaggtttctacttagacatactccctccgtcgtataaaaaattaacctagtattagatgtgacacatcatagtactacgaatctggacatacctcggtccaggttcattgtactagaatgtgtcacatctaattctagatttatttttttatggagggagtacacttattcaataaaaagatagagtgagatatagtgattgtagag

SEQ ID NO: 9656 - DNA, 1430 bp, Oryza sativa
attcctgcagcccttctttgatgatttatatacccttgctgctgctgcccaatgtgttccttattatacttctcctgctgctgttttatgtcaatcatgcaaattctctacacttgctgctgctgttttttaaatttattctgcttgatacattggttatatacctctacacttgttctttttttatgcataagaacagattttctgcacttgctctttttttatgcataagaacagattttctgcacttgctcttttttctggattgataagaggagactatatacacttgttttctgtcattctttgatgatttatatacccttgctgctgctgcccaatgtgttccttattatacttctcctgctgctgttttatgtcaatcatgcaaattctctacacttgctgctgctgttttttaaatttattctgcttgatacattggttatatacctctacacttgttctttttttatgcataagaacagattttctgcacttgctctttttttatgcataagaacagattttctgcacttgctcttttcttctggattgataagaggagactatatacacttgttttctgtcattctttgatgatttatatacccttgctgctgctgcccaatgtgttccttattatacttctcctgctgctgttttatgtcaatcatgcaaattctgtacccttgctgctgctgttttttaaatttattctgcttgattcattggttatatacctctacacttgttctttttttatgcataagaacagattttctgcacttgctcttttgatgttatgatttcctctttttatcccttcatgcaaatgattgtaattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgaga

SEQ ID NO: 9657 - DNA, 521 bp, Oryza sativa
acgctgcagcttcagaagatctgctcttcgtggaggttgaagccgacgtttgggaaagcgagcaaggcaagtcacatcatctttgagcatattgaatcccagtttgtaaaattatgttgatttaaattattgcattatcgctttatttaaattcccgcgttatcactgttttatttagccatgcctatttacctttgttatgaccatattattattgttattgttgttattattaccttgttcaccctagattaaacaaaaccccaactagtggacactctactcgtggtatccctagtttaaatttaggtagatgcttcgctatttaattaggtaacattagatggttttataacttagacttgggaaattctcatatcacctggacactatggaattgttggagtattgtggaattggcttcaccccgccccctctattcaaaatcccctaaaatggttttaggctgggctcggggtgcatggttttgatggtagcacctcggccatataaggaccggt

SEQ ID NO: 9658 - DNA, 1501 bp, Oryza sativa
cactttcccctctctctctccctcggatacgaccgattttattcccgtaaagttcgccggcgctattgatggagccgcgatctccgcggccgattcctctctctccggccgctctctctctctcccggcgctatataaacgttccccgtgcctctgtcctacgtttccaccgtccgccgctcgctctccccgtcggaatcgtgctcgcgccgtcgcatcttctctccgccgtcgccgccgagctccggttcaccgccgtcgtcgctccggacttcctcccgtctcggcgtcacgtccatcggcttcgccgcgtcgtcgtcgacctcgtccgcccctccgcttcgctcgccgaccgccggagctccgtcgccctcgccgtcccgaaccgcgccgccgctttcctccgcttcggtcgtcgtttccgccgtcctcgttgtcccggggtgagccgtggaccgtccctctcgcttcccccttccctcctctctctcgggtgccactccgccgcgccggtggtcgccggcggtgaccatcggggcgcgagcgcgcgtctcccgtcggccgtgccggcgaggccgccttcgggcgcgccccgcggctgccaggtggggcccggccgtcagccgcccgcgcccgcgggtgcggctgacgcgtgggacccacggcgccggccgccgccagccgcgtgcccccggtccaccgtggaccgagaggctgacgcgtgggccccactcccgtggacccggtccgcgcgccctctccctcggctgacgcaataaacccggtttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttccttttccgttggtcgtgtagacgctgcagcttcggaagatccgctcttcgtggaagtcgaagccgtcggttgggaaagcgagcaaggcaagtcacatcatctttgagcatattgaatcccaatttataaaattatgttgatttaaattattgcattatcgctttatttaaattcccgcgttatcactgttttatttagccatgcctatttacctttgttatgaccatattattattgttattgttgttattattaccttgttcaccctagattaaacaaaaccccaactagtggacactctactcgtggtatccctagtttaaatttaggtagatgcttcgctatttaattaggtaacattagatggttttataacttagacttgggaaattctcatatcacctggacactatggaattgttggagtattgtggaattggcttcaccccgccccctctattcaaaatcccctaaaatggttttaggctgggctcggggtgcatggttttgatggtagcac

SEQ ID NO: 9659 - DNA, 527 bp, Oryza sativa
agcgggaaaggcgggaggtgggagacgggtccgacaggtgggtcccacctgtcggcgaccccgggagggagggaggcgggcggccggctgccggctgggcctcggcctgcggccggcccaacagagaggagggggaggaaaaggagaaatgggccgacggcccatttgacaaaaaggaggaaaaagagaggaaaaagaaaaagaaaaaggaaaaaggattttccctggaataaaatattgcttgctcaattttaattggttgaaattatttctagagctctgaaaattccactaaaaatcctgttaatgaattttgacatgtagaactcaagaaaaattccacatgtcaagtccgattgttatttgcattactttcttaaggttttctcctgatttcacctgcattttcttggggtcatttgaaaattacaattttggcttgggaggaaaacttcggggtgtgacaaacctaccccccttaaacggaatctcggccccgagattcggaggagctggtgaagagatgc

SEQ ID NO: 9660 - DNA, 1501 bp, Oryza sativa
ataatcacaccagtacaatatttggggtagcctatctaactgttgtcgacatggcggtctaaaggtctgactcgtagtcgacaacaaggtagtcttcctcctcgagttcatgcccagcgagatcagagatagcgctttcgtctctcctgacagtaaccggagacaccgtaggagactagccgtgcttatccctgaagtcgatatccggcgtcttgtcttggcgtatgttggcttatatgttgatcttgtgtcttgatctattgttccgtgtcttctatggtggatgtgtcccctcttctcctagggggtcttttatttatacccaaaggtgtccccttgtcaagtagaactaggtaaaccaatatggatacaatccgagtagtacttgtcgtttccatgtagaactctagtcgtctttccttatccggaactctctccatatctgaaggttgcttccatataggacatggtatgtggtgggtcctaccgagatttagtcaactattatgagatatgtagtatccataattctgacagagcgtgttcaagttactgagcatgttaagtgcattttagtgcatccatgttaaaccatatgaatttatagtaattaatggtcaaatatataaatgtaatgttttaaacttaggaggaagtgagaaataccaattatttgaaacggaggagtaactaggattaactagcttaatcctgtctgactagttgaaatgcactggctactgtcttggggggttttcggtttaggggtgggggaaaaaattcagtgtttagttcctaaaaaaaattttaacgtatacagacacacatttaaaatattaaaaatagactaataataaaacaaattacagattctacctataaactgcgagacgaatttattaagtctaattaatacatcgttagtaaatatttactgtagcaccacattgtcaaatcctagcgtaattaggctcaaaagattcgtctcgtaatttacatgcaagctgtccaattgaatttttcgtctatatttaatactccaaatatttgaggtgaagggattttttgaaagtttgaaggaaactaaacacggcccaagtatggcttgaactgaagtctgaactcgggagatcagctcgtcacctttctgctcgaaaataaatataaatcaccggcgtaccttagcttagtcctagtaattaaatgtatacatgttaggcacgatgttgggccgtgtaaatgcaagtttttaactgacagtattgaccgtacgcggtaattgtttgaaacttgatttgaacgttttgcatatgtacgtagtacgtgtattataattaacaacgaaatgagcagtcagctacgagtgcgctaattaacaatatgaactcgtatgtactgggtctaataaagtcaatcttaacctcttgttttctctgcaattgcatcttgctggccataccgctgctacgttaattagctggagtagtttgttcagtcactc

SEQ ID NO: 9661 - DNA, 1501 bp, Oryza sativa
tttgttagtcgtacctcgggttctataaggattaagctcgggcctctgttgcaaagcactactgtacttgcacatgtctagtgggtaaggcttagtttgtggctcagtctagttataaacaaaggtacacggatggagatggacgaagtcgggggtcgatggacatctctaggacaaatgaaggctacacgagctgtggcccggtagtcgagatgtcatggcacagggctggtgtcctgctgctagggactcaatcctgcctgcctgtcccggaggttccggccgtaggcggggctgggtcgatactcttgtttatggctaggatgggttggaactatgtcacgtcttccgtccgtatgccgtggtggtatgtggcacgtggttacacgtgaggaagatgtgtcttgtgggtaaagatgtacacctctgatcagagtaaatctattcgaatagccgcgccctcggttatgggcaagcctagcaatgtacccaatttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtcagggttcacggctttgattaataacactatgtagctctaggatcgtctttacaaagtagctttgggcaactaagtgacttttaaatgctgtttactgcaaaacttaacccctatattattaccccttgtacctccttgcattaatcatgtatctgccagtgtggcttgctgagtactgtggttgtactcattcttgcttaatctttccccccttcaataagagaagctttggagaagaagtattaggtggagtcctggcttataccccagttgagcgctgtcacaccccgaagttctcctcccaagcctaaaatttaatttataagagaccctaagaaaataccggtgcaaagcaagagtaaacccttttaaatcaatgcaaataataatcggagtgggcatgtggaatttttcttgagttctacatgtcgaaattcactaacaggatttttagtggaattttcagagcgctcgaaataattttacccaattaaaattgagcaagcaatattttaattccagggaaaattcttttctcctttttctttttctttttcccttccttttccgaatgggccgctggcccattctctcctttcctccccctcctccctgctgggccggccacaggccgaggcccagctaggccgccccgccgccctcctctcccagggtctccgacaagtggggcccacctgtcgggtccttccccaacctcccgtcgctcccgccgcgccgccgcgcccgcaaccgcagccgcgcccacgtctccgcctcctccgggccacgtcgaccacgcccgcgcgtgcgccgcgttccccgcgcccactcccctctctctctcgctcgcgcccgcgcccgaga

SEQ ID NO: 9662 - DNA, 174 bp, Oryza sativa
aactccccgtccgcgccctccccctcctcatgcctgggccgctccgtcctcatcgccgacttcccccacgccggcgggtaaaaacccctccctctccctctccacccaaaccctaatctgcctgtgttcaccgccttttgcgcttcctcgcgccgtttggtttcccacctcagg

SEQ ID NO: 9663 - DNA, 1501 bp, Oryza sativa
ttaggaggagaaaacttgcggtaatagaatatggatatatgggatgaggaaattaattgttgaaaaatatggtgacggccacggtggtggcggcggcggcagtggaggtggaggcgatgatgaagagattaggaaggggtggggattttaaggttatggaggggtcttgttgggccgggcctaatatccatgcctaaaacggtaggttcacattggtcttgggttatgaagggttacaaatctcaaaggatgatcaaatggatcaaaatacactcgaacaaaaattgaaggcccttcatttatagaaaattataaacaaaggactcctgatatatgacagtagcctaaaatatactccttcatttatcaaatgagctagatggattagattgtgggatatgtgaggttgtaataaattcaccatatgttgtagttaaggtgtagggcagatggagcaacaccaaacatgtactccattgatcgaaggagttacgcaaattaaattatcattatattagaaaataatattttactgtctagttataataagttaaaaggtgacacaaccaatagttttggtacaaggatggtgcaaaattagagacaaacaccatgaataacagatagaggagactaggaatgtagggagatggtcttttgtgggttgagcctaactttttactcctcgtaatagtgatctttactagagttgtcgtgttagggggtcatgatgtatgcaaacatcgtttcattccgctatagtctcgtacaccctatgtcacatagtttaatcactaataaacacatgcataaaactatttattaggaatatataactgaccacataaatcccaagtccccaactaagcgctgccatataccaaacatgccatacatccaggaaggcgaagaggtttgacttcacatattgacttccttcccttcatttttcttttcctagttaattaattaattagttcctcaaccaagatgagaaagaacaagaagaaagacaccaacataaatttgatgttgacgtagtcgtgccaaccgtgcacacatgacgtctttagatttggaaattactggaaggccttttcttcctcttctttttttttttgaaagaaacttatttggaacttggaaggtcttttcgctctttaggaaagcgcgcccgcttccatcccagaaaaatttccacgaaggccacgacccgcgtcgcgcgcgcccgtttccatcccagaaaattttcctgtataaataaataagacccacacgaagtccacgaaccgcgtcgcgtgggacccttccagaagcagagcccttcctgtagtcgtcgtcgtcgtcgtcgtctcctcttcgcgttgggtttgattcctcttcttctcgtctcccgcagcggcggccgtcgatcggaatggcgagccgaggagaggccagcaccagcgccaccagcagcagcagcagcagcccggcgggtacggacgcggcggcggcggcg

SEQ ID NO: 9664 - DNA, 1501 bp, Oryza sativa
ccgccagcgcgccgcgcgcgcgtgcgcgagcgtcgcgccgagcgccctccgctccgccgcgccctgcccgcgcgcgtgcgcgtgagctggccgcgccgagccgagtcctcctttccgcttcctcgctgccgctccccgcgcgtcgttcgcgcgcacgcccgcgtggtcgtcgcccgcgtcgcgtctgcgccgtccgcgcagccgcccgatcccgctagccagcgcgcgtgcccgagccgcgccgctcaaaccaccgtgccgcccgttgtttccgcgcgcgcgtgccgtggtggccaaccgcctggtcgctgccgccgtcagccccctgccgcgcctgtcgctcgtgtcgccgctccgctccacaccgccccgccgtcatcgccgtcgtcatcgcctcggccccgcctctccgcgcgcaagccgctaagggacggaggcagagctccccctccctctgccgcgtcgcccccgctcccctcctccttttcccaaagaggcaagggacaagccccctttccctcccctttttttttctctttttccctctcgccggcgtcaccttctgtcgccgttttggccgctaaccggagcaccagctcgccggcttgaccgtccaatgtcggttcccctctcccaaaccgacattgccgcccatttaaacccaagcccctccccctccaatctccctcgttttcgtctctcgccgccactatcgcccctgttcgccgtcgccgtttgtcgtcgcgtgcgtgccggaggagccggtgcgcactaggatgcggaaggggactccgggcgcgccctcttcttcctcttcctcggcccgaggccggagagtttactcccgcgccgtcggcctctcgtcactgcgccccgtccgcatggtagtgcctccctccgttcttcctcctcgctccatctctcccctttagttttcggtagtagcacgagtagcctccccgtagctagccagcgccgccccggccgttgccaccgctcgccgtgtgcttgccgccgtcgccgcccgagctcggaagcgccgctcgtcgccggcctcgctcggcgtagcttcgcccaatccgacgctagcaacggattcccatagccgcgtagatgctctcgccgccgggaattggcccctcgtgacctcgtcgccgttttccccttttctctccgccggttgccgccgccgcaatccgccgccgacggactccctcctgcgaatccgagccgttggctcgtctcccctcatcctgagcaaccacccggtgtactcgctttcaccggtatcaccgtggttcgctccgccgctcgccgctatcgtccgccgtccgttccggccggcgacggcccgcgtggcggccacgtaggcgccacgtcggcgccagctcgccgagatcggatcgggccgatcccggtcagtccctcccgtgcgcgcgttccaccgcgagccgtgaggctgcgcgtgggcccgccgtatccgcgtccaccgcgaaccgcg

SEQ ID NO: 9665 - DNA, 1501 bp, Oryza sativa
aattttgtattgatgttgaagatgaggttcttaagctgctactcatgactttataataaaaaaagggtcgtagatacatgcatgatgctacctccgtttttaagtagatgacaccgttaataacttttaaaataatgtttgaccaattgtcttatttaaaaaaacagtgtaaatatgctaaactatgagtcgtacttaaaatttatttagtgataaattataagaaaacaaaagatatttatatatattttctgaataagacgaatgatcaaacgttacgtaaaaaaatcaacggagatatctattaaaaagtagaatgagtactctataagttggtaggtagctcaattgacactagtgaaggtcaatccacacaccgtagtccaccctctcggctccccaattttctctgggttcttcttgttgacccaatttgtacgaccacacgtctacacatttttcgcaacatgcgccattattgtgattcaccacattgggattacccgtgtcaaacgacgatgatttttttatacaaaggctaattcatcatcacgagaaataaggtcagcatggatggtgtcaggccatttgtagaacaccgggaggaacactctatcctccatccacttaaacttggtcttcttcaccatcgatgtgagtgtgccggtgaacaacgtccgtccttgcaaactctccaccttctcccactccatcttcttttcgttaagcttgatgacatggttcagtgtcccgcgtcggccaaggaggacggccatcagctcatgctgatcagactcaaccaggtagctattgtagtgtttgaaaccgaagctcgtggggttgtcaagaaactcaaacccttcatcatgcttgcatgggtcatacattaccaaccctccttgatcgtttagaaggtatatcaagccgcaatggataaccgggttggtgacaggtgacggtagtagtcgtggcccattgatgccgagctccatcaatgtccagtcctcccacacgccatcatcgctgttccagttggcatagccaatcttgagtgggagaaccgcgtcgataccgaatattctatgcgccctgtcgtcgtagatgacaaaatcaaaattacccctatatatatgtggaaccttattaatgttcccagtcacaagctcgacatcgagtaccgcgctcggcgaatcaagcgtgaggtgtcgcccagcggcacagcaaatcttggcgcccgcgtggtcgccgtctttgccgccgacctcgaagttcttgtggtaataggggctatagtaccgaatattcgtgacgccgacgtgggcggtgctgagcaggagcggggtgatccacgccgggtagaagggcgacacggcggagcgccagtgccggcacgtcaacgcgaagctcgggtggctcgaccaccgcaggcgctccaggatcacggcgagcacgtcggacgggagagacgaccagtcccgttcctccatcgcgttgggctctc

SEQ ID NO: 9666 - DNA, 1501 bp, Oryza sativa
gaggcgctgcatttgaactggtcatttgcttcttgatcaatataatttgctagatcacaaaaaataaaatagcatattcagtttttaattatctgcaagtgatcacacaaaattacatccatctgtatttatatgtttgtatctatctagctctatctactgattgggcactttttaggtaactctcacattataatcgaaagatatgacgattgattgggtggattgtattgtaataaccatagatcgtattatataactaaactagtagcgtgtccgtgctaacgccacagcaaaattttgtactgccagcaaatccctagctgaatttcaccgaattaattaacatttttctctcacatatatgagagggattggacatctctgaattttattgccaccatttgtttatctgttcacattattttcttgtgatcagtgcatcagaccttgttttagacaaaagtctttcgcccagctttaggccgagttcagttccaaactttttcttcaaacttccaactttttcatcacatcaaaactttcatacacacacaaactaataacttttccgtcacattgttccaatttcaaccaaactttcaattttggcgtcaacacacccttactaaaagcatacgagtatgatacacgttttgctggagtttcaagcttaacttgcagcagcatgggacaaaggcaaagctgctagctcagcagataggcagaacaagccagtctgagctaagcagcaaccaaatgccaagctgctaaaacaacagaaccaaagctatatctctagagaacggttcatctcgagctatctcaaaagggaacggtccatttcggcacaaaaatgacagcaacagacatcaaacagttgcagaactaccgaatacttatagctagctggaaaactgaactccacggtctcccatcttcttgatcattagttgagacttgatcctcatctcgtgaattttgacaagcagcaatccctttaaagcatccaagtaccctgccagcttcgaaggaatcaaaggtctccactgttgcaaaagggaaacaactctacaaggcaaatgcaacatatctgaaagcaattttttttaacacccaatcatttcgggttagcgaaatggcccatgttcctgcagagaacaaatacaagaaggtaatattctgattttgtttccaggctattgcagcatggacatgaccttaactctagaatttgggattctatcccggtgcacatctctaaaatagcaacctcaggaattttgctggagcacatttgaacattaagtgatcaggctatattgcataatatatttcttgtgatctgcgagtttgttggtaaaaatttctttgatgtgatttaaccacaaacgctgatgtgcagagataaagacataggtaataaggatattgacataccagcttcagatattgtgctgcattttcttgaaccaatccatacatcagttttgcacaccta

SEQ ID NO: 9667 - DNA, 1501 bp, Oryza sativa
ctgtcagttaaaaacttgcatttacacggcccaacatcgtgcctaacatgtatacatttaattactaggactaagctaaggtacgccggtgatttatatttattttcgagcagaaaggtgacgagctgatctcccgagttcagacttcagttcaagccatacttgggccgtgtttagtttccttcaaactttcaaaaaatcccttcacctcaaatatttggagtattaaatatagacgaaaaattcaattggacagcttgcatgtaaattacgagacgaatcttttgagcctaattacgctaggatttgacaatgtggtgctacagtaaatatttactaacgatgtattaattagacttaataaattcgtctcgcagtttataggtagaatctgtaatttgttttattattagtctatttttaatattttaaatgtgtgtctgtatacgttaaaattttttttaggaactaaacactgaattttttcccccacccctaaaccgaaaaccccccaagacagtagccagtgcatttcaactagtcagacaggattaagctagttaatcctagttactcctccgtttcaaataattggtatttctcacttcctcctaagtttaaaacattacatttatatatttgaccattaattactataaattcatatggtttaacatggatgcactaaaatgcacttaacatgctcagtaacttgaacacgctctgtcagaattatggatactacatatctcataatagttgactaaatctcggtaggacccaccacataccatgtcctatatggaagcaaccttcagatatggagagagttccggataaggaaagacgactagagttctacatggaaacgacaagtactactcggattgtatccatattggtttacctagttctacttgacaaggggacacctttgggtataaataaaagaccccctaggagaagaggggacacatccaccatagaagacacggaacaatagatcaagacacaagatcaacatataagccaacatacgccaagacaagacgccggatatcgacttcagggataagcacggctagtctcctacggtgtctccggttactgtcaggagagacgaaagcgctatctctgatctcgctgggcatgaactcgaggaggaagactaccttgttgtcgactacgagtcagacctttagaccgccatgtcgacaacagttagataggctaccccaaatattgtactggtgtgattatggtgaataagagcaataccggcttcggccaataggatgtagggttattacctgacaattcaggggcccgaacctgtataaaaatccctgtctccatctcttttacctcagtctcgcatataccctagtcccaacgatccccatactatgcaaataccggaatcacgacatcaaacgtcgacagtggcgtgccaggtaggggcattttggtgcttcaggatttcgacgagatgggttcaaga

SEQ ID NO: 9668 - DNA, 1501 bp, Oryza sativa
cacggttctctccttatatttcccactgggttttcgaggagttttacgtgatgtatttaatatactgactataattatttctaagattatctttacagatatatggaacactaaatgagtaatgatcaaagttggattcgatcaagggggagtgttatgaaatatttgggtgatctcatccatctatatggatagaacagcaaccaattctgggacacgacggttggtcgtgccccacacctcttctcgcctcacggcgagaaccatcgcgtcttctgttgccgcctctctcccccatatatattgtaaccattgttatcaataaaggatccgctcattcattctctacattcttgtgtgcaactctctctctctctctctcgatccctctcgctcaatcaatcttatacactttcaacacgatctatgatccgattacaccgttgtgttcataacaattaaatctttataacaaaatctcacatgattatattttgatgaaaaattataatttatttttataatatatctaaattacttttaaatttcactaaattactacttagataaataaaaataaatttagtaaagtctaaaagtaatttacatgaactacaaaagtaacttaaaacaaaaagaaagtaacttttctgacgacattagaagtaaattcgttatagggataaaaatataactctatctagaaattaaatttaatcagcacaagtaagtttaacaagttttaaaagtaacatgttaattggaagtaacttttgcatggttcagaagtaactttctataaatttgtaaatttgttttaaacattgattgttttttccctttcacttttgtttttcatgtagtatgagataagaagataaaacctttgatggattgtaaataagttagaattaatcatgtataagatgtaaaagttacttccttataacatggaagttacttcctaacatgtaataaattacttttaaattaataaaatatttaaatatattaaatatggatcttgttttgtcgcatattttgactggagcacaatggtgcaaatagattttaaaaacaatatgtgatttaaaagatataagttattaaagaggttaaaaaaatacacactattgtatttatacttgatggtgtggtagctggataagacaaaccagctaccagtagttgtctagtcatgtccataattaaagtgcatttaataataaacaagtaaaaaataatattatatttttaataaaaaataaagatcaaatgtatatttaaaattcaataatatcatcaatgataagctaaagttcaaaaggaggaaaatctcgtccagactttccgacacatcaaataaggaataagtccactctgactccccgaaatctaatttgtatccctcgactacaaaaccagatataacgacacccccaaatattaaaaccatctaaaacaactaactcgatggtttttgagagcagtttcgttgaca

SEQ ID NO: 9669 - DNA, 465 bp, Oryza sativa
ggctaagattttccttttcttttttgaactaaattcaaataattcagttttagtcttgtgttttttttgacattttcataaccgcactgtatagtagattgtagacaatatcaccacgcttgatgcgcggtaacgtacgtatttgtgctttcggttacaaaagtttgagttaaaatgccgtgcgtggccagtaaacagtaatttcggtttacagattgattatagatatctctatatacgatttcagggtcaagaatcaagcctcgccttcgcccttccacagcctcacggccctgccctctcccgaagaaaaggtgtggcaaaataatcgagtattctagagaaatcgccgatccctccatccgcggcgttgagctccttgcagcaagcacctacgactaggctctcccccgacgagctcgacctcgagctcgttgaatagcgtgaggttaaagtcccccgaca

SEQ ID NO: 9670 - DNA, 1501 bp, Oryza sativa
gcgcaccggccggcgccggacactctcccccacggcgagagcagaacaccatcccccgacgtcgcggatccggtgtgccagccttccagagagccgaatcgacgggggctggccggccggggagagtaccccggtggcggcggcggcggcgccgatctagggtttgccgggaggaaaaagaaaaagctttttctttcttcgcagggggagagtacgacgctatgcaaaggataggaagattagatgtggcgacaggcttttgcgatttattgcgagccacaagggcgtcatgcaccggtgcacgcggtgcacagaatcgatgcgagtgggccgagttggatccggtgacgcggtccatgagcctggtgtacgccacaaaactgccatcaatctcacaggcgaatccaatgtttgtaggcaaccacgtttgtagacaaattagaaaattaccgagagaaaaaaaaaaggtaattttggatagtactttctctctttttcttttgtgaaatgatgattagaggttttagaaacttttcctatgctacctcctctcattctaagtgcatctatgtgtccaacatttaatcatatttgaatgaattttttttattattagcaaaaatgaccgtgcgttgccacagaaagaaaaaaaagagaaaattgaattaaaacatattaaattctaattaaataaaatacaaattttctaaaatatttgggtatttttaagtaggtaggtatataattaaactaatttacaaataaagtaagcgtcagaaataaaatgatatggttggatttaatttttattaaattatccatattaattacactttttgaaattttcttggaatttacataacttaattactaattttgataatacaaacatcattttaggatttatttaaatactagcaaaaatgcccgtgcgttgctacgggtaaacaatttcatacttttaaagtatatttcatgataaaacaaattacaataaaataattaataattatatgtacttatactatatttcttgataaaacaaatcacaaaataattgaatcctaacgttcacaggtctctcacttaagcatcaaatatttctaaacaatcaagaatttttggggaaaaaaagtggcacgaactgagactagagctagacgattcattaatcgaacaatcctttccttgcatcctcttatttacctccaagcagctagccaagttcagttttgctacctcttatctcgcccagcacctcccctccctccctctcccgtgtaggcctcttggcccaagaggcccagcccgcccaagtttgtttttgtccctcccaagttgccaggtgggccctcactacagtgtcgtcttaagctcgtgaccaggctggacttcgccatcgtcaccatctcctcaagaaacataccagcgacctaccccaggcagtggcgcgtgcgtgacgaaaaaccgagcgtatcaaatacaatctgactatggacct

SEQ ID NO: 9671 - DNA, 655 bp, Oryza sativa
attcctgcacccccgcgtctgaagaaggagaacgctcagctgaagggtctcccagcgccaggaggagtccggatccgcactacgccccgtaagaggacgactgcacctgtgcgcatccagcttgcgcccaggaacccacctccaccagcagcccccgcagcagctccagctccgcccgcagttcctgcagctccagctccagctcccgcgttcactctctccttcgctccagcatcagccgccagaggttcagccagtggtaccggaggttggctgtctgctactcccagtggcagcggcgagactgatccgtcagactccaggagtcgctcagagggaccgggtgacgagcaggaggacgccttcgactccaccgaccgcaggagccgttccgagcattaggctcgtttttccactagttcatcgactgtctagtttttgtttgttagtttgtgtgtttaggttgcttgtttggggtcagtcgacggtcgatatcatgtgcctatgatatggctgtcttaataaggatgtttgcttgctcttttaagtgtttttaattcagatcagaacaattgcagttttaattcctatataataaagcttagttcttgagcatctgtttttcttcttttccccgtctgttcttccctccaga

SEQ ID NO: 9672 - DNA, 1501 bp, Oryza sativa
actcctaaagctcatgtcacatcatcacccactagcaattattatttagagtattttaaatcacatgcaagtgtactatatcatcactcactagcaattattatctagagtattttaaatatcacacaaacatgacatatcatttacaaatgttgtattttagaactcaatatgcaaacaatatcaaatcattatctctacatatcattttatattatttaaacatatatatctaccatttctataacgtataatatgtatttatctatatatcccgcaacaaagtgaagggtatgatcaactagttgggggtgagccacacgaccattcgtctgatgacaggtatcatcataggtcctcgcggactccaaatttttattattttttatcattttaatttttaattttaaaaataaactatcgtaaaacttatctaaaataagaaactttgagccatgccatcccgcctgacgtggcgaaacaacactaccacgtcaaccataatggacatgacaattttgttttaccacatcagctatgatggtgcagttaattgttgtgcaggttacatcattatggtcaaataatgttgtcatggtagctagaccggtgtgacaatattgttttgtcatgctattctagctggtgttgtcatgttttgagttgaaatagattctgaaagagattgtttttaaattatataggttagaaaaattcgcaagctcccacgtacctcctagttggccacacaggcaaccgaaagcaaattacgtaggacgtcggatcttcgtcaatccaaaaaatgactccactcctgctgacaagaactcgtactactacaaaaatcagtttcgctggcggccaaaatgtattttcgctagtgagttgccgccaccggatctgccctccgcgcacctcgttgccgccggacctgcagcctcgcgagttgccgccgccggatccgccctccgcgcgcctcgttcccgccggactggctgccccatgagtcgtcaccgccagaacccccgcgtcacgagttgttgctgctggacaccacccctcgcgagtcgcattgccgccggatctgctgccccgtcttggcgaagctccgccgccacccgtggacgccgccgccaatggggaaggaggagaggggcgcgcgcctatagactccgacaggcgcatgtagggaaggaggaaggggaggaggggggggggagaaggagacttggagagggcgggggtcagtggagacttccagagggtgagggtgtgcagacttttaatattgttgtagtttttcactgcagtgctctttggtggccgctagcgaaaatcgatttttgttgacggtcacttaagtggtccacctgtaaaatagggctatttttaatggcggatctcttaagataaccacttgcgaaaatagattttcaatgacggtcactaactaggaacctcctgctgtattttcaatggtgttttctattttagccgtcag

SEQ ID NO: 9673 - DNA, 1501 bp, Oryza sativa
gggcgaagccaggataaatggtcgtcggggtcaatactaacttaaactttgtttagatctaggggtaaaattttgccgtgtcccatcggatatacagacacatatttgaagtgttaaatgtagcataataaccaaacaaattacagattccggctgtaaactgcgagacaaattttttaagcctaattaatccgtcattaacaaatgtttactgtagcaccacattgtcaaaacatggagcaattaggctcaaaagattcgtctcgcaaattagtcgcaatatgtgcaattagttatttttagcctacatttaatacttcatgaaaggtgtttaaacgttcgatgtgatatggtgtaaaatttttatgtgggaaccagggtttcccaaaccgtcggggccagggttaccgcaccccggcggtaagcacggttaccgcggtaacagtggaaaaccgtgaaaaaccgtgcaaaatttatcaaaaatacaaattattttttaaatttatttgaatttaaggaggttaccgcggtatttatattaccgtatccctacggtaagcctggtaacctcgcggttaccggcggtaagggaaaccctggtgggaactaaacaccctcttagtgtttgatgcattgttagatcttttaaaataggagtatcttttttttttcaagaatagctccataatgctttgctcgactatttatctacagaatttatcatccaccctaaaagaaacccaaaaaaaggaaaaaataacagacccaacagaaaactaaataatgctacgagcaaccattggcccataggagattattgcaacgcactgacatgtctataaattatattaaaaacggacataattaaaatctaaacaaagtagacattaaatgcacaaatactcaccgctaagattaccaaaatgtatattgagcatttgggctgacgtataatcattagaactagctaattcctatttgttgcttgctaatgtcaaacgtgtcgtttctaattgctaatcgggctgtaacaaaatatggttaccggggtctagtgtttatatcgaccggggtcctacacggtaaaattaagtgggctaagaagcgtacacaagaaatcgtcggggtcagtggaccccgatggatagctatagcttcgcccaatgaagtcccaatgattgaatcaatataggtcgttagtctcctttctagtctctttatatagcaaatagataaaaatgaatagaaaagaggaaaaaaaaggagagatattattgtcctcattaattatctgccgttattaatttccatgtgattccgctctatatactaaattaacctcaagattgcaataatagagctggctaaattaagcaaaaatatttacgcagcaacattattacgggaacgtatacggttaaaaggcaagattagcttgtactaaaataagccttatgtcatctaaattccatctccaccattgatattataggcaaactgt

SEQ ID NO: 9674 - DNA, 852 bp, Oryza sativa
tataagttgtgatttataaggggattctgctatccgggcgaccaggcggggggagcaaaattgggcgctccccccggccccgctcccagcgcgcggccgtgcgcctgcatgccgctggcccaccacagtgtctggcccaccacagttgtcgggtcccaaaactaatgatttggaaaccgacatattaaaactgtatcaagccttggatcagtagattgatacaggtttaacaatttggatcctcattgcatacatttaaacatgactccgaaggatatgttattacaaaatatttatgggtgtttacaaatttgtggctaattaatacaacagaagctatagaatgactcaactctactattttgctatagacttaaaccatttatctagtctatacttgaggattaagttagaatggaactaacttatatgattgaactcccagcttcggtaagaacatcaattggactctgaaaaagggggttgaagcaagggtgagtacaacgtactcagcaagctattatattcaataatgaatgcatgaaatggtaatatctgagtagatctaggtttacttgcagaaatcaaagaatatagaggaataaagcctagaatgttttaaatgcaacaatatttaataaagtttggaattaagtttctaaccaaataccatatgagtcccaatgctcaaatccgtgagcacggctattcgaatagattcatttatactttactgcagtaaatgtacgctttacccgcaatccatgacgtgccaaacacattagccttgtcatggcaaagcttttcggttactaacatcagtggtacctgttccatgaactctagtcccca

SEQ ID NO: 9675 - DNA, 1501 bp, Oryza sativa
taaataaaaatagataggcagccccctgtcgtcatgtagtcgatcttgggcaaattgctttcgaattccgatatataaacgtggaaatatttgcaaggcatgggggccctggtcaaccaggagctcggcggctcgcgcacggtgcaagttcaacagcagcagcagcagccggcgttggacttccaggagaacatcctcctcctcgtcggcgacctcaacgcgcgcgaatgccggccaaagaggaaaccatcgtgtacgaggcggatccggacgcactcaccgtggaccttgtcgacgatccgttggttaaagagttccgtgacaagttagtggatgaggtcctcaccatcgatgccggagatatggaggcactattcgaggaacaccaggagaatccggagctggagaggacgctgatgctgatctctcagtccgaccaagacgctgatgccgccgatggcgacaccccatgagactcttattacctttctttgacgtgatttgtctcggactttcattttttcggcccagcatgtgttgggctgtgattgtttcttttctttgacctttgtcaagttttctttcagccttagtaactcttctatttttttttctagatcacagccgaattccttccttggataccctacacgtactactactactacttctgcggccgtggataaggcggcggagacggaccaccacctggccacacgtgcctgcaggcgctgcgtcttgataattctgccaacggagaaaacccatgaggaggagtttatatttataggacgtgactaatactcgtagagactatactctatactgtattaactatagaccagggtttcccaaaccgccggggccggggttaccgcgcaccggcagtaagcacggttaccgcgcggtaaccgcggtaaccgtgtaaaaccgtacaaaaccgtgcaaaatttataaaaaaaattaaattattttttaaatttatttgaatttaaggatgttatcgcggtatttatattactatacccccgcggtaagcctggtaaccgcggtaaccgtgtggttaccggcggtaggggaaaccttgctagagactcatttcaaaccttgttgcctaactagtacaccaaatgtatacatgtgtacaaatttaatatttcagaaaagattatatgtacaaaatatatctattataaagtttctatgcgtaaacttttctacgtataaatatttatttttctagaccggagtaacacgctgataaattcattctaaatttaaacgtacaggtttcataggtacaaaaattacatttaaattactcgtacagggtatctgaaatttgtataagtatagatcggtgtaaaaatatgtatataatctctatattcttttaaaaaagtagtggtggtgataatgaatttgccaccccacctacctacttctattatgaattctgcaaattatctcttcaacttgctaatatttaaaacaatcaaaa

SEQ ID NO: 9676 - DNA, 1160 bp, Oryza sativa
ggttatccggaggcggaggcaggcgcagcgggcaatgagaagaggggcgccggccgccatcggtaggcccatgggggtgggaatggaggacgtccttatctccgccggcgagaggagggattagaggggagatattaaaagaggggatatgggagggagagaggaggaagaagagaggggatttgagaatgacaggtgggccccaccattttttgaaattattgtatgtgtgaagctgacatgtgggtcccagaggttttgttatttttcacggtcgaattgccacgtaagcaccacgtcagataaaaacaccgtccaaaccgctatgggacctatgtcactggttttgacagccgagggacctgttgtatctggtttttcagttgaaggacgaaaatcggattcgttgacaagtcaagggacctcagatgaacttatttctccggccaatgagcgaaggctgtgtttcacaccaaaattggaaagtttggttgaaattagaacaatgtgacggaaaagttgaaaatttatgtgtgtaggaaagttttgatgtgatggaaaagttggaagtttgaagaattattttttaactaaacacggccgaaatgtttcggtcgctgtatagttaatttcatgcgggcttttaatctactgggttcatctcatgctgctgctctgttagatgatagggaaaagtacgtacgaggtccttcatcttgtcatcaaactataaaatcgtctctcaaccagaaaatcaatatatgagatccttaacttacaaaaccggtttagtttaggtccttaggtggtacgtaaaatctaaaccaagaggcttctcgctttagtcgtatcacgcgacacgcctcacagctgttcgatcgtgcttgtcgtcctgacgtacatccgcgtggccgcgctctaatggctcaatgagaaggatcaacgtagtgcctgcctgccttttttttaatagatcatgtatgcctttttcctcttcattcaaataaaagtttctctcaaattatttatctgatctataatccgattacaattatgtttattacaattaaatctgtcgacattcgatgtctcgactacggtatttgcatggcatggggatcgtcggtgctaggatatacacgagactgaggtaaaagaga

SEQ ID NO: 9677 - DNA, 816 bp, Oryza sativa
cctcacgttgacagggtaaagaaaattgggtatatatatttaccttcaatctcctgaagttcgtgttatactcttatactcttctctcttttttttaacgaaaaccattataccatcatcgatctttctcttgtttgttttcttctaaaaggttttatgttagcaactcactattatcataataagtttcacgttggtttctagctgatgtgtttagttaatcctatgtatctataaggttcattctcactaaatcctatgtttcaggtaattcttaattctcttttctacaatgaagtcacatcatttcaattatttctctttagattaatcatcaagggtgtaaagttcatcgcttcttccaaaaaccacaccatacaatccaatcatttataacatttggataattgatcaagatgcaaaatatataagcacatgaaagaaaatcgtataggtatatatgtaagtaagaaaattctaactcatatatactattttatcgcttaaattttctcgtgggaacgagcaggatacctatctagtttacttacgactgctccaatttatatagaagaatagcataattcatgtacttaaaatgatgtgctctttgtttgaaatcctccagagattatttttgcagcattatcatcgcaaaatatcctttttattttgaaaaatcctacttatcatgattcacagattttatcggagaaatcacaggaaacgagagaaaacactaaaacaaatatgccggtatatatttaaccattttcttttgatcttcttgcctcttcattgcttacaaaagttcca

SEQ ID NO: 9678 - DNA, 1287 bp, Oryza sativa
attcctgcagcccagagaatttaaacataattataacttaatgcatgtgtgagtcttcccttcccgggtgcgccagaactgctctcactgctagaaaccatgtacgcctagagtgcatgaggatgtaaagttcatggagcgggtactgccaatgcgaggttaccgaaaagctttgccgtgacgcgtctcatgtgttgggacgaggctcatgtgttgggcagtcgcggagtgcgggtaaagtgtacatccactacagtgtgagtaaacctaatctatttgaatagccgtgctcgcggttattgagcaccgggacatgtattacacttggctagactctaaattcttaacttgtgtgggatgggatattgcatgatgatttctatattgatggagccacttcctgagaggcgggaatgtggacgtcctcagaaaaccatgacgactcaatggcgggaagctatccttgggatcacaatggatagtggacaataccgtcattgtttaatatgaacactactactaaaatttgatcagtctgtgctaggtcttaggcttgtgaaaagaattacaaaacttgctttgcgcaaaagaaccatagccatcctttaaatacccctgtcatatacattgttgctgtggtggcttgctgagtacggttggtactcacccttgcaatatacaaacttaatcagaggtcggagatgaagcttcggaggatccctacgcttactaccaggagggtgatgaagacgatggcgctcagtaggtcttagttacggtcgttgcctgtggcaatggcgtgccgctgccttgactccgctgccttacctacttctgtttttggaatgtattccggaccgctcggtccgatgatttaagactatgcctgcgggcttatgatgtaataattcgtactagacactcgtgtatgtgcacttggtatttcagctatgaattcgtgtgtaccagactacttgttccagggaaatggtactatttacatgattgattcctgttataaaaacgggggtccacaaagctggtatcagagccatacgactgtaggaaaagaccaaaaaggcgccccaccccttttctaagttggccaagggagaaattcccatttaataatactttcaaaaataaaaacactatgtttacaaaactcggtacgattttcatcttaatcttaactattttcttcactaaacaagatttactctcagctgaccttgggtttttcttaaaattagatggcagattaggattcacccgctacctgggaga

SEQ ID NO: 9679 - DNA, 1501 bp, Oryza sativa
tgtaaaacattaaaaaatatatatgaactattaaagaaaactaaaaaatcacaagaatatatcatctaaaatcttatagtaattaatctacgtgctacaattaattataggatatatagagatgtgtgatgttggcttaccatcaaaagcacaactataacatcatttgtaattggcatcggtgcgccgccttccttctggagcctgagcaggacgtcgagagagcatgacttgctccccgccgccgccgtcacctgatcgccgctcgccatgtccgcttcaatttggtccctccgttcttgaatgatttgctgtatgacgcgctccatcttgttgcgggtctccagcgccctccgtggcgccgtcgcgaccatggacgcgagcttggacgacgggaagaggtcggcgacgctgagcgagaacgtctggcctaccatgtcgtttagcgcagccagatactcatcgctgtacttggaccggctcccgacggagcaccggagcacgatgtcgttgatcagccttgtgatcatctcggtgaggttcacggccgtgccgggcgctgcagcggcggcggccgacacgtcgcgcacgagccgcgccacctcctcctcgcggatgcgctggaacgagcgcacccgcgccgcggtgagcagctcctgcgtgagcagccggcggaggtggcgccaccgctcgccgtacggcgccagcgcgacgtccctgccgccgaagctgaacgcgtcggtgccgctggtcaggtggcggtcggcgaacgccaggtccttgctcctgaggatctcctgcgcggcctccggcgacgaggcgaccacggtgggcacctcgccgaaccagagctgcatgacggggccgtgctcccgggccagcctccgcatgacactgtgcacgctctcgctcgacgacacgaagtggtggatgctgccgatcagcggcagcgtgcttggccccggcggcagcttaagcctcgacggctttgtgtttgtggcacatgaaatcaccggcagcctgtgcctgtggcagactaccccttggcgcgtggcgagaagcaccatgtcgcccatgtctctagctactgtactacgtacgtgctagatagactactgtggtatgtgcagctttactctacagcattggatcgtgctataaatagccgtgtcattgcgttcttaatatctgccactaatgctggccttattctaaatttacggtcaattaatggaggtgtatactaaagggcagcgtggaaatatatactccctcttccatcccataaaaaacaaatatgatataatttaacttttttatttatagtatttgttttataactgagcaattttctattctaatcatccaattagaacacgctctttctccaaattttagcatgtattaatttagttaaatctgtaatttttgagtgaattaaatcaaacaaggattccgtgcacggtatacagatctcggatactcattaccgtgaaatatc

SEQ ID NO: 9680 - DNA, 1501 bp, Oryza sativa
ccaccgtgtccgcctgcacctcccaagacaaggtctcgccaagctccaccgcctgcccgcacaagggcaacgaagaaggtgagagttgacgccaccaaaaacaaggggccaccgtacgattgcagtcaagaggagcttgatgcttatgtggcaggagaagtgaagaggtaactcaagcctcggtgtctgtcacgccctaaaaatcgcctaaattaaaaatgcattgtttaaatcattttttagaaattatttttttaaaagcctacaagctaaaccctaattatttaggaaaattttcaacaaaaaaatgagctagataaagttttattaaatactacacttgctcctctattttctagatttttctaggaattgtttgagcaagggaagtatttttaataaatgaaacatcatttcacaaattattttaattaaaaagttccaaaactcctccctaaagccgttgggccgtttttggcccaacatctttctctctccgcgcgcgggcgaaccggcccaagccggcccagccgacgtcgcccgccccctcctcctcgagccgccgacatgtggggcccacatgtcggggcctccttcaacctccggccggctgcaagccgagcccgagccggccgaccgagccgccttccgcctccgaatccgccccaatctctccacttttagtccggatttttgaggggtttttatccccacatcctcctctatctttaccctcaagaatcggagcaaatcgttgggtattttatccgaatcgaactcgttttcgagtttatctctaaaaccgagtttttgatttcccgagtcgatttcttgcgggaggagtccgatctcttcaatccaaggctataaataggaccccctagtcctcctctttcgtttgctccatctcccgtcctttcccgtgctccgtagccgccgcgccaccgccgcctagtcctccgtcgtcgccggccgccgctcagccgcgccgcgccgccgcttgcgccgtcgctgccgctcgccgccatcgcctttaggtgcgccaagccgtggggaagctcggccacccgtcccccttcgcagccaaccgccggagctccgccgtcgccgtcgaccaagccgccgccgccgtcctcttcgtcgccggccgtcgtcgttcgtcgtttggctcgagggtgagtactgtcgggttcgtctcgtcgtcctctacgtgtacatgtcctccaaagtcgcagccgaccatccaatctccggcgaggtcgccaacccgggccggccattgatgacgtcatcatggcatcatcatcttcttctttttccagtttttttttctaatagattaaatcttcggaaaatcataactaaataaccgtagatccgtttcaggtggttcaagttgctaaatttttctaaaatcaagatctacatgttaaaaatatccacatgtactgtttatgctttttttgtactgttttgttaatttttgtttaattgctttagt

SEQ ID NO: 9681 - DNA, 1501 bp, Oryza sativa
ggactaaagatctggggtatatatattcccggtacaccctcgtcttctccaccaatacttagatgtttttccatcgagatcgatctcggcttctccttcgccgccaccgtgcctagggcaaccctgcgctgacgccatcgtcttctctcgccgtcccttggcggtgctctccgccaccgccgcagacgccgctgccgcctctcttgggtgagagccgccactacctctctctctctctctctctctcaatctcgatctctctctctctccaaatcgccgctgcctagctcgttgccgacgccactgccacaccgcggtcaaccgccaccgccgacgaccgacttctacgcgaccgccaccgccgccgttgccgtcgccactaccacgccgccgcccccgcctcgagctcgccacgccgccacgacgccacgccgccgccgcgcccgcccgccgctggaccagcccacggcgccccgacgccgccgccgcgccaccacgccactgccgcgcgcgcccaacattgccgaacgtgaacgaacgtgattgaaacgtgaccgaacgcgaacgaacccgaacgaatgtgaacgatacgtggacgaccttgaacgaacgcttaacgaacgtgaacgaatgtgaatgagatgttaacgaacgtgaacgaaacacgagtggacgtgaacgaaacgttaacgaacgcgaacgagcgtgaacgaaatgcttacgaacgtgaatgaaacgcttacgaacatgaacgaaatgcttacgaacgtgaatgcacttgtactaaaagtgtgagaacgaacacgtttaaactaatacattttcctggtaatacatatatgattatatatgtaacttggcccgtttagactaatacattttcctggtaatgttgcagagaagatgtcgtcgtcgtccctcaagccgaagtggtaactagccatcgaaggaattcgcgcaggcaagtgatgtaatgaagtgattgttagagatttaatataagattgttagacttagcatatatgattattacaattttaatataagatttatagcgatttaatataagtttgttagacttagcatatatatatatatgattattacaattttaatataagattagtagcgatttaatataagattgttatacttagcatatatatatgattattacaattttaagattagattagtagcaatttaatataagattgttagacttagcatatatgattattacaattttaatataagattattagagatttaatataagattgttagagatttaatataagattgttagacctagcgcatatatatatatatatatatatatatatatatatatatatatatatatatatatatatatatatatatatatatatatatgattattacaattttaatataagattattagagatttaatataagattagtagagttttaatattacggttagcaaatacatcctctagacctaacaaatatt

SEQ ID NO: 9682 - DNA, 1501 bp, Oryza sativa
gaaatgttgttattttgagacggagaaagtaatgccatttaacgctactttttgaaaatacaaactatacaaagtaggtcatttaattaatatcacgatcttgatttcgcttgtatcgatcatgtgcctgagcataaacaaataatactccctccgtatctaattatgcgtcacttttaaatttattcgatcaaaattttgaaacttcgagtctcaaacataaaattcgtgcagataattctttttctttataagcacatttacattattataatttagtgtcttgacccatattataatttagttagacatttaattatcgttatagtctaatagaaaattagtggtgaaaaattgcaccataggaaccaaataaagtcaataatattatatatttgaataccgagaatatattatatggctagccgacacctcaataaaagggaaaatattttacgaacaatgttccgagcatgttgtttattaagaacttagtgtacactggacgtgctcatgtccttaatatacattattttttgcgattacactagaggtgcaaacgactggcatagtactacacatgcacataacacacgaatgcacacaaacacatgcttaaaataacaaaggtcaatagcaaagtggtgggccactgtacaacctttggtatttctagttatgtgcaccccactttattaccggtttaaaatcccctttatttttattctcgatctttagtactggttgatgcatactaaatgaaaataatctgtcggatgtgggattcaaactcaagacttctctcacctcagtcctcatttgtgttaccatctcacctactatacataactaactttgatatagatgctttcttctttaactaacatgtactaaaaccgtaaaaacattctaggttggtgttaccatccggtatctttagtacgggtttggtttctccatctttaacttcggttggattggtaacaccaatcgaaagtagaaacgtttttgagacttcgacttttagaacaggtactgcaaaatatttttagtaccgattctaaatctaactgacatatttgtgttttgggtacaatgataaaaaatcggttttctaatagtgctcgaaagatgtagcagtattacttttatcaccaaaaagtaattaatttatcctgcgtgtaatgaggacaaaatgtatatgctacatgcaattaatgaaaatttagatggctacttggattctgattaataatttaatttatttattcatatatgttttggatatccgaagatgacatataggaccctcttcaaaaaaaaaagaatcagaaaaataaataaatattaaatacttttggatggagtattaattaattggcatatatatatatatatatatatatatatgtatatgtatatgtataaatactaactataaatatatgtattaattggcatgcatgcagagtgggagggacaagatggatgtggcgagcac

SEQ ID NO: 9683 - DNA, 932 bp, Oryza sativa
agagtttgcatgctatatacaagttaacataagtaattgaccacagtaaagcaaattttgtcagaaaatatagatcacccaatattaaaagaaatgttgcaatgatcttgcataactttggttcaacttaatcggacataaaatgcattttatatgaaatttgaaagcttcgacttccatatgattcgccaataaaaaattatatctgagagactgtactgaatatttggccaactaaacgatctcaagtggaaaaaacttgcaactacaaagatgcaggtgttgtcaagatctaattttgatagaacaggtatctatctgagttctaaagaaaatttcgacccctaaacaatctcacatgaaaaaaatttcaactacaaaatttatatctcatctagtgctacaattttcatataaaatttgtttttatccaacttcgtatgaaagacttatgatttttttctttaaatactattcctcccattttaaagggtggtttatagagctttttatagatagtaccacctataaaaattaccccacttttatcagcattttcatagacggttcactataggctaaacacccatgaaaattggtttatttgcatatgcagttttcttaagacactgcttgtcaaaatatgatttcacagacggtctaattaccggagactgcatcggtcatcttcatcataggtggttacaaattttagccacctctgaaaatggaaagtctagaagcaggaaaagttgttttttaagccgcgtatacaaagtgaaggattcttaacatcgcacagttaccgtaagattgttgcggttaccacatgcccttatcagtatttaaaacctcactgaatttcactcttaccaaacggtttttccggtaaaaccacatggtcgctgcagtaatcttgatactgccggcta

SEQ ID NO: 9684 - DNA, 301 bp, Oryza sativa
tcccccattacatggcaatatggggctatttatagtcttcgtacagactcataccctctagggtttagttagtacagggaaatttatacggatacccttatgatagaggcattagtgaggatacatgttgtcttttgtatttatgggcaatcaggcgatcttcttgggctggcccattaatggcgaaaggcatccatggcctgcagtgcctcccaagtcctcagtcgaagacacctcctacccgggtgaaggcctcctgcttcgctctatggtcttcacccatagtgatggcttggccaga

SEQ ID NO: 9685 - DNA, 263 bp, Oryza sativa
attattattatttaattattgtaggggaagttcattaggagtactttcgattggtcaacaacgcaagcaacttaactaactaacaatagagtcatatataacatgcaatgcaaattaatgtatggatcacctgattaattgggccgtcgttccattcccagccgatcgatcgcttcaactattcgatatatatatagctgctatatatatataagcaggatcggttattaatttatcgagattgattgattgatgtatggtta

SEQ ID NO: 9686 - DNA, 1501 bp, Oryza sativa
ggaagggtagtgctactttacactgttaatcctaggttaaatatatcctctgtattatacttagggagtggaagctggtggtagtgaccatttgaacaatataaatgagcaaattagcggcaacgtagaacgggatagctataaaaattaaaaaaatatatttatttgagtttttaagaaatttcttcatagtttcttttttttttgcacgaatcatacaattgaactgtttgaaaagcatgctaacgaaaaatgagcaagttgtaatttggagctgtggaaaagaacatagcctagtcaacttcatttttatactatgcccgatgataagattataggtgccataaatgttaaaggagtcatacctataaaaccctatatataaccatcatatgcggtgtcggaccatataattacttttaacagtagatttcagcttaataaggccttatttagttggggaaaatttttaggtttagttgtcacatcggatatatggatacgtttaaagtattaaacgtagtctaataacaaaataaattacagattccgccagaaaactgcgagacgaatttattaagcctaattaatccaccattagcaaatttttactatagcaccatattgtcaaatcatagcgtaattaggtttaacagatccatcttgcaatttacacgcaatccgtgtaattggtttttcccctacatttagtactctatgcatgtgtccaaatattcgatgtgacagcgtgaaaatttttgttttgggaattaaacatggcttaagttttacacgacattgtaggatgattttttttttactttggtaggactaataattatcaggtaaaattggttatatagcatcgaaagttcacttttttttacagcaccgaaagatacatcattgtggcggcattattttattattattattgggtttgctggtttatgaccaatatggcaaatccatcaacaacaaacaaaacgttagcttagccatgcccattactcctgtagtcgaggggtttgctattctggctctctattaagctcataaaaaatactagtccacacataagcattattatcttttgttaaatatgatggtagtttttacctggtaataatcatgggattgggtatattgtatttttatttttggtatcattacttggtttttttttgaccaatttggcagtcaacaaagcaaagagtagtaggttaggcacgcccattactcctcgttacagtagacggttggctggatcggaccggctctcccgtgaggcccacgggacgcccaaaacggacggcccagatcagcccgtgtgggccccacacgctcgccgacctcctcctattaaaacccgatgattccgtgcctttgccttcgcttcccttcatcacttccaaaaaagaaaaaaaaaactcgttttcttttcttctcttctcttctcttgttgcggcgaagggggagaggaaggtcgaggtcgacgaga

SEQ ID NO: 9687 - DNA, 853 bp, Oryza sativa
ccgccgccgacgagcgccactgccaaagccctagatcgaagcgaagcagagggccttgcctcgccctctccactcaggatttgtaccgctcgcattcgcatcgcgcgctcatgacctggagttcatgttgtggaagtagacgcatcgtagcaagcaccacccacgcgttggcttgcccccgtatctgcggttgattgattcctgttgggttcggttggtgtttgctcagattcgaggtgacaacgtaccagcagtgaagaaaaaacattgcgaagaagtgatcctcgttgcaccaagagtgtaaataatcttttgatcagctcctagaacaaacaataatcacatgtgttggtcccatgggcagaactagaaaatcaatccaaccaagatgagttcatgattgctcattctttcgtgcgtcagataaatcaagctgcatacttgggtaaaagaagatcatgtgctcaacatcttattgttctgctagcagttgtgttgaatcttcctatgattggccgaaacgtattatgaagctcctgatgcttctgctctcccagttgttggtaaagaaagtgatgctgttggtttggctagctgtctagttccttccagtttcttttgttcctagcatgggcaacagtagtcagcaatcatatcaaaattagatgaaatgcttgttacttgttgagacattgagatataatggattatggagatattactccatatgacataaatacatattaattatggacatctatttccagttttctctaatacttttttgtttttctgcagtgtgttgaagcctgcccttgacacttagcaactgcagagtcctgctggagagaga

SEQ ID NO: 9688 - DNA, 751 bp, Oryza sativa
tgagtacatatgctgctgctgaaattaaagaatggaaacagatagtgtaattttcatatttttagctcttcgaactgttagcaaatagaagtagcaaccaaacattatctgtatcaatggtatatggtggagttcacagaatatgatacacattggtgtccgatcttatacctaccctacgagatacgaatgtaatatacacttcctctatcaaaaataccaacttttgtacacgatttaatttatttgggatgaagagaagatatcaatcctgatacatattcataccaggtctaacgctcgtcagtaccagatctggtaccccatcggtgccagttggtactagctaatacctattgataccctccaccatgcactgcactggacacattacgagtgcggcgtcatccctcgcacagtcgcaccgggcgcccgttgttgccggctcttctccgtggcgggcagggacgccggatccgtgaccttcggctgcttcacacactccacgcgccaagtgccccgccacctgcactcgccgcgccgtcgcccgtgtagcagccctccccgccgcctcctgctaccgcacaccctctgccccgccacttggactccaccgctcgcgccacagccctctgcgccaccgcccgccactgctcaccctctgccctgccggtgggacacaccgctcgcccgcgccgcagctctttgcgtcgccgcctgtcgcgccttacggccctgatccggccacagc

SEQ ID NO: 9689 - DNA, 1501 bp, Oryza sativa
actcaacaaattgtatctgtagtgctgatacaaagagtacaacatttcttttccgatgccaatgcagaataaggcatatagtatgttctaagcttaaatgttgagttgtgtacatctaatagatggtaaagaacttagagtaactctctaggcaatcatggagccaaatcattttggtcttttgggcttatgaaataaaggagaagttagcaaacgttagaatttataatgtgcatatatatttgaaaggctaaaatccaaatccatagacagggaaggatgataagagacatgacacaatcgaattaagcagctgggaatgagaccttgggcctgtttgggagagcttaagattctaagaagcagctgactggtagccagcttctgagaatctagaaaggcttctagtttattttatggattctataactacagattctcaaaatttagaccaaaagatgactgtttggggggagcttctgattctggaagaagctacaacagctaactcccccaaacaggccccttgactgttctttcgtagaaatcagtactagcacaatagagacaaagactatggtggtgaccgtccatgaaaggaattattccgaggttacaacatgttaatagaacaaaccattgattcagaaatagtataaaaacaaactaaattggtatgaacctctccaaaagtaatgaggcaattaacataatactcctatgttactaactgcaactctagttgaaacttcatgttaatttattctatcctccagttgcaccaactacagttatgtccattgttatattctttacagcagcactaaaacatcgttgctacggtatacctgaaattaattaaccgaggaaataaattagattaccatttaatttggaaatgtggcagcctattcaatttgtataatttatggaattatcaccagttcaacatggccctttactgaaatgttttgtataagcatcaatcaatgattgattgcaatgataaggagttaggaataagttcatttgaggtcccttaaattgtcaacgaatccgattttcatccttccaccgaaaaaccagatacaatgggtccctcaactgtcaaacccggtgcactataggtcccatggcggtctggatggaggttttagctgacgtagcgcctacgtgtggctaatttgactcggtcttcatctgacgtggcgcttacatggcaattcgatccaaaaaataataaaacttatgggacccacatgtcagtttcacacacaataataaaaaaatggtggggtcaacgtgggccccacctgtcattctcaatcccttcctcttcttcccctctctctatatctcccctctgctccctcctctcgccggcgcagataaggacgacgtggagaggcgtggcctcctccactcccgcccccatgggcctaacgccggcggccgccgcacctcagatgaacaaaatatggttatccaccaaagttgaaca

SEQ ID NO: 9690 - DNA, 1501 bp, Oryza sativa
agaaaaacccaagtagatgagtgttgtggtataagttactagatgagtatcagcgtgtggtacattcgaattcaaaatgtcaaggactcgtttaggtagagtaagagagaacatgatgagacagtagttatgctgatcggacattattaatttgatacttctttaaaccacaccatttttttcacacatatctctatgagaaaaatgagtagtggagacaagagaacagtgggttcatatggacattgctggagaagttgtattcccaaagttacttacaaataaaggtccaacgtcgtacatttgagcaataggtgcaaaaaggaaccacatagcgataagaacccatgctttgatacccagagaaaatagcaccatcaacaagatatctggagaagcaaaatgcacaccacattaatcaacgctatcatgtaatcagaaaatagaggtgcataatctaaagctaaattaccaggtaatctcaatttgtctcgaagaaatataaaaaattttctcttccaccaggtggttgtttctggtattttgaacttctacaggatgggagagataattcttatgaggaaaacataaacatcctcaaaatataaaagctatatgacatactatgatagaaatataccagctcttcctcttcatcatcgtcatcgtcaccatcaccgtcacggagatgattagcaggtggcttaggtgccacggccactataagactatctaaagaaattgcagaaggaaggaagtatttaactgtattccacaagatgtatcaagtgcagaagaagaagaaaaaaagtagggtcttgaagagacaacgaattaaccatccatcctagaatagtcctgtcttccacataagatgtatgtgaagagaaagaaaaagaatactagtatactatacccccgtggcggaggttgacatgggcgtcgtcttggcacgggagattccttcctcgcaggaccaggcggaggcggtcttgtgggagatgtcggtcgtgagcgatgtggcggcgcagatcggcaacctaggggcggggaggggccggggagcagtaaggaggaaggatttctgaattaggggtgggtcgggtggtttgttaccgagataaacggagggaggcgaagggtggtgggacgggacgggccgacggcgcgcagcgtcacctcgaccatctccgcctcgtcgccggcggcagccatggccatgcctgactctgatctgtccccgtctgtctactcccctctcccttccggttccggccgatctcctctctctctcttatatatattatagtaactcgttttaactttttcttaattattttttttcaaatttataaaaaatatataataatatttttaatacaaaatagacacattatcattatcatatttaatgaaactaatttgacattatagatgctaaaattttctttataaacgggtcaaaataaaaaaagtttagctatgaaaaaaaaatctaaac

SEQ ID NO: 9691 - DNA, 1501 bp, Oryza sativa
cgctgagaacggcggtgagggttacggaatctggctgtatgttgtggtccttcatgtgtgtgaacaaatggagtgcatcggtggagaagccgttgagggcgaggccagcgatcatgacggtccaggtgtggacgtccttgtggcgagtgggagtggagtggaagagggagcatgcggtttggacgtcgccgcacctcatgtacatgttgaggagcgcggtggcaagatttgttgtgatggggaagctgcaggtggttgcgaggtaggcgtgcgcccagcgggcggtgtggagcgccccgaggtgggcgcatgcggataggagggcgagcagggtgacgtggtcggcagtgcgcatcgtgcggaagaggcggagcacctggacgtagtgggcgcgggaaaggtaggcgtgaaggagcgagttccaaagggggaggtccctgtggtataggggggctgaggtcgaacacctggcgtgcagcgggcaagtcccccgcggcggcgtacaaggagaggagggatgccctgatgaacggtcgggagactcgaggccgcggcggaagagggaggcgtggagggcaacccccgcagcagctgcagctgcagctgaggaggaatcggaatcggcaaggcgcgcccagccggcaagaagtggtgggtaggtgtagttgttggggtggaagcgggagtgggagagcatgaagcggtagagcaaaatggcaaggtgggggcggggcccgcgggcgagggcgcgaatggcggagttgtaggaaaaagtggtggggtgggcgcggaggatggagagtgcgtaggggagggaggcgagggaggcggcggcagcgagggggcccgccgcggaggggtcggcgaagagggcgccggaacggaggaggtgggcgtggagggcctttggacacgtggcggtggcgggcatggtaatggtggtcgtcttcctcttcctcttcctcctcgccggcggccggaccggagcgcggctgtcactgtcactctcaggccctgtttggctaattgatatggaaatgatttccacccactaaaagacatctttaaatcttaaccatttattctccctcttttatttaatcctaacccttcattcatttcctaatcttaatcccacccctcatttcccgttatccaacattatccaaacacactctcaggggaagagacgagaagagcggctctctctctctcgtgggcctctcggcccaagatctcaagggacagacggagaaagagggagctgggcaagtgggccccggagggcagtgaccagaccacaggcggcgtggaattcaaaggtgagtcgtctcgtcgtaagccatgcgcgtggtttctttcttcttccttaaacctgaatcaatctttctttctttctttctttcttgtctactagtcttctactggagtaggttctacgagacacaaattagacaggagagatcgagtttgaaggcaggaaggcaggcgatggcgagca

SEQ ID NO: 9692 - DNA, 1501 bp, Oryza sativa
tagccgcagtagtcttgagccgccaatttggaactctcttgtggtactagtataaattaattatatcgtgtggaaattattaagatgagactgcagcaggccaacaacctgcagaattcttcttcttcctccaattcttcttagcctgggtttatttcacgctttcaattttagttgaaattgaaacgatgtgacgaaaaagttagaagtttatatgagtagaaaagtttgatgtgatagaaaaagttaaaagtttgaaaaaaaaattaggatctaaacacggtgttacgcttttacgcgtacaacgaccggccacctgcagtacatgctgaccatgtaatatactataatttgcaattaagcaggcaagcaggtgtaaataagcttaattactatttgaaaattatattattacttaattgaaaagaaaacaggtgctagtttaattaccagctcctcctcttgacgacagcagcaaaggtgtggccgaggcggcgaggcacatagataggggcgggcaagcttggcttggatcgatcttgagtggatagatcaactggaagggcgtagcggcaacggcgttgggcgggacctaagatctgacatgtgtacgtggcgaagggcaaaagtacacggcattggaatggatgacatattatcaaatttctcgcaaatgatcgagcaacctaagagacaaagtcaatcgaattgaaatggtccgcgtatagtggaagtgggattgcactatactcgtattaggtagatgcacggacggacgtaatacaaacgctagttgacagttccaattaatcgttcatgcgacccaattgatttagttctaaactttcgctccatactacaaccttctcatttttctattatcacgttttcttaaccgctaaacggtggattttatataaaagaaaaagaaatactccatcattttacgttataagatatttttgactttggtcaaagtcaaattgtttcaattttaaccaagtttatagaaaaaaatagtaatattttcgacccaaaataaatttattataaaaatacatttaattattaatttaataaaattaatttggtaatataaatattattataattgtttataaacttagctaaatttaaaatagtttgactttgaccaaagtcaaaacatcttataacctgaaatagagggagtatatttatagatttttttaaaaaaataaatctattttctaaatatataataattcatacttacttaatcaagcatgcgtatatatttagaaatggtctgatggattgagtgagtcgtacttaaggactagagctatgagcagtgtgaacggatagacgtgccatcacaaataatataatgtatttatttttttatgaagaaaaagaaggagcaaaaatgaaaaataagaaaaaaagacaataataattagtaggagtacctaccaaccgtggactagtattacctgctgaccaaccgaccttgcaaagg

SEQ ID NO: 9693 - DNA, 988 bp, Oryza sativa
caaatataatttagaaatagttgaaattcgtaattaaaaaataagaaatattggaagagaagactagagtccatatagaaatacaattgagaacaatagaaattcggaattaaaaataaggaatattacaagtagagtatagagtccatatagaaatacaattaagaaataatagaaattcggaattaaaataaggaatattagaagtagagtatatagtccatatagaaatacaattaagaaataatagacattcggaattaaaaataaggaatattagaagtagagtatagagtccatataagaatttaaaactaactaaaattcagaataaacataataaaattaaaattagagtttagagttcatataaaaatataatttataaataactaaaattcaaaattaaaaaaacatgggaagaggagtctaaagtcaatataagaatacaatttagaagtaacttaaattcgaaattaaaaattaaagaatattgaaagatgagtttagagtccacatagaaatacaattagaaataataaaaattcagaattaaaaataaataatattgaaagaagagcctaaagtccatataggaatataatttacaaataactaaaatttaatattaaaaataattaataactaacatgtatataaaaaacaatatgaatattatacatgaatattatacattagtagttttgtaaaggtagtacaaaatttaaaataatgttttcattttaatatatttgaataatacattgagaaaacatatatgtaattatatgacagaaaatataataatgctagccgcgcaatctgcgtgggccactacgctagttaatataatatatgttaatttccacagtaattatatagtgctagtatattgtccagaacagaacatgaaattaatgtgcatatatatgaagagttggttttaccaaatcgatctggcctaataaaacaggggtgtacggtgcaa

SEQ ID NO: 9694 - DNA, 266 bp, Oryza sativa
aatcaatcaatctcgataaattaataaccgatcctgcttatatatatatagcagctatatatatatcgaatagttgaagcgatcgatcggctgggaatggaacgacggcccaattaatcaggtgatccatacattaatttgcattgcatgttatatatgactctattgttagttagttaagttgcttgcgttgttgaccaatcgaaagtactcctaatgaacttcccctacaattaattaaataataataatgcatgagagataat

SEQ ID NO: 9695 - DNA, 1501 bp, Oryza sativa
ttgtatctgtcacgatcccacatgaatctcactggtgaacacaagcacaggagcaatatatcctctccaactctgtatatcaagttcagggatacaaattggaagaactagcagcagagattgggaagagaagcagggggtaaagggaatcagagaaacacagagtaggggattagaggagaaatcaagaggaggaagaagaggccacagccatcaggttctaattcatcaatgccttctctcactgccacggttggtatttatacttcttggttgcttgcaccttcagtatgtgagctaggccaagcccatttctccagcagcccatgcagcccaccagatacatgacagtatcattgtcggttcacaacatgaatcgtggtaattcagtaaataaattggaatgtatgaaacaaggagaagttagcttgcagtaagtccctcggccccttcgacccttgcattccttcccctcccacgatccatcctccctccccttccccacaaccaccgcaatcattgccgccgcatcaccaagcgaggaggtcatcagttgcatcggatctgcgaccttctcaacctgctagctgtttggatcgggctggctagagtgaggttgctagccatctcttgtttaagggatttgtcttctcgtagaagttgtaagtgttacttctttgatgtatgtgcatatctttgaggtatcccgtatttagtataacggcaaattcaactctagatttaaacagagattaattaaacaaatgcatgttccttttttttagggggggagaacggatctgacttgtgagagagtatatatataatgtgaaggaaacgatcgatgcgtgcgtgtactaattatgaagaggcttacatgagaattatactcactctatcctaaaatataagcatttttagctattaatctggacaactgtgtgtctaaatttatagtcaaaagttattatattttaggacgaatttccaaaatataagtatttttagctataaatctggacaactatgtgtctaaattttagccaaaagttactatattttaggacggacgtagtaggtagcagcagtctcaaacatgtcttctgagtaggcacctagctgtatggcaatggtaggctacatatgacaataaaggtgtacgtatgtacgtagatacgtgtagacctcaccgcatatgcaccggccctgacctggctctagtgctgtacccatatataccacgtaggcagccagcaaataaagcaaaacaggccaagaaaaaatacgcattattttgtattgaaaacaggaggaggaggaccccggctggtttgcgtattgttaaagaaaaaaacatgcatgaatccaggctgaccggccaatatatacatgcacacacaaattaaaggaggagacccttttccctttattaagaaaactttaattaattaagtagtagctagcagtttctgtagctttcctctctggatcgatcatatat

SEQ ID NO: 9696 - DNA, 1501 bp, Oryza sativa
gatatattatcccatgatttgctacagtgatgctacagtaatcagccgctaattatggattaatatacatcattagattcgtctcgcaaaatagcctaagggttatgaaatcggttttgtcggtaatctacgtttaataatcctaaatagcaagattccggagggctatttaatagcccggaggatccaaacaagacctaaatgtctaggggcttgtatgtacttttttccaaataattggctcgatcatcccgtcgtcacatatgctttcaatagttgtatatagttttgtatttgcgcaactttaacctccctccatactaaatgtctaggggctcgtctgtacttttttccaaataattgaaatgtaaacataggagtagggtgtatttataaataaaaatatattaaatgtttgagggtttattggcaatattatttattagccggcacaaactgggtttcgtgcaaacatcgtcaaaagtcaacgacattatctataaaaaaacagcaaccgagaaagtgttatttgtgcgcctacatttaaataaaattacattatgcattattgtgaatataatataacttgctgagatttattcttatataaagtggctcaaagtatagccagacgatttaaagttctttcactattccactaagtaccgatctaacctttttcttgccatttgtctctctgtattgggcctggtattccatagcccaaaggctcacatgtggagacccacttagtggagcaacctaagcagcgactcgatcaagttggtcgatctctctccctcttcgcttgatccctttctctctccagtcttatcgcgtaacaccatccttccggtcctcagccgcctctttgatactccctccatccctaaatatttgacgccgttgacttttttaaacatgtgtgaccgttcgtcttattcaaaaaatttaagtaagtattaattctttctctatcatttgattcattgttaaatatacttttatgtatacatatagttttacatatttcacaaaagtttttgaataagacgaatggtcaaatatgtttaaaaaagtcaacggcgtatatcggttaaatatgaggaccgcctccgatattgttaaatattgttaaatatgagggagtatatcggttagattggtccacctccgaggaccgctaccatcaccacctaccggaatcaacacgtcaagttccctcgaattcggcctctctccgatatccgtcgctctcggcggcggcaggatcttgggccaatgtatctctgaagcatctaggccccctgtaggatcaaggaggccgactagaggggggtgaataggcggttttaaaacttaatggcacttaaacaaaactaacctaagttgctaggcaaggtgaggtgaaaggttaactaagcaactaagttaagttttgcaaacctaggtgatatgggctcaaatatgtctctatgaatgtaaattgcacaaatataaa

SEQ ID NO: 9697 - DNA, 1501 bp, Oryza sativa
caaatattaaatttgttttacttaatttaatttaaattaactaagttttctaatctttttcatataattttctatctttttctttctcatctcttttatcacaagttttttttccaaattctaaataatcaaatttgattataaaataataccacaaattattcatgttttcattccccgtcattttaaagttgtaaacaaatatttaatttgttttacttaatttaatttaaattaactaagttttctaatctttttcatataattttctatctttttctttctcatctcttttatcacaagttttttttcccaaatgctacctaaacaaaatttctatattatttcatccctacacaaactttctctctcatcatctcccattcccaaatttccagaggcagaaaagtagaggaggatggagttgctaacctttagactccttcaaattgtatattttcaccaaaacaaaatcaccaaaaattttggcagcacctccccttaaactcaacaaatttatgaagccttctcgggctagctggaggaagaagaagactttatatggatggacttttagtcccagtttgtgttgcctgacacaccctaacaaccagcgaaccgggactaaagacgggactaaatctttagtaccaaccgggactaaagatcaaatcttcccgttgaacttataaactgggactaaaaattgtttttagtcccggttttttgatgaaccgggacaattgtggtttttcccctacccgataaagatcacttctccagcagtgatttatgcctaacacagaacggcagaaaaaatttacgccctctaatatgggagggggggagtagtatagtaggctagtagctgtaattaagctccaacagtgtgtgcaagtgcaagccttgtcaaagtcatagccattagctagctttcactagtcaagatgtatattcatatataacacgtgaatcccatacgtacacaactagtgcataggctcctgcttcatatatgtacgtgtatattggttcatcagaacatatatttatctttggcaggacgatggccctatgtgataaagcacatagcaagctgataacagcccatcccctacttgcctccgttttcgcaattgtttttgttcctttaagagatttacacgtgttgggctgttttgcagaaagctcctcatttttgtacgatatatcgcataggtctttaaaccgactaacatcccggttgtttttttttatctggaaaagctctcgtgttttagagaaatacaatgcgaagtagtgacaatctcggttttagggaatagcgctgtaaacatgggaaatagagaagtgttcttcaaaaatacgtgcctttgtcactaacagatagatctacctgtcggtgacaaagatatggtgtctttgaagacagaggatctaaatcccttccatccacgggccgctgctccctgttcccctcttccatcccattcatttcagg

SEQ ID NO: 9698 - DNA, 1501 bp, Oryza sativa
gagagagagaaagggcttttcttccaacaacaagatactagatgccgtgcttcaatgggcttccttcctctaaaacgtggccccaaggcggtggagagagacaccctttccctgccacgtgttggactttctgggccaggccagcaccaccccttgaaagcactatataacttaactttattaaaaaaaattgatccgacagggtttggctaatggatagggaaatgattttccacccaccaaaacacatctttaaagtttaaaccgtaactattcgttttcctcgtccagttaatcttaaccttttatttatttcctaatcacgatcacaccccccattttctattatctaaacacaccctatgtgaaaagtaaaacccccaaacgtcaattgattgagagcaactaagtccaaatcatctaaaccaatttaatagctaattcatacaatagttatctacaaacatatactacactattaatatctggtctcacgtgtcatacacacattgcgctttggagtccgtgttgcagctggctacaaatatgtagcctactgctcttcttttccctcctttatcttctcaatatttgtttatagctagcttatagtatgctattgtacatgctttgatccactaaaacaagtaagtaccatctatgtaggaggggatagctcgatcgaattggtaaaaacaacaaaacacaatgttcttgaactttctatcaccttattcaatgtggtagaggtagagcgcaataaaaagaaaaaaaagaaataacactgcaaagtacaaacactacattggcatcgtccattgaccttgcctcggttggtttcgccagcaattcaccaatcaccacccgtccctgctgcgcctccctgcttccgtctcctgcctcttagttgctggcgtctggtacacgcgatagtgacgcctaccatttgggtggggggagggggtggtaaaagacgatattgggaagatggaggacacaaccgtcgtagtagttcctagcttcaactcccccctccctttttaggcataagccagtctagctgattgctttgggtaacaaaaactctttttctgctaatatattgacgtgcaatttttttgcgtgttcgaaaaaaaaaaggaagatggaggacaccatcgaccctgaattccacggacttctggatctgagcgtcactgttgcttgatctttcttggtcgtcagcaagcaaaggccacccctcatgagtcatccccttctcattgtgcgagattgtaggatcgagatatcgattagaggggggtgaatagacgatttaaaattaaatgacacctaatcaaaactaacctaaattgttaggcttggtgaggaacaagtctaactaagcaactaagttaagttttgcaatcctagggtgaaagtggctcaagtctatcactaggaaagtaaatcacactttctaagtctagtttagcaatcctaaggtgatatgatctctagt

SEQ ID NO: 9699 - DNA, 1501 bp, Oryza sativa
tagtgatagacttgagccactttcaccctaggattgcaaaacttaacttagttgcttagttagacttgttcctcaccaagcctaacaatttaggttagttttgattaggtgtcatttaattttaaatcgtctattcacccccctctaatcgatatctcgatcctacaatctcgcacaatgagaaggggatgactcatgaggggtggcctttgcttgctgacgaccaagaaagatcaagcaacagtgacgctcagatccagaagtccgtggaattcagggtcgatggtgtcctccatcttccttttttttttcgaacacgcaaaaaaattgcacgtcaatatattagcagaaaaagagtttttgttacccaaagcaatcagctagactggcttatgcctaaaaagggaggggggagttgaagctaggaactactacgacggttgtgtcctccatcttcccaatatcgtcttttaccaccccctccccccacccaaatggtaggcgtcactatcgcgtgtaccagacgccagcaactaagaggcaggagacggaagcagggaggcgcagcagggacgggtggtgattggtgaattgctggcgaaaccaaccgaggcaaggtcaatggacgatgccaatgtagtgtttgtactttgcagtgttatttcttttttttctttttattgcgctctacctctaccacattgaataaggtgatagaaagttcaagaacattgtgttttgttgtttttaccaattcgatcgagctatcccctcctacatagatggtacttacttgttttagtggatcaaagcatgtacaatagcatactataagctagctataaacaaatattgagaagataaaggagggaaaagaagagcagtaggctacatatttgtagccagctgcaacacggactccaaagcgcaatgtgtgtatgacacgtgagaccagatattaatagtgtagtatatgtttgtagataactattgtatgaattagctattaaattggtttagatgatttggacttagttgctctcaatcaattgacgtttgggggttttacttttcacatagggtgtgtttagataatagaaaatggggggtgtgatcgtgattaggaaataaataaaaggttaagattaactggacgaggaaaacgaatagttacggtttaaactttaaagatgtgttttggtgggtggaaaatcatttccctatccattagccaaaccctgtcggatcaattttttttaataaagttaagttatatagtgctttcaaggggtggtgctggcctggcccagaaagtccaacacgtggcagggaaagggtgtctctctccaccgccttggggccacgttttagaggaaggaagcccattgaagcacggcatctagtatcttgttgttggaagaaaagccctttctctctctctcattcttgtgtttcttctcgatcgatctctcgatttctctctgtgcaccagcatcagcta

SEQ ID NO: 9700 - DNA, 1501 bp, Oryza sativa
taaagggggggggggtgaatagacgttcctaaaaattattacaacttcatagcatattggaatgatgagaacttttgattcaaaacggaacttccggtatgggattcgaagttccggtctcaaccgaaaagttaggcggataacggaataaaacactagctataaacttgtacctcaaacaaagaaaatgtatatgaattaaaaggtgacaaataaggtatctaaggaagatataaagttaccaactaaatcaattaagcatgcaagtagatcgggtaaaaacaacctcaagcataatgtgagagaatgcaagaatgggcaaatcaagagaggagacgcgtgatttgtttcccaaagtttggatccacggatcctacgtctctgttgaggagccacaagggccgggcctatttcaaccctttcctcacgaggttgcacaaatgcattcctcggtttcactcttgatttctttccttgcagaggcgaaatcgaagccttcacagactttctgtggcacaccacaaccttgggtgctcaccggcaacgcctagccgtctaggagaccttagtccccaagagtaacaaacacaatcgaagatttgcctgctatgaacttgagtgctcaaagtatggagtgaaactcactagctctcaacttctcaatctctcaatccaactctctccccttctcaaatccctttcacaaagaggcaacacaaaggtaggaaaatggggatggttatttggttttgaatgtgtctaatactccccaagaacagcaggcacttaaaggaggggtggaggagtttatatacccgagcctcacaaaaactagccgttggagaccaagactgtaattttcggaacttccgaaaatttacagaagcaaatatcacgcaaccattttcggaacttccgataatttttttggaacttccaataagcacagagtaaaatgaccataagtttttgctcgggagtccttttttatgatcttggactatgtggaaagctcacttagaggactatccaactcaaccaaaaacaaggcctaaaatcactcaaatgataggttaaagtttgggtttctctcaaggtagcactatgataggtcattttgagcaccgagacatacacaaacacatcgacattgcatctgtcttgatagtacgccattcctatactcaaatttatatagtaagagaattatactaataggataggaataccttctttccatcttcctttcattgtcttaagggacgccaacgccaaaaccattcaccatatattcttcaaacgattgatgtggttacttgtagcttcaaatggtctcacacggtccattatgacaaagccgccactcgtccttcaccactagatttggttcttcggcgccaagccccttgcttgccctttacccccgcatggtccattacgaccgagcatcacttgcctttcaccgtctttcatagtagacacttcgtatctatcgacgagt

SEQ ID NO: 9701 - DNA, 444 bp, Oryza sativa
gggggggggttgggctgggttgataaacacatttacggcccaccacggcccttttgaccctacaattattactcccaaatgattacacattgcagctcccaaatgattagataagaggtgtatacgcgctagtacaggatgcaagcggggatttcacatttgttactcaaaggatattattacatttcttcagttcaagcaggaaaacccaatgtgtaaaaaaaaacctgaaccattaggtttaaatccaagtgtctttcttttcaccaacactgaactcaatcctcaacatgcagtaaacaggcataggaggaccaagggattgatgatgcagctgaagttagcataaacaacgtaattacagttcagttcatcatgcatatgatgcatccatcattattgttatctccagatacagatcgatctctctatatatacacatca

SEQ ID NO: 9702 - DNA, 1501 bp, Oryza sativa
atgtttcggtgagatggaacatagttgcaacacaatttaagttttacctatatggccttttttttctcatgccatggaataattattgttggaacccatagttattgccatgtatatatattgtacacaacaaatattgtgaatggaacatttacctaaacacaagtgaaagaacaaaggtgaataagggaattatgtttgtaaagatgacggagtaggatggtgtggtatccttgaggccatagtagtagaggctcattggtacggcatatctgcataatttggcatacagtaaagaaaagcttaatgtaatatgcctcggatgattagtaatatttgttcatcaagaaattgattactaattaggttttcaccgaattgatactgccatcagcaattaatatcttattggaggctaagtttctttatcacggtagccatgagcaagcaagttgtatgattgtatacttgcatcttaccttcaaaccaatatgcatcactcactatacatcttattatatgcaaaggtttgagaagggcaataaccgtatgtggtttacatacaactataccaattagagatggaagtttactcaataggttgttatgtctgtctttaggctgatgttccagttagttctcttttctttcatcaaattgtgtttttaatttgcagtcattttactacaaactttgtattaattgatttataactttttttcagcaaagtttggaactattttttcattatgcaaaaaaaaaaatactaacttacagttatatagtagttggacttatcacgagttcattgtttctggtcaagcatttgaccgaactttgtgcagcagatccttctagcgtatagttcatgaccgacttatcagctcatttttgttgttcaaggacatatataactggagtttgccactttgctcaacagatccttttaacaaattaattgctttagtacatatatacattaacttaacttgttatgctttctattatatggcactaaatgtactctagttcgacgatttgtcatcggctgtctccctctggaatatactactgactttatcattttttcctacaatataccattgagatggatacttttcaaaaaatacataaaatgcccttcaagtcataccagagttggcaattgattgacccacgagatgtttcaaataaaatatgaaagtattttttttacattgcattcttataaaatgtagatgtttgtttgtatatttcaagggtttttttcatggtttttttaaaaaaactatttttgtgtagcatataaaagaggaatcacatacatgaaagatagccgcataaaaaaaataactatatagcacatgaatgatgatttacatgaaagagcattaacataagagtatcctataggatatataacataaattatattttcataaaaagttaatgcatgcaaaatgaaattcttcaaatatacacacttctatattatataagg

SEQ ID NO: 9703 - DNA, 325 bp, Oryza sativa
cgggcgtgccgtcgatggaagcgccgagcggaaggggaagaagagaaggggcaaaactgtcattttacgcggtttctctctcatcaattcagtggatattatattttaatgtgcccagtgtcctgtggcaaattaccacacttttagagtgtcctcaggcaaattcacgcctttcgggtgtcccccagccaattacacaatttctaggtgtcccagggcaaattttgccaatatattttgatatattttgatagaagcatctactctatattggatagaaatgatatggtttttgataagactccaaataaatcttatgtacagg

SEQ ID NO: 9704 - DNA, 850 bp, Oryza sativa
cccatatgaacccctctagctctctttggttatatcctgcataataccttctcttccagtatgacttgttgagtatagtgggtagtactcagtcttgcccggtctctcaaccccagagttcgagtatgcgtcagatggtggtactcggaggagtaggcttcgtccgtcgtggaggacatatctagagggtgccagcgtagaggatggaatagtcaccaacattgcaagcagggaggcacgggatacgctattccacaggttccacctctccaccttagctcctttgtcgccgtggtttttctcccgagcagtgaagcccacgccattccctgctaagatgaggtctctctcttatgggagaaataaccaattctcccatcactacttttgtaacatagatagcgcactataggtgccaaaacaactaaaactagaacctttaatttattataggtgccagtttttttaaaaaaacctgatacatgtaaaaatcgagccgagccgactgcatcatccttatccactcgcaacgacgtcgcccgtgcggataagcacgacatgcgcgagcccacctctctcgctctcgtgagcccctctttctctctggcgactctcttccctctctctctttgcccctctcctcccccacccgcgagggccgacggcggcagcccttctcacccgcgagcgtcggcggcgggctctctctcacggctctccctcgcgagcggctgctgttagatccaggccggatccaggcaatggtgacggcggcacgacagcacgacgacgggctccccaaccgaaggcgacgggggcggggcgccctctcctctgctagatctagcgg

SEQ ID NO: 9705 - DNA, 1217 bp, Oryza sativa
accgggactaaagatcccgggggggcctgacaggtcctgacagcattcgaaccgggactaaagatgatgtttagtcccggttggtaacacaaactgggactaaagatcaaatatacccgtttcccttttgaaccgggactaaagatcatctttagccccggtttttattgcatccgggactattgtggaaatcggccgaccgacgaaagatggtttctccaccagtgatcctatgaacgcacacacgcagaccttatccctatgagcacctccatataattgggccggcatatcttgagattgacgaagtcaccacatacacctcgttgtcaaatctaggattagaatccgggtgggctgtttccaccacaagaaactagttgagctacgctcactttgcaatatactacctctatttctaaagggatgctgctgttgatttttaaaacaatgtttaaacaagtttaatataaatatggtaaaatataagctaggcttaaatttttttaattaataatataacaagtcatgacaaaataaatgatatttatattattatttttaaataaaacaaacgctcaaatgtcgtgataaaagtcaacaacggtgttatcctgcacaaggaatataaagggcagaatagtcatttcagttctggacgctcccaggcgaaacctcactagtcggtatagatgttgatgtctccccgacacacctccatcgccatttgcattcacaatcattaggatattcaaacccccagcagcaaatcttcatcacttaattacgtactctaccactacccagctagctagttcactccaaatctcacaaacctaaccctattatccacggggaagtatccggtgcaatcacctaattcaatgtaataatacaactctcatcctataccattatccacatcattataagttaaaatttaactcgtagattcactcataagttaaaatttactgggagcgtccatttctcgatccaacggtgtaggatgagagttacatagttgcaccgaattaggtgattgcacggatacttcattcacaagctttccaccccctgtgggccccacctcctcaagaaatcaaaccccctataaatagccctcactctcgcctagcttagctcatccttccatgcaccacacctgctcgaccacatcgacgcatcgatcatctcccaagaactaaccgatcgga

SEQ ID NO: 9706 - DNA, 1501 bp, Oryza sativa
gatttacaatatgtttgatcatatattgtaattttgcaactaatatttatgatgtttgattgtgcattataattctacaactacgtacattatgcataccaatatcacatacaagatgtcatcgatcaaccagtagatcaaatatagtaattacggatagatgggtgataatttggactgtatgaatcatacaaaacaataataatcattttgttgtatatcgccaatataatattgccattgctcgtgggttgccttggccgttcataagcaaattaaaccagagcttgaactggattttctttttcttattgtgaaatcaacactttttagaagtggagatgaagctgatggaggaacaaggctagccaaccaacgtgtggaagctattgatctagttgatatatgcgtttagaagctgaaccacaagcattgtaaacattagttattatcgacattggcctcgtgacctctatcttgccatcgattgagtgcaattctgtattgttggaattaatagatgggctaaggcccattcgaagattaattctttggaaaatcacaaaagcccacctcatgggatggcatgcatgtggagtttagtaccaccttgcttattctaggagagggggacctccttaaaagggagtataccctcctagccacttgaagtatgtgtggtggagagaagagggggaacacgcgctcgctcgcctcgcctggcaaggcaggcggcgcgtgcacggcatacgcgtcgaatggttcggaaaattggctcctcacccttacgcagatgcagtctccttttgcagttttgttttgctgcaggaaaattcggatttgttttgttgttggaaacattccgaaaaatccggtgcatgaaaacggctggagtccggataagttacgcgcgtcttatccggctcggttacgtagagtggagatcgtgcgggcgccctgatcaagcgatccatctctatataaaccgtgccgccgtcttcacgcaacacacgcgaaatccatctagggttttcctcctcctctgtgttgcgccgtcgctcgtagactactccatcccgcttgccagcgtgcaccggtgaaagggagagcaggtctccggaacctatgccttcgatgtcctgcaccgggagaaggcggcaataaggcttttgggaagcgcttcgcgcgactgctccctattcgttcgcgacggctcgccttcctctccgctcgcgtgctgcgcgccttcgtcgacgcttgcaaccgcgagtagttcctgccgagcaaccggtctttccgccacctcggtacatgttcgacatgttgcgcatatttgatctgttcatgttttactgcttagtttacatgtgtagatataatgatgcgttaatgctagtatacatctgtaatgtcatgatttatttatggaatatattaaatcattatatgcctatattctcaacaatccaaaaaccttattataggcgctgtgattttacta

SEQ ID NO: 9707 - DNA, 1501 bp, Oryza sativa
gcggtgtggcggcatcggggcggcggttggcgcggcggcgtggcgacggcggcggcggcgtggcgttgtggggccgtggcggcggcggcgtggcgtggcggcggtggcgtggcgtggcgtgggcgcggcgtggcggcggcggcattgcgcgcgcggcggcgaaggcggcggcggcgtggcgacggcggcggcggcatggcgttggcatgcggcggcggcgttgcgcggcgtagaaggcggcggcgtggcgcatcgtcgtcgtggcgcggcctctcgtggcgggcggcgcgacggagagagatcgagattggagagatcgagatgcatgaagggagatctggcggcggcggctctcaccccagagatgcggcggcagcggaggagacggaggcggcggcgaggacgacgagctcgagacgacggagagatacggcggccgtcggcgcggggatttgccctaggcagtggcggcgaaggagagaggccgagagagatcgatcggccgaaaacgtttaagtgttggtgaagaagacgagggcgcaccgggaatatatatacccctggatctttacttccggttgttctcaacaaccgggactaaagatatctttagtttcggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagtgtaggaattatattaaattaaatgctaaaaactctaattaacatatgtaaatgccacatgcatgattttaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaatatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaatatatgccata

SEQ ID NO: 9708 - DNA, 1501 bp, Oryza sativa
aatgatcatacgtcgtcgtcgatgctgaaaggaaattccaatccctatccgctcgtacgtgcaaatctcttcctttaatttccaacgtggcagccacttctatccatgtaccgaaagtgacatgccaccattagcttttagcattaaattacgcatcaggtcggccgcctgactcacaagattaatttctcattaggtaaatatatttacgagagtttgtccaatcaccttatggtttgactcacaagattaatttctcattacgtaaatatatttacgagagtttgtccaatcaccttatggtttttttctattcgttggatcggaattgctaaccttccgtccatagaaattgcatcctcaaatcttacagattttgggccatcggatgagcttcaagattcgtactccaagtcttttcctccaactccgatgacctctcttcttctccggcgtcgacgacatcctagactccggcagaggacctacagattaaggtcccggggtggggtgtgagagggaaggggaggagttcgccggctctagagggatggccgggggaggcgacagcccggcggtgggcggcgaggcgccggagcagcgaagctggaggagggcggtgggccggcgttggtggtgggggcatctcgccgccgatggctcgaggaggaaggagtggggaggagaaggaggctggccggggggaaggggggtttcgccggcgccgttgacaccctccggcaaggcgggcgacgatgcggtggggcggtggcggcgggggatcaggcggaggaatgcatgatgggagtggtggcggcggaatgcgcgatgcgaggggaacaagaggaggagagctaggattaatgcctctgcacgaatcttaaagcatatccgatgatccaaaaattaactgatatataaacattcccatccaaatatccaaatatatatgatcatatcctatatattgttttcttatgatctgataagaattctaaagcaattagaaattcgactctcggtaccagttagcatgcgagttttttttgaaagaatttcttatacgactccttatgtatttctaaaagcaaaaaaaacttatgtttatgaatattatgccgtatttgtctcggatagaaaacatcttgtatccgactcaggtaccgacccacatagagaaccataaacgttttccgtccgaatttcttggtgaaacatgtttttctttcccaatttctagctgaaacatgttctatccgaattcgaatcctacacaaataaacggcggcatttgaatcgggggcgaagcgatttccccgcacggcaggcaaccaaaccccctcccctttgaaaaaaccgcgtgcgccgtcccgtgtcgaggtaaagaaaagagaaaaaaaacccgcaacttgcagaaaaagaaaaaaaaaaaggcaaaatccccgacaattttacacaaaacccctcccctcccgccgtttattttgtaaaattctctctc

SEQ ID NO: 9709 - DNA, 301 bp, Oryza sativa
attctctacattttatagatcgtgaccggtagatgaaaagtttcaaggaaccctataatacatataaatacattgctgaatatgatagtgcaaatcaacaccacgagtttctattttcttactgacataactactgcttagcatgttgttcttcaacttttcagggtgctgaaacattctcatcatttacccttttttttaggaaatattatataaataatctcagctggctgaccaaagcttgaaatttactttcgaattgctttcaactacaaaacataaaaacaaactgaaatcacca

SEQ ID NO: 9710 - DNA, 1501 bp, Oryza sativa
cggcgtccgggcagcggtggaagggtacgacggcggcgtctgggcggcggcggaaggggacgacggcggcgtgcgccacgcgaggaggagtgaggaggcgaggaggaggagagggggagcgaagcaaggggacgacggcggagcggcgccacgcagggaggagcgaggaggcgaggaggaccgaggcggagtggaggtagcagcgacgacgcttgggagagagcgtcggatatgaggatttgtcgttgtggcgatgatgcgcgacggattgaatgcggcggaggcgaggtgcgcggcagagatggcgcatgcggagtaatcgcgcgtggacggtggagaggataaggtcgctataatcgttggaatcggtggagcgaggaggatagcgaaacgaattagatgagatgagatggtagatggacggatgagatgggaggaggtgatttcacctgtaggattgctagacacaacttatactttttatattagtatagatagaccagagactgacagatgtgctctctatgccctccacctgctgctggcccaaatatccaacagcgagagaacaaaatctacattaattttattacggcaaggagaaattctctttgattacatcgatttggtggactcatgtagagttaaaagtactctagtaatttggttgggagtaacgttaatctggttaatttcgattaagagcaaccaaaatactgtattttctctctgtaaaaaaactccaaaaatacattttttttaatttgagaaacaacattacaaacgtagatactcacaatacacatacacccatataaacgcacatatacacccaacctttattagcacctcgaaaagactgaacttgtatatcttgagagtgataaagttatctctagcacctcgttgttaataagtacgtcgcctagaattgaaaaaaataattagccgtaaatacgagtactcaaaatatattgtactccatgttctatctattatatgcaatacaactattttcagttatgttatcctaaattcgattgccccaatgtgcaaaactctccataggataaacacatcactctaatcctccattacctatgataaacacattcattccgtgtgaaccacgtctcatttagccacacattcaccaaggcaaatttggagcactcaaattccaattttgtattcatattcccattcaacaaacccccacagcataatttaaaatgtaggcgtctgtgttctgcaggaaacgtacgtcctatgcacaataatttatttatacgcgtatatacttcacggctacgcagactgccgtttacacagaaacacaacatcgtacacgcaccgtatgtgcttacataagttcgtaccactgactatatataccaatgcatcctagttccaattcaccaaaccaaaagcagagttcacagaagcagcagcagagcagcaaccaacagcagctggatcacaggtcacaaagcctgatcga

SEQ ID NO: 9711 - DNA, 1501 bp, Oryza sativa
actataataagaggataatataaataccattgatcgagaccacgataacttgagatttctgacgctggctagggcaccaagtgacaagcatagatcgttgtcaaagttaatcggctcgtaggacttctcacggatcgatgcttcgatcaaggaatccattggatcgaccaagcgtactctaagttcataataaactgtaattctcaggagaagggaggtgagccttggcgtcttgatagccaatgtagtacactccaggaggcaacttctgcatccatggatggccaaactcttcagcgtggcagattcgatcttgttgaattcgcatgagcaagatttgagctccatggcttccaagattgggcaggatgaacagatgcactcatcgaagcaaccgtccaaaactaggccagagagatgcaatctttttagtcgggaagtagacacagatggtagccagggcagcctgaacaacggcacgccgacgccgacggcgatctcggcggcggcgggtcggtgccggaatccgccgaggatgcaacactcgatcagccgagagcccttccatgcgcgtatgtatggtgcggtccaagagtgggcgagatgaagacgaaacctctcaagaaacggggggttgaagtcgatcacgtgcacgtcgccgaactcgagtagattgttggcgaagtccatcagcttctcccacctgaccttggccatgccgccgccgaactcgtcgccgtcgatgtcgatgcacggcatggagcgccacaggtcgcgccaccgccgcgacagcacgcacgtctgcacggcctgccgcgccgggaggaacgacatgaccttgtggaggaggtagtccggcagcgtgcccaggtagtcgtcgccgcgatcctcgcccatcgccaccggcggcgtcggcgcggtagtcagatgcgtgtcgctgccgcgagatcgcgaaagacggtagggtttcgagtcgcgacgctcacggcgggggactgacgaggaggtgtgtggagattatggatatcccatatctatacggcgacggtatttggactaggtacaggatacctaatgtagatagaatatcttatttgtatctcgggtttgtttcttaacttgtgtatcaaggaaacaccctgagacttagtcggttacgactatatttcatctgtatttgcatattccgttagggatatagattatcttttgtaaaacggactcttccccatatataaggggggtccgggtgcctctagtggcagaggttggattttctccaaatcatacaatcaataatacactcggcggattcatccccggacaggagtagggtattacttcttttataagaaggcctgaacctgtataaatcctttgtcttcaaacccatacactttcctagcttgatagccaccccctttcattattgccgaaatctagtttcgacagttggcgcgccgggtaggggtagcgtcaagcttttcgccgatcagtgcaa

SEQ ID NO: 9712 - DNA, 1501 bp, Oryza sativa
cttttatttttatagcttcattgcaaggaacaaagtcctgagacggctggtccctcaaaggagaaggtgcgacatttttacctctcccttttagcttggctttgccatttttctatccctcatggcgcttctctttgcggatggtctcctcctctgtgtcttgattggatgatgatatgtatgcttgattggattatgatgtgtatgcacctgatttagatatcttagtactcttattctttttatcttcttctaagaaccttcgccattttggttgatctttcagttctctccacatatacaccaatgtgaaaggtttttttcattattttccgacttaaaaataatatgagccttttccatgatcatatcatcatagtatccactacttcaggtgcttctatctcgagaataagctttacaaaattttccaatttccttcttaacaacaccccaatttactaaatttttctataaatttagtcaaacataaagaaatttgattaaaaaaagacaaacgacttataatatgaaaagaagggagtatttggtaaccatttgctcttgccaaaaataaatggcaaaattggtacttttttttcattctttttctagtcacacttatgtatgcttgaccaaaattataagaaaacataaaattttcaacatgaaacaaatatattactccctcctccctaaaaaaaatatagtactccctccacttcacattattagtcgtttaaatttttttctttgtttaacttaaagaagtttgatgaaatttataaaaaagtttagcaacatctacaacatcatattcgttttattaaaaataacatttaatatatttggttaacatatttgttttatattgaaaatattttaatatttttctataaatttggtcaaatttaaatcatctaactataagaaaaatcaaagcgacttataatatgaaatggagagagtgtcaaaatatgtttaatgttagattgaataaaactaatttggtgatttagatgatgttaatttttcatataaacttgattaaacttgatcaaacctaaagatattggactagaaaaaaaagtcaaaatgtcctgtattacgagggagaatagtgctccaagccaacagtaacacaggtatgcgtttgcggctgttgcaatgcgaacccttctgatcaaattcaacaccggaaccgatggtggagtttcaaactccagctctggctacaagtattccatgttttcaaccatatttgagactggaaaagaaacatggtttcggaatcacatgatattttgaatttaggggaactactgcacaagcctcccaatgcattgggcctcaaccaagcccatctgttacatacaattcgatcgaatggcatacgactgcatgccggtagcgtccctgcgacctgggcatccaagctctaccatcttttgcgatcgatcttgcgacgacaacaccaacaccggcgatgagctcgaccagc

SEQ ID NO: 9713 - DNA, 319 bp, Oryza sativa
aacagtcatgcaatgcaagacacattggggtgctgttaagaaggaaattggaatattttttggagcttattctcgagctagaagcacctggagtagtggatactcggatagaaaaggttcatattatttttaagacaaataataaaaaacctttcacataggagtacatgtggagagaacagaaagatcaaccaaaatggcgaagggtcttagaagaagataacaagaataagagaactaatatctctgaatcaggtgcatacacatcatcatccaatcaagacacggaagtggagaccagccgcaaagagaagcacca

SEQ ID NO: 9714 - DNA, 632 bp, Oryza sativa
ttagtgttaagaatatgtgagatagtttgtgtgaatgctagcgaaaaagattaagtaaataataaaaatgtaaatatttagctgtactaaacaaaccttgcatcgcggatctgtaatgtcctttttaggctctcagcgtttctggacttaggacgtatagtagtgactgcaccaacttcagtgatcacacccataatgtctgtttgcattgcataaaaatttaataaaatgatatggcattgcagaagacgcatataacaatagttgtaacacaataaaagtatgttattaccaacgtagaatgaattcttctcgacaagcgaaggaacatcttcaaatggtgtcagtgaaaatgtaatactagggaaatgaggagggacattaatgtgttcttcaagtgttgtccatttactgaagaggatcattaggttgtttgcaactggcctgtatgttctgtttgcagccctaatagtgaatgagtcaatgtagtaaaccttttcttccttaaggagaggtttcatcttttctgttatagggggataaatttgggcatgtatgctagtcccctgcagattataaatacaaatcatgttatcaagagaattattggtatagtaaggcaaataagaaaa

SEQ ID NO: 9715 - DNA, 1029 bp, Oryza sativa
attttatggctgctaatggcggtacattcatagcagccaatgttttgctgtaggattataggtgctcgttatcgcatagaataggtatctatggctatggggctcctaggaatgagctagcagccccgtaggtcccgccttctgtttcaaaacccgcacctacgtgatatcatagataacagttctagcctagctagcaccagcatctatcgggctactggtgcatccccaagaaacccataggtgttggtttaactataaaaaacccttgtagagaccagtcttatatgtgccggttcaattaaaatcgacacctataagccttttccacctccgcacaatgaaaaataaaagatcgacacctttaagcactgtaggcaccggttcaacagaaaaaactggcaccaatattgtagtctccggttcaacagaaaaactggcaccaatgttgtagtctgtaggtgtcggttttttaaaataacctgcacctataatatactatagtaccggtttttaaagtaccgacacctataatatattataaaaaaccaacacccatcgaaactgaccgagccgagccgattgattcgtgtgcgtcctcaacgaataaaaattgatcgaccttatcctcaccgagtcgaccttatctcctcagctcctctccttctccattttgtcctccttgtcctccatcccctccctctctctgtacgtgccgggagccgtgggcggtggtagcgcccgaggggcagtggcgggcggaggtcccgccggcgggagcgccctcccttccgccggatctggtgggaggggaggcggcaggaggcaggcggcggcgctcgagaggaggcggcgcgcggtggtggcgcccttccttccgccggatccggtgagaggggagttggtggggcggcggcgcccaaggggaggccgcgggtggtctctacaacaagcggcggtctctcttttgacctttctcgcatccctgccccccccccctatcctcttcctctgcatcccccctccaga

SEQ ID NO: 9716 - DNA, 1501 bp, Oryza sativa
tgcccctcggtggtcaacgacgtccgaggcatctcccgtgctgtggagattacaggtaccctatacccacacggcatggttatccgactagttataggagataacttatatctatggaatatgtaacagatcatgacttgggtattacgtttccctgtatattatggaatgggctaaagtcctggtttgataagattgtaaagtagatttaggaaaccgataccgtattggttaaggtttttatattgtaatcctgcctcccattttatataaggcgggcaggaggccctccaggggcaggagacacaactagatcgtcagatctatactacacccagcgaattcaaatccccaaacaggagtagggtattacctcttaattgaaggtactgaatctgtctaaatccttatctctgcatccatccacttttaggtctcgtgcgctacctcttttattattgccgaattcatgtttcgacacgtggtaatcagggcagtcaagtcaggcacagcgaatccctgatctgagccctgtttgatttcgtctgcaatattgtggtattaagatggatggaagggatttgggatttttttttttttagttttgtctgatctttcaaggtaaaatgaagggtctcgagtgcattttacacgttgagtacgattgaaaattgaactaaattttgccagactgcaaggcaggaccatgtatttagaaaaaaaatatttttattagtgcctcaattagttgcaaattgcatctgcactgttgtttactccctctgttagtcatcatataagtttttctcgctaaaaccatggaagccttaactttcctatatttcattgtatgcgagtatgtgatggggaaaaataaaaaacatgcacacttcaactgtccctatgcacaagaaacaaaaacttaatttacatgcatgcaaacttaatttgcatgtataattaaactagaaaaatacccgtgcgttgcaacgggtgaagtctattttaatattattattgttatatggtttagataaaatgaaatttactgttcgagttcgcttggatatatatatatatagaaaatcatgtgctgcagttagaagtccgatcgtctcaagttagcatgcgagtttttttaaatagatttcttatatgattcattttgtataccaaaagtgaacgatcttaaaaaccgactaaaatatggatatgtattttcaaaagcaaacgaacttaaaaaccgatttatacacggatgatgtaccaaaataccaaaacataaaattaaaactgactcaaacacggatgacgaaccacaaaaacatcttcaattttataaccgactcaaacatagctgacggaccgcggaaatatcttcaattcttataatagtagagataggataatactacacgttagagacagggttatatcgtgatctgtcagggttacgggtcaggcataccctctacccttctatatacgttacggatcgaca

SEQ ID NO: 9717 - DNA, 719 bp, Oryza sativa
acgactgccagtgctgctaggaggaaagagcggatgtgttccatgattgctgtatgtccgaggggtgtgacgagagcgcgattgatgccgcaggatttcttcgagtatatatagagtatattatatatcagttcatgaacgagagaacgtgtgatcaccactgagtccactctgtccatgttagctaagctggttgagcaatatattgctgatcacgtctcactacattaacatatctgatcattcgatacagttgacttccatgtgaagactttgatatcttaatggttgtgtggattatattattttgttttgtttagaacctactaagcacttcaggacacgcaaagggtggacacacaatcggttattgcttgttacgtatcagtaaatgagaacttcttactactccatccgttttaggatataagacgttttgactttgattaaagttaaactgttttaagtttgactaagtttataggcaaatatagtaatatttataatactaaattagttttaacagatcaataattgaatatatattcttaatgaatttgtcttgggttgaaaatgttactacttttttctacaaacttggtcaaacttaaagcagtttgactttgaccaaagtcaaaacgccttataacatgaaacggagggagtatctaatacttatgtggatggatgatatccgcctcccgcgttgtccatgcaca

SEQ ID NO: 9718 - DNA, 1501 bp, Oryza sativa
agtccaaatacgctagattagatagaagtctatatatagcaccctaaaatttaaaactgtacatccaatcccttactttgtaaaaccgttcatattaccccctaaggtggttctgtgtagtggtttttatctaatttatatgtaaattggatgagtttgatcacgtgatatacacattggacatatatatacatacatatatatatatatatatatatatatatatatatatatatatatatatatatatatatatatatatatattaagtataatatatattacaaacaagtatcaacataataatagtataatatcattgtataaatataaattgatgacttaccactgatgatatgcaaatatattatattagttatttaaagttgttcgtttaaactttcaaaataagaaaaatcaccttacggggtaatatgaacgattttacaaaattcaggggtagggttagaactctagttttaaagttcaggattctagctaaatgaacgaactttcatgtagagtttacgggggtatttagacttttttctatattattctatatacatgatttatcccctattcacagtcagatagcccagccgtgtgggtatatagtacccataatctccacactatatctatcatgccgttgccggttatacagcccctcaccggggttaaccacgagaggccctctatcttgccaagcttgtcgtcgcctcctgcacacaagtggcgaggcgttgtcggggttcggcccctccatcaccatccttgttcgctgcttagagagccaaggcagtctctccggcggcagcaaggtggaggagaggggagacaggggcggcttgggcatgtgcatggacaacgcgggaggcggatatcatccatccacataagtattagatactccctccgtttcatgttataaggcgttttgactttggtcaaagtcaaactgctttaagtttgaccaagtttgtagaaaaaagtagtaacattttcaacccaagacaaattcattaagaatatatattcaattattgatctgttaaaactaatttagtattataaatattactatatttgcctataaacttagtcaaacttaaaacagtttaactttaatcaaagtcaaaacgtcttatatcctaaaacggatggagtagtaagaagttctcatttactgatacgtaacaagcaataaccgattgtgtgtccaccctttgcgtgtcctgaagtgcttagtaggttctaaacaaaacaaaataatataatccacacaaccattaagatatcaaagtcttcacatggaagtcaactgtatcgaatgatcagatatgttaatgtagtgagacgtgatcagcaatatattgctcaaccagcttagctaacatggacagagtggactcagtggtgatcacacgttctctcgttcatgaactgatatataatatactctatatatactcgaagaaatcctgcggcatcaatcgcg

SEQ ID NO: 9719 - DNA, 1501 bp, Oryza sativa
agttaaggggaaaacgatgaaagcttcagctaattaatcagctcctaaattctgagcacatataaagccaacccacactatggttaccgaagtttcgaaattttaaggttccgttgtttttccaatgtataccacattatttgtattggatcagaaagaaaatttcatttccacaaatagtcattgtccgactccaattaacaccgatgcctgaatatcccagacaattagtgtatgaactctgaaattgggtatgagttctgaggtgtatatcttcctctgaattttttcctccacttgtaatttatagattatacttctaacagtgatcaggagcactgtaaatttcttactttggattactagccatggatttgaatttgatgctcgtactatatgcggcacaacaagtagtcactaattaataatagaaatcaacctgtaccaggtacctgatctgactatctggagtgcagcacactaaaaatgaggcttctgaagtctgaactacggatagatgaaattaaatcacactagaacgtttggaaatatataacaagtgcatgactcgatctctgtggtttaaacatgcatatgggctgacatggaagaaatcaagctgcacaacgttgatgaccttactgaaactttaatatttagatagatacatatgcagcctgttcgacctaggcatataaatggcatggtactatagtacatggaagcaaataaatatacgttaagtttttcgagggattggagaaaaccaaatgtaacattattatttttctaactgtttttctactcaattctagtgtaacttggtgtgggctagtgtggcttcaaattctctcttgtctaatccaaaaaagtcgaatcagaagcaataaaaccagtttattttctgtttttgaactgatctatttcttgccatgcatagtaagagttattatgttaggttggcataataaaaacagttattatgttagggttgtgttctagttttttaaaatttgtttacactagttaagaagagaataagagtataacaaacatattagcgggattatggcaatatacatatgagacataaggcaactatacttgctttccctcatattcaaatatttttcccttttacactagttaagaagagaataagagtataacaaacatattagcaggattatgccaatatacatctgagacataaggcaactatacttgctttccctcatattcaaatatttttcccttttgaatttagaatgagaacaaaacaatggtggttcttttctttgatttacatctctcttttctacccgtgcacgatgctgcaatgtgcaaaaatataacctgcaacctaaacattcatatatggcgcaaattctaagatatatatccacttctgataatttctttttctgtctccatatgcatattatacttctggtagtgatcaagagcttgatgtgaatttcttagtttgaattacgagcca

SEQ ID NO: 9720 - DNA, 1501 bp, Oryza sativa
cgcttgcacgtgttccttggtatttgccccctgaccaatcagagattcagagacaccctctttcctatcttggctccacatggacatggacataaacatgaacatggacatggacatgaaaggaggaagggaaaagattatacatgctactactggctactagcagctgggactgggaggagagctgctggtgttctactagcttccttcctttttcgcatacgacgatcacctttcaatttcccccatcaatctttctggttactggcactgcattcttctgtcgatccttttgtcttgttactgccactgttcactcttacttaacgcactggcattactagtgaggagtatgctagctttagcgtaatattttaaggcaagttgttcacatcacacaaacatgcatgggatccacaccatgcacgaactgcagttttaaatttgcccaaatatctactactgtataaactcttgtgagatgttcccatggcaccatgatctagaatgacgtggaccgtcctccttcaagtcttagtataatactataacactatgcctccttaaaaatcacagaattgggcaacattctaaattcctttagctgaaactctgcactatacttcggtttggtggaggccacacgctgtcaatgccggtgtggtggttgctgagctggtgggcgacaaactacttgaaaggttgtagcggatctaggcgtaagccttgctcagtggatctccgggccggcagccttcgggccggtagcggatccaggcgtaagccttcgggtgtcgtaaccctcttgggggcgctgtcgagggtatctaaaccctctctccctttcttagcaagttttctctgggtgaaaaccacatctttcttcgatgggcgatgtccttgatgttgtgatgtccttgatgtcttgaggtaggtccttgatgtcatgacctccctggggcatcgtttttgcagtcttgcctttgtggtgttgttgtaggccgggcagcgatcggccacgcttagcgggggtcgttttggtgctcggttccacttgcagtggtttgtgcttgtgtggttagcgtgtggttcttggaggtgcttggtgcacgcccgacctcgacaacttctatcgtgttctttcttgtaacttttctccttaatatattcggatggcctccttcggccttcccggcgaaaaaaagaaactccgcactatacttgctgttgttagcaatagcaggagtatttcttaaggtgaaatgtgattgtccatgtcatctagaaggctataattgggcaacatgagactatgagagagccccatatacatgctttcaatggtgtgtcccttaagtgtcttgtgtggccaaggcatgctattaattgccccctaattttctgcaaacacatggaacgcatcagatgcaaaacacatgcctagctaggtacatacaacatgacacatgacattgaatcaggtcaccaactataatctctg

SEQ ID NO: 9721 - DNA, 1070 bp, Oryza sativa
aaaagtcaacggcgtcatctattaaaaaatagaggtagtatatgactagatttattaacacacatatgaatatgggtaatgctataaattcttatattacgaaacggaggaagtagtgttctgtgataaaaatttgatgttacgaacaagattatatcaaactcttgaccagtgacaactttttaagtacttatagttttacatttgacatgtataaatttatcttgacaagtactaaattgtgataaaaaaaattcacatggctaataccatgaacataaatcatatattttcaacgtgtattataaactttgtagccgttaactttttatgactataattggctaacttacaatcattaagcaattatctatagtgcactttggctgatgatggagttctagagctccgtagtggcatggttgcatggcagaaactttatagatgtacttttcatgtattatttatctaataagtaactttttaacaaagaatacagtcatactcttcgggcccatttaaatcgcaagaatgaaaaaaaaaagaaggaatagaaaatacgaaggattcaaataagaatataaatgtaaaacagagaattgaatacagaaataacataagaatacttatttgattggagcataggaaaaacacagccggatgagagagatatactcgaaagaatatttaaggttagacctcactggtggagaagtgctttttagtcccggtttataaagatcgctatctttagtcccgattcaaatacccgggactaaagatcgatcaccaaccgggactaaaaagagggaagcggcagtgagatggtcctcttttctttttttttcttttttattttctcccgaattgagtgggatatatatcctaaatcaaaccccaaatcctcaaatcaaagtaacatcccaaatctacatcccaaatcttaaaattacttatacacataaatcaaatacatcacaaatcctacaaaaattacaaacatatcaaatacatcacagatccatacaaatgtgcaatgaatcacaaaattatctatacaaatgtgcaaa

SEQ ID NO: 9722 - DNA, 1501 bp, Oryza sativa
ctggaaactttactacacagtacatgacaggacagtggtactgttacctaagtgaagctcgtgctatgaaccttgctcctcccctgcatctggatcctcatgtctaagccagcttaatcaattcactgatgcaaattaacagaggtagattaatgagataatatatataccttcaaggagcgcattgaaatttcttcgtacttgtgcgtaagatcacgaggacaagatcttgtcgtcgtcataactcataagtactgcagatcgatcgaataagaagctgtacactgttctgatggcaaaatcgttcgagcagtgcatcttcagttaataagttaatacaaaaaaagatcagtctctgaattcttgatttgagctttaatttatgtttctctagaggaaaccagttgtacgtgtgaatttagttttgttttacaagactccacatggatgatacaccctcatttttcatgtcaaaaatcagacttgcgttttagaaatacagggagaaaaatgttgcaactctgaatttttcgagacatcttatatgtttatttcgacatgtttaacctaactatatttgttacagttttcctatgaggtgggtcccactcccaaaacatttctacagtgaaaaatcttggtgccagaagtacagtagagaggacacttgtatcatggcagccataattaattaaacaagccatatatacacttcatctctcttgccatagagatctctgttattattagttattactatatccccatgcatgcaaaatctaatcctcatcagtagtacaacaactactactagtgctataatatattactccatctcttggattgttctgatctgatctcttgatgatgtacacaaatacaaaatacaaattatatgatccctcatgagaatatagctcctctcatctcactctcctgcatctatggatgcagaagactaccaagaggaaccaagcaagaagaagctactagctaactacttagctatagctactgctggctctttgaaacgtaggaattttacaaaattttcacagaaaatagcttggtttcttaaaaactcctgcaaaattcctccgatctgaataggcctagaggaattttgtgggagtttttaaaaaaccgacctattttctgtgacatggagcttatgcctagctagctagctccatgtccaaaagctcaacctaattaacaaactcgcatcaacatctacatggacatggacatgacatggagctagctagagcctttgagctttgagcttgaacttgatcgattttgtacatggccatggcggattcttgcatatgtcaagcagctgcagcttgttcttgttccttctcgagctgcagcctgatctccatgttgaacctggcgatgaactcctccacgcgccggttcagctcctcgtcggagagccgcgagtactcgctgctgctcgtcgttgtcatctcctcctccggctccggcggccgct

SEQ ID NO: 9723 - DNA, 1501 bp, Oryza sativa
ctccctccatctatttttgatagtcatatttcatcttggcacacagaccaacgataactgattctacttatcatccatctaaacatgctactagtcattcctcgtaaacaagcgatcattaatatttacatttctcgatactcatgtagccaatcttgtgtggaagaatgaagagtcacgcattaaatccaagaaatccattaagatgataagttgttggattgaaatatgcctatcaaaaataaatttttcagatttaaaaatatgactatcaaaagtagatggagggagtagcattttcaacccaagacaaatttattatgaaaatatatttaattattgatttaatgaaactaatttaatattataaatattactatatttttctataagcttaattaaatttgaagtagtttaacttttgacaaaagtcaaaacgttttataacttgaaacggagggagtagctagctactagtactattatataccgtgtctaaaatctcagattctctctgcttgcattgtgtgtacgcatgttttttagattttccatcgtgtagacaaggcatgggcaatgtcaacgcttggtatgcattattgccctaaactaatctcaaacaatctaacctataagcaagcagtagaggctgcattttttaaaaaaattttcttgtatgcatgtgggattattagagttttgcttctacgtactgctcccttcgtctcataataaataagggattttgctctttaaatttatcctaaaatataatagattttgaaatccagagacaatatttatattctcccttaccaactttatttctttacattttaaagtaacttgttttcgttaaaaaacactatttaacagtttaaaatgcattgataacaaaaaatcaagataaacttatattctaattaaaaaagaacaccgttttacaatcgcttatactcgacacacacacatttcaagattccatctttaaaacattttgaatatgaattgaattttacttgctaaaaattatatcattgaattgccatttgaatttactttcatatgttcataattttgttaatatataataaaaaattataagataaccgtatcaatcttaaccctgtcttatattatgggacataataataataaaaaaaaatcccctcttgtgtcttgtctcgaccgacttgtagcagtagtagtatttgtaaccgccttcttcatcgtctccttctcctaatcctcttctgagagactcctcctcgggtgctgacgtggcaccccggccgacgcggcctcccctatatatagcgccccacccccacgcggctgccgagtgtggctgtgcgtgtctgattcgtgttcgcttctccgactcgactcgatcgactcctccctcctcgccgtggtgcggcggcggcggcggcgaagcgcattggtggtccactccggcggcggggggagtgagaagtcaccagtaaggaggagtagagga

SEQ ID NO: 9724 - DNA, 1501 bp, Oryza sativa
atatgggaattactagtactctaaaatttcttatatttacaaataaattttaaatggttgaaatgtttacatcggtgaacaaatgagtaatctctccgtgctaaaatatatcaaactagaattggatatgatacatattatagtaatacgaatttggatatgtatgtccttatctaatattcgtagtaatggaacatgtttcatccagttttgtgttgctaggtggtgtttgaatctcctgaagatgaagatgaagattaagtgtttcacgcaaaatgatgtggtaataacgtgtgattaattgagtttaaattattataaactcgaaaaatggataaatctgatattttagagcaactttcacatagaaagttttcgcacgaaatgtaccgtttagcagtttaaaaaacgtgccattttaatccaaaagtttatcctctaattttgatacggtggaagtagattagtattcgcgtcgtgacagttgcgaatagtacattttccattgtgtatgtgcatgtgttgagggggctgaccagcggcaaaagctagctatagcggcgaggcgacgtgttctgagactctgcttttcttctgcactttttagcgtacattactcttggggacaaaaaaaaccttttctgtactagcgaagaaattaatctggcgtacacactctctgaaagataacctctctgactttttgatactccgtactcgagccgactacgtaccttgagctatcaacaaaactgtattgctgctacttgcagagaataatgaattaataattattacttcctccgtccctaaatatttgacgctgttgatatttttaaacatgtttgaccgtattcaaaaacttttgttaatattattaaaaacttaagtagtagtagtatatttaaaaatgaatcaaatgatagaaaaagaattaacaattacttaaattttttaaataagacgaacgatcaaacatgcttaaaaaaaccaacggcatcaagtatttagggatggagggagttattaacatcttaatttctcttttcgtgtgtaattaaacaaaggattttgtcaaaggccactagcgtcgattggctggctccagtagctagataacatgtgggtccaaccctgtctcttaattattggtgtgctttgaggacaaaagtttatatttgtcgtatctcaatcgtttttattaaattaaggaatatatatgtgccaattgccatcatgttgctgtggtaatatagatggaagaaaaaaggaactcggggacaatctaccaataattggagaagaaaaggttatcctacaaagagtaaggtaaatattgaaaagcaagcgggatatatatagataaaaacttggaagtaatgacgttttacgagattgtgtcattgtatgtgtttgtgttgcgtgcaccattttgcaccaccatgattttggtgtagacttgattaattgcatttttttttggtaattggaaatttttagg

SEQ ID NO: 9725 - DNA, 1501 bp, Oryza sativa
actttcgcatcagctccatcctcagctcgtgcagggacgcctgagcctcgtggcattccctgctcttgagctcgttctccctcatcaagtcctccaaaactctcctgcactcttccttctccctcaaaagcagagagtactcctgcttgagctgtccacagcagctgcattttccctgcaacaaatacatcaccttccattaagcaccaagaacagcagtaactagtacctccttgtttcttagtactccctccgtcccaaaatataaaatctggtaacatcaattttacatgattgatcattttttctattaatagtcaaaattaaaaatgtttgacttagcactattctaaaaattcttatattttgggacaaagggagaacaaatttttcgaagcatcacctcattttcctcaatgtgaagtgtttcatgcacgctttgtgaacccatggtggcggtctcctgctctccaccacctgtgcttatgatgctagaaatgccttcgggaggatgaacctgcggctcggccacgccatcgttggaggtggcttccagggcggcaccgccgatggccggagaaggagaaggcgggccctgcggcggcgaggggcccgagaagagctcgagcggcgcgatcctgtgcctggcggccgcggcgcccctcctgatgtaatcgggcgtgtcgtgctgcatcccgtcgcacgggaggatccccgacgaggcggaattctcctctggtcgtcaccgcgcagtccaacgagaaaaaaattcagacaaattcaaaaaaaatccagcgcgatgtatcgagaattcgagatctagaaatggcgcggcgcgcgcgcgaaccttcgctgttgccgtcgtcgtcgtcgtcgacgtaggggatgaagtcgcaggtctcggacatcttcaccgtcttcctgaccgacgccgacgacaccatcaccggcgagtcgccgcctgcaagcaaatcgaatcgagaccatgtcagaaaccaaaccaaacccaacccaaaacacacccacacccgcacgcacgcacgaagcaccaagcgaagccgtgtcacctatccggccatgagcggcggggccatcccctcccctcccgctcccttcctcctccatctccatcaaccaccgcgccccgaaatgaaatcaaatccacgcccaatctcctccgccgcgccaaacccccacttcgaatccgagccgcgccaagccccagaaggctatcgcctatcgatcgatcccgcgtcgagagggatggagagatgcgtggaggcggcgaggatggcgaggaatcggaggagggcgatggggaaaatggaggggggagccgaccgttgcaactgcggggggattttatttttctcttttcgaattcgaaatgcgtgcgtgcgttttgtgttgttgttgatgatgattaaattagggttagattagtttttttttttgggggtggggggggggggttggatggacggtccagatgcgtcgccct

SEQ ID NO: 9726 - DNA, 1501 bp, Oryza sativa
tgacacggcttcgcttggtgcttcgtgcgtgcgtgcgggtgtgggtgtgttttgggttgggtttggtttggtttctgacatggtctcgattcgatttgcttgcaggcggcgactcgccggtgatggtgtcgtcggcgtcggtcaggaagacggtgaagatgtccgagacctgcgacttcatcccctacgtcgacgacgacgacgacggcaacagcgaaggttcgcgcgcgcgccgcgccatttctagatctcgaattctcgatacatcgcgctggattttttttgaatttgtctgaatttttttctcgttggactgcgcggtgacgaccagaggagaattccgcctcgtcggggatcctcccgtgcgacgggatgcagcacgacacgcccgattacatcaggaggggcgccgcggccgccaggcacaggatcgcgccgctcgagctcttctcgggcccctcgccgccgcagggcccgccttctccttctccggccatcggcggtgccgccctggaagccacctccaacgatggcgtggccgagccgcaggttcatcctcccgaaggcatttctagcatcataagcacaggtggtggagagcaggagaccgccaccatgggttcacaaagcgtgcatgaaacacttcacattgaggaaaatgaggtgatgcttcgaaaaatttgttctccctttgtcccaaaatataagaatttttagaatagtgctaagtcaaacatttttaattttgactattaatagaaaaaatgatcaatcatgtaaaattgatgttaccagattttatattttgggacggagggagtactaagaaacaaggaggtactagttactgctgttcttggtgcttaatggaaggtgatgtatttgttgcagggaaaatgcagctgctgtggacagctcaagcaggagtactctctgcttttgagggagaaggaagagtgcaggagagttttggaggacttgatgagggagaacgagctcaagagcagggaatgccacgaggctcaggcgtccctgcacgagctgaggatggagctgatgcgaaagtcaatgcatgttggctctttgggtaagaactcaaaatttgtgtggctaatctactccagctttccaatggtagtaggcgtaatggaagattaagttcggctgtgattggagaaatgaataagttggatgtaaatatgtcagctcaaagtacttgtaggaattcgctatttatgtaaccagtagttacagtggttgtttaagtatctcatcaaaaaaatgtcagcatgcttgctgagtggctgaatgcaagctttctttttcatcatgcagcatttgcagtggaggggcaagtgaaagagaagagtcgttggtgtcagttgctgaacgatttgagtgagaaatttaaggtaactggtttcatattcaaagtttgtttactactcatgtacaaatagcacaattgtctgggaagtcaaagcagcatattttattttat

SEQ ID NO: 9727 - DNA, 1501 bp, Oryza sativa
aggtgagatgatctcaaaggggtgtcaacctgatgttgtgacatatagcacagtagttgatgggttttgccgcattggggaacttgatcaagcaagaaagatgatgaagcatatgtataagaatgattgcaagccaaatacagtcacacatactgctctgttaaatgggctctgcaaagttgggaaaacgtcggaggcctgggaattgctaaacaagagcgaagaggagtggtggactccaagtgatatcacttacagcgttgtaatgcatggatttagaagagaagggaaactaaaagaatcatgtgatgtggtagtgcagatgttgcagaagggtttcttccccacaactgtggagattaacttactgatccatgctctatgtaaggacagaaaaccagcagaggccaaagacttcatggaacagtgccagagcaaaggctgtacaattaatgttgttaatttcactactgtgattcatggattttctcggcagggtgatttggaatcagcactctctttgatggacgacatgtatctgagcaacaggcatcctgatgttgtaacttatactgttgttgttgatgctttgggaaagaaaggtagattaaaagaagcgacagggcttgtggagaaaatgctcaacagaggcgtgctccctacacctgttacatacaggacagtgatacatagatactgtgagaagggcaatttggaagacttgctcaatctactggaaaaaatgctagcaagacaagagatgaagagcgcatacaatcaggtcgttgagaagctatgtgctttcggtaaacttaatgaggcttacagtctcctctacaagatactgagaactgcttcagtgagagatgctcaaacatgccacattctgatggagagttttctgaatagaggcctcggacttcaggcctacaacgtggcctgtcgtatgttccggagaaatttaattcctgatgttaaattatgccaaaaagttgataatcaactggcctcagagaaaaacaaaccagttcctggaaaactcatggttaagtttgctgaaagaggtcttctgaaacaagtaaaacaagatagcaattgatttacagcgtatcgatctatttgtatttattcatccaatatttaagattcgaaaaacaagcaattgtgatggttagagtcagaggcaatacgatactacatgctgtaaagcttgttcttttgctttctggatgcaatgcaatctgcaattcatctatcctaattcctaaactggcagcttcctagttgtctatgttcagctggattgcaaactccatggttaattggtcatgccttactactgcacctacttcttcacagcaaccaacttattcacagcagcaaacggactggtaggtctggcacttgaaggttagttagctgctactgaaaattcaaaagagctatgaatctttggcaggtctataaatgccttggtccattatgaattatgttgagcaaa

SEQ ID NO: 9728 - DNA, 1501 bp, Oryza sativa; identical to SEQ ID NO: 6459

SEQ ID NO: 9729 - DNA, 1501 bp, Oryza sativa
gaatttggaggttttaatatcgccgaacctggcgaagcttgggagaatcggatgtaactttttctgtagatgtccatgcatatattatttgtctgattccgagtccgtatgagaaagttacgcctattttaatagatgacatattttgtccgtttcggtagagttttggaaaattctatatgtaacatattttgtccgtttgagtttattttttatacagttggttcctatgttctcctaagtgtgaaaaaaatatcaaaaaaatgaaataaaaataaaaaattgcatctctatgtactgtttaacttatatatgtcatttcatgtggttatagtggtagagtgcattatgtttaacatgctgatcaaagggttttactaaaagaattatggtctaattttagtgaaggtacaaagtagactaagtggtatgctagatattttcagacttagctaagtggtagttctagtttaaattttttttgtggttggttgtattgtgatcctgagtgtgaaaaaacatccgaaaaaataaaataaaaatgacaccgttgcaactccgcacagagaaacagggatgcagccgccggcgccagcacggctggcgccctcctcctgccacgtcggttcacgtgcgccacggtggcaggaggacggcgccagccgccgtcccgttggatgacggcgccagccactctggcgccccaaaaaggaccatttctggtataagtttttttagaggtctatttgtgaaataatttttttaaaaggaccaaaatgtgaaaaatccagctgcaatcgccatagagcaagtgaacgggagtcccgagaacccggatcgcatagtatacttgtatataaatagaagaagttttcttctaaacttttgtatcctgttattctaagcaataagaaacacaccaggttagccccaatttccagattgagtgtcattccacattttatttccctttgttctttgccattgcaggacaactacattcacccgcaaggtgttcgattgaggttctaggcaacaaaggaattccaaagtattgaaagtaaatgtgcaacatattaattataaactgaaatgtaaaaattcgaaaatgtacatttttctgatcgtttttacaggaatatttttatggattgtcttcccaccgtcaccgtgatattatgcataatttatctacttaatttataatcttgtaggtcctgtcatgccatatgatactacaggacagtgtacgtcgtcaatgcgtacaatcagacgggggcagagctaaaataaaatagagaagggtgacacttgcttaatttactctctttagattaagtttaacctgatgcgggtgtctaaatttgtattgagtgggatacacacataatgaaaataagtgagatatagcttaaaaaaaatttcttgaccgggttcctggtacccctccaatactctagtactcgatgctctccgccttcgacgtcgccatcagctcctg

SEQ ID NO: 9730 - DNA, 1501 bp, Oryza sativa; identical to SEQ ID NO: 6457

SEQ ID NO: 9731 - DNA, 1501 bp, Oryza sativa
ctccatggtcccgcgaccggggagagcgcccttgtcgcgtcccaaaacgactctaaaatacatccccgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttccccccctccccctcttgggccggctcgcccatctctctccctctctctcctctcccccgcggcaaattcggcctcctccccgcgcgcgtgccgctgacgggcgggcccgcccgccaccctcactgacgggtggggcccacccgtcatccccttcctcccgccgctcccgccgcctcgcccgtgccctagcgccgccgccaccgcgaatcccgccgcctcccgccgtccacgcgcgcaataaagtggggggaaatattccccgtgattccctccctctttccccccatttttccctccctctctccctcgcattcgtttggaaacctctcccctaacctcgccggcgccatcaatggcgaccggatcttccgcgcccgtttccccctcgtccggcagctccctccccctcccaatcctatataaaccttccccgtgccaccctccaccgtttccgccactcgccgccctctctccccgtcggaatcgagctcgcgccgtcgctctctctctccgccgtcaccgccgagctccggtccgccgctgtcgtcgccccggaccacctcccgcctcggcgtcgccaccttcggcttcaccgcatccccgacgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctttttcggccgccggtccgccgggcctaaggccgccgccgggggcccaaagggggggggggggccgcctcccgccgctgcgccggcgtggccgccttcgggcgcaccgtgcggctgccgcgtggggcccggcatcccgtatatatgtatatacatagacacagtttgattattggtcttactatttaaaaagtaaagtgcacgggcggtctctaaacttgtatgggtgtatcaactagatcactaaactaggtcactaaactctcaaaatgaactttttagccctttaacttgtctcgtgtgtcatatagatccaaacgggttccaacccgccccgtgtgctgacgtggcagccatgttggcacctacgtgtcaatagaactcatatatatgtccgccacatattaaaaaaaaaggaaatatttttcccctttctttttt

SEQ ID NO: 9732 - DNA, 1501 bp, Oryza sativa; identical to SEQ ID NO: 2288

SEQ ID NO: 9733 - DNA, 1501 bp, Oryza sativa
ttgatgctacgatttttttcgtggtagttatatcgtcattaataaggccggtcaccattcatcctccaagttcagacctttgcggtatatattgccatgtgattattcagatgtgcatgatatagatagggacaagaatagtgaattctggcactcacccatggtctgtgaagtaaacagaaaaacgtacgtacagaaactgtaagctacatcgcctccaaaaccactatatataaatccagggcaatgttgaaatgtaaatactactactgaaattacgaattctctacctctcaatgaatcgttttcataacctccacatgcaataaccaatattaagatcagcggattactgttgcagtgttgttacgctatatgcatgtgaggtatcaggaatgggacgctccaactcatcgagttaagcattttctttttattggcgtatacatgcatagagagaacgagaatatttatcaccgatgctggagcaacttgtcagcttgatccaagtttaactcgcggtgggtatacgtgcattacgcagataacaatccacaactcacaagaccattgcaacaatgacaagcaactctacctgctatttggtattccattgcatattctggcgttaacccaaggcttagttgggctactatggatggattcacatagggagatccatccagggggatggggttgatccctatactctcacccaatccccccacaagtctccctgctaattaagcaagttatttttggctaagcaaatcactggcttagatttgtacttacaatttatcaaagtaataccattaaaaaatttaatgtaaagaataaaaaatcacaaaacgaatgaaatattgtttttaaaatcagaaaccatgaaaatgacgatagaaattcaacaaacactcccaaaatatggcccaaaatctgaaaaaaaatccaaaatattcacaagcaattagtatcttgttgttcatggaagctatagattcaagattacaacaaagtactccgaaggtcaaatcatcatatgtaacacatacatctcacacgaatcatataatcctatatagttcatcctcacttagtgtagctaatagcaatttcttgctttgaggtgcagccgtatcattcgaattgttttaaccgttagattagactctctattcactatcggtcattagacggactgctgccaccgatttcttcaacctaacaaattgttacctgtctttatcagttcctctacaggtgccgctgcttgatgtgtttagtaatggcaaaataatcaaggagtcaagaagtaaaacactactccactaatgctgcacactaataggtatgcacataataccgcactacaattttcctcaaaaggagctcagaagtcaccgtccagcccataaaaacaaattgatcacaccacatgttcagttgcagtctcttttgttctaggagatatgccaatatacgattgatttgaaggaatcat

SEQ ID NO: 9734 - DNA, 372 bp, Oryza sativa
caaatgcatgagaatcaggaacggagttaaacaaaaaggggaagtctaaccctacatgaacaactctgcatcacaaatttcacccggtagcatttctttcttgcaagatccatcgaagaacggacaggttcttgattatggccacaacgacaagaaaactaaaacaaacccttcacagcccagcccccatggcgtctgaatcatcatcagcagatcgcatacgaaaattctctaaccaatcccagccaagaatcacacatctagaatgaactagcgtagaaaaggtgcaccatcatcatcatcatcagttcatcatcaccacacgaagtcacgaagaggagaaaggggtggttacctagaaggaataatcaa

SEQ ID NO: 9735 - DNA, 1501 bp, Oryza sativa; identical to SEQ ID NO: 2291

SEQ ID NO: 9736 - DNA, 1501 bp, Oryza sativa
ctcctccatcgagaaagcccgcggcgccttctcccccgtcgccatggatccacccctcccgccgcgatccccgcctccgcccgacgaaatcttggcggccttgcccctggatcgatcggaatcatccaaggacgacgccgaccccgacgccgccgtacggatcgaaatggcgacgaactccgcggcgagctccccccctcccctccggcggatcaaatcgaatcgaatccaatcgaatcgaatcaatcgctcaccaaatcccgccaagaaacactaatccagcagcagagcagagcgaggaattgggggagtaaatccggggtgcgatttgagggcgggggaagcggagaagaatccctccaaatccgaaaatccgcgaggatttatacgctctcgcgcaagcgcatcaacgcacgaacacgagcacgaaccgaaaggaggacgaaaaataaaaataaaaaataaaaaagaagaggaggagcaggagaaattttcttcacgcaagtaaagactaaagaggggctccggaaataaaaaaaaatgcttggatccagaggctcctccactagtagctggcgccgtcacccactgaccagtgggcccagcggcaggtggcctcacctgtcagaagtcacactcacccggtggtggcacgtggcctcgcggtgactgacgaggtggggacagtggagggtggggccggggggtcagtggggttggagggtgcgcgcgggggaaagaaggttcgagatcccggggggaggaggagaggaagaggacgtggcgggcactatcgcctacaggggtgacgtgtcaagccgggattgggcgcgagttggcgatggggacccggcacggtggcacggccaggcgatcggtttcctcggcaactcggcgccacggctggacaaggcgcaggcagcgacaggcgaggggcaatgcaaatggcatggtggggttgcaaattgcaattttgcattattagcggagcaaaagcaccaacggctcgttgattttgttcgctcccatctaatcacattattttttcgtccccagcccgggtggtgttcggtcacaggagtttttgtccaatcccttgtcaacatagtgtggttacagctcgagacttttattgtgctgtgattctttcttttcttattacattatttccgttacacggcggacacaccattatacgtgaaacatgatacacaccactgcgcatgcaacaccacgctcacacttccacgagtgcgtctcttcacacacgctcagagagataaaaactggctgtatatttatgatcacactaaatcctattgatatttacttacgtacgcgtaatatttatgggtagcaagatttgaaccctaatgggtaaagtcatgcactcactaatgactctatcaccaccccgtgctttccttactgtgtagtgattctcgtggcatcatgtctcgatgtttttatgtttatacttggagcacatcctttagtgaca

SEQ ID NO: 9737 - DNA, 1501 bp, Oryza sativa; identical to SEQ ID NO: 4982

SEQ ID NO: 9738 - DNA, 1501 bp, Oryza sativa; identical to SEQ ID NO: 4981

SEQ ID NO: 9739 - DNA, 1501 bp, Oryza sativa
aaagagaagagaagagaggtgattggatgataatttaatttgaagataccaatggtataatgtttatatggcagagcaagtacgtggttgggattgtcctattgcatcgatcaatctctcattcaatcgtatcatgaacccaggatgggccagattcatcacttaccggcatggcagggagatccaaattaaatacagacacttgcctcgttgctttacatgtcatcgattgcctctacatatcaccttgattttctttttcttcttttgtcctttggattgttctgggggcagcctaatctagttttgtgtgattggttcacggtggtataactttagttctggtttgtgcctttgaggattatttgttgattaattaactttagtttgcgtttgtacctttcaggttatattgattttgggtctgttcactttgatgtcatttttaaccatactaatttttctgttaaagttgtcaaaaaaatatctacgtttagtttattgccaaatttggtcaatacataagaaatcctgtcaaaattttagcaatattgccatcttgctaaaattctaaaaattttgatattactaaaacttgttaaggtttattttgactacaatctgaacagaacaggctctttaggcaagctgttagaaaagcaaaagcttctagaaggaaactatacatcggtgtgcatggattctttttaccagcctggatgttgatgggtgagtcaacactcgagacaccacaagcgtgagtgcgtgacatgtactgcatattccaaatggagggatttttacacacaaggacaatagagtttagtacttttggggaagaaatgaccggacatttggagttaacatatgcattttttactattgttaccacaaggacaattttcatgaagtcattatctttgactgagtacacccttttctgggtgtagaggttttaatctattgttttttaagaaaataaagtatttatcttattagtacaagttatgattttattgtaccgtttcatgcaaatagatgatggtgaaattttgtcaaataaatatgacattgtgctatattgtagtactatagtatttatagaaaatttcataatcatcagggcgcgcacgtttttcctgaagcttggatattgtataatatctaattaggctgagttctaaatagatattcagaacgtctattttctttcgtgaaaccagctttctcaaaccacgtgtttcttgtaaaagttatatatacacatgtttttctttaaaaatatttttaaatttatagtagttaacactaatttatctcgtttgcatgccaaaaaatcctaaacagttatagagttgtgtatatagatcaagaaaacaaaaccggccttattgtcaagtaccagtaattaagcactgaaaatgatacttcctccatccattaaagttagacatattttatatttaagtttttcaaataagttgttcctacttataggctc

SEQ ID NO: 9740 - DNA, 1501 bp, Oryza sativa
acactgaagcaagtgatggagaccattctccttccacctcacatgagctgtccttgttgcccagcctcctctcctctcctctcctctccaccctcatccttatcctaatccaaatccacctccatctccatgttcatctcaagcttctcagtccccacacaccccagaagcctcatcacattcactgattgcaaaaaaaaaaaaaaacaaatcactcaaggataattttaagatcactgtcactgattgatcctttgcatcaggaggttcttttattgtttccatggaccaagtttggatggcatcttttgggggtggaaaatttgggtccataatatgttttttccattgtctggattttattctgggggtgttcaagaagagcaccaagttggacaaagaataagtctacaatgccatctagtcaaatttgggataagaatttagaaacagtgtgctttgctggtctatatggtgacagcatgtgattaatttatttagttttctttgtgggggagattcggatgctgttctggactctcgttttaagcgcgctggagatttatattagtgggacatcaaaatggaatttttcaggtaagagaatgcaagctaaataattgaaatagaattattgttatttttattattactcatgccaagatggaccggctagtatctccttaactactactgtggataaattctaagcgctataattaacaccactacggtgaataattatttttaaacttaacgataagtgagctgctaattaattaaatcaaataatattaagaggaaaatgttgtcataaaaagtcaggcaaaatgaaatggagtaaaaaaaacactctcattataggcactgcaataattcaacaaaagaatacaaaggccttgtcaggttgtcatggactgttctactattatagaagtagcaaggaaaaatgaagcctttcttttggccataaaaataattagacagcaactaatttttcaggcaaaaaggcacttactagtcattatcaccttttccatagttccatcatcaaaaaccacaagatcaagttttccagctcgctctttcttttcttttcatttccctgtgtacttgttctgatctacttctactcaattacacctcatccttgcatacaaacaaacaaaaaaagtaaaaaaatgaatttccactaatgatcattacctgtaattcaagcccctctttaagcaacaaaataaacttttttttttatgaagagttgcatgttgaaccggcagaaaaacaggctttccaaacaggttgctttcatttttaaaatttaattttcattaaatttcgttagcggtggagatccaccaatcagaaggcgccacgtagccttgagtgagctctatttaaaccactcctctccccccagagagaggcgacccacagatccagaagcagcaaaaaaaagagaaaaaaatcagagaaaaaaaaatgaggagcccgaggagcc

SEQ ID NO: 9741 - DNA, 1501 bp, Oryza sativa
ttatgttgggtgcttttatcatagtttactctttagcatttcttttcaacatccaattacttagatataataaaagtttaatcataaataaaattttcatgacttttcagacgtaccttaaaccatcgatacaataaattaatataaacatttgtatttttccgttcgtcacctcgtccgtacgccaatttttcgtccgtcgtctcccccataaaatcccaatcagaattcaatcacccccacccaaaaaaaaattcccaatcggaattcaatcacccctaccaacaaaaattcccaatcagaattcaatcacacaaataaaatcggaggtcgtcgtcgaaccgctgccgccgctgccgtcgcatggacgccaggctgccgccagctcccctcccgctggatccgggagagggggggcgccgctgccgccttccatcccgctggatccggcgaagggaagggcgccggcgcacctgttcaccgcctcccctcccgccggaagggagggcgccgctcgccggtcgctgctccgcgccgccgtagccgcttgggggaaggggggagggggtggcgtcaccgccgccgtcgctcgggggagattgggggcagggggagggggagaatgaatcctagggttagggttacggtttgggtgtatttatttaggttaggattaatctggaccgtccattcgatcggacagctctagttgctgccacgtcgggccaccggcctattgagtcaccgaatggaggacacaaaatggacttcaacggagaaaggaaataggccagacagattgaatagaaaaaagggaggttatataaacttttctatattcggcccaaactaaaaacgaggattttgattcattttccaattaaataattgttaaatgatgtttgtattattaaaaattagcaattaagctctgataatttcaataaaatttcaaagagcgtaactaatcaaggagaatttaataaaaatttaaccatgtcattttatttctcacacttgctttacttttaaattgatttaattatacacctacctacttaaaaataccaaatattttagcaaatttatattttaattaattacataatgtaatttttttcttaactttttctcaattttctggtctgtatgcttcccgttgcaacgcacaggtatttttgctagtaaaattattaatttaatagtattgtagtgattcagagtactagtgtgcttggttcactttttccattgagtatcggatttcgattgtaccataatttttgccgaattttcaaaaaaattgagttattttgattgatttttactactctaaattttagttcaccaaatcctttcgaaatttcacttgtaatctacttttgtcccgcttcaaaaccttgaaattttgcggttttcaatattttcattaaaccttggtagtgttaaggcatcgatactttaagatcctctacggtcgactgcaccacgcctttatcac

SEQ ID NO: 9742 - DNA, 1501 bp, Oryza sativa
gagacgaatcttttaaacctatttgctccatgatttgataatatggtggtacattaaacatttactaatgatagattaattaggcttaacaatatggtggtatagtaaactaattatgtaattagttttttattagtgcccgaacacaccatgcgataccctatataatacctgatgtgacacgccaaaattttataccccttcatctaaacacccccttagaatttatgatgtgctgggaggtattagttggatattcaaaacgataggatgaattaatgcataattaactactctatccgtcccagaatgtaagtatttttaaagttggacgtggttattaagaaattatgtagaattagatagaagagggttgtgattggatgagaaatgatggtatgtgggaaaattaaataatagaggatcttgatgttggtgtaaaagttgttatatttttatacaaattctagaggctagaagttactccctacatttacttttgatatgcatatttcctaatctaaaaaatttatttttgataggcatatttcaatctagcaccctatcatcttaatgactttctcatatttaacacgtgactctctattcttccacacaagattggctatatgggcatcgataaatgtaaatattaatgaatcgcttgtttacgaggaatgactagtagtatgcttaaatagatgataagtagaattgattatcctttgtctgtgtgccaagatgaaatatgactgtcaaaagtagatggatgaagtattatattttgggacggagggagtacttactagaaaaaaaagttttaaaaaattagtacgaatttttaaaacaaattttatactataattttttataaaaatataatactatttaataatttagaaaacgcgcgtgaaaaaattagcaggaacgttaggaacagaaaaatacagccttagatctaagccacgtttccacttccatcccgcggcgccgcccgctgtctgcctccgtccagcccccaccgtcgcgggcctccctctccggcgcgcgccgcctcggtcgacgaggaggcgcgccgcaccatctcagatcccaagtaagccccctacgtcctcccgccatggtcactaacccccaatctgaatctacttgcgcgatcgatttattactagattacggagatctcgacccgttttgtcgcgcgatcggtttatccccactatcagtactagtttagctacttactgtattttggtttatgaggtttgattagttctggaatcggtgaaatcagaaccaatgttgtggttgtggggcgcagtctagattacaccgttggtcgattggaaaggaaaatgatgatgaattgctcatcttctcagtgtcagcctgttgcatttgggaaaaattttggttctttggttatttggttataatactggagaagcaaattccccaaatcccctttgcgccatagaatcgttaaacatatatatgacag

SEQ ID NO: 9743 - DNA, 1501 bp, Oryza sativa
aattcatcatcattttcctttccaatcgaccaacggtgtaatctagactgcgccccacaaccacaacattggttctgatttcaccgattccagaactaatcaaacctcataaaccaaaatacagtaagtagctaaactagtactgatagtggggataaaccgatcgcgcgacaaaacgggtcgagatctccgtaatctagtaataaatcgatcgcgcaagtagattcagattgggggttagtgaccatggcgggaggacgtagggggcttacttgggatctgagatggtgcggcgcgcctcctcgtcgaccgaggcggcgcgcgccggagagggaggcccgcgacggtgggggctggacggaggcagacagcgggcggcgccgcgggatggaagtggaaacgtggcttagatctaaggctgtatttttctgttcctaacgttcctgctaattttttcacgcgcgttttctaaattattaaatagtattatatttttataaaaaattatagtataaaatttgttttaaaaattcgtactaattttttaaaacttttttttctagtaagtactccctccgtcccaaaatataatacttcatccatctacttttgacagtcatatttcatcttggcacacagacaaaggataatcaattctacttatcatctatttaagcatactactagtcattcctcgtaaacaagcgattcattaatatttacatttatcgatgcccatatagccaatcttgtgtggaagaatagagagtcacgtgttaaatatgagaaagtcattaagatgatagggtgctagattgaaatatgcctatcaaaaataaattttttagattaggaaatatgcatatcaaaagtaaatgtagggagtaacttctagcctctagaatttgtataaaaatataacaacttttacaccaacatcaagatcctctattatttaattttcccacataccatcatttctcatccaatcacaaccctcttctatctaattctacataatttcttaataaccacgtccaactttaaaaatacttacattctgggacggatagagtagttaattatgcattaattcatcctatcgttttgaatatccaactaatacctcccagcacatcataaattctaagggggtgtttagatgaaggggtataaaattttggcgtgtcacatcaggtattatatagggtatcgcatggtgtgttcgggcactaataaaaaactaattacataattagtttactataccaccatattgttaagcctaattaatctatcattagtaaatgtttaatgtaccaccatattatcaaatcatggagcaaataggtttaaaagattcgtctcgcaaattagtcacaatatgtgcaattagttattttttagcctatatttaatatttcatataggtgttcaaacattcgatgtaacaagggtgaaaattttagggtgggatctgaacagagcctaagtgtagctt

SEQ ID NO: 9744 - DNA, 1501 bp, Oryza sativa
agaatttgacaacaggcgtaattctaccaaacttcatatccgccctcctcctcggattaggattccattgtcccatgataagcctccatcctgcccgatgtcgaaaagcattaggccagatccaaccagaaccagcacgattaacctgatcaccaacccaattacagatcgcagacgtgacctccgcagactttctgagcagatcggagagaacctccatccagatcctcctttcatgggaggagaaggctgccgcaacccagtcgcctgggtgccgcccagaccctaactcacgccaaaacatgtttgtacaagttaaaggcaacttgaaaacaatataggagtatatgaccaccaatcaaacttaaatcactgaaatatcgcttacctttcatacattcatcagttgtctggataagagtggataaaaagaaaacctaataaatgttaatgtgatgaatttgatgacaatgaccccgagttattttttcaaaacacggaagatgctcacatacattgatgcacatacacgcgcaccacctataaccataccggagagactgtcatttctcaatattgacaaatttattaccacagatagcaacaataaaatttaaaaaataattaatcgtaaatacgagcacgtgcatcagatataaaacttaataaaaacttagattgatagagttacagttttttttaaccccgcagtgtatacttgtattaaaggagaggaagccactgtatagtagccttgaggctaagagttaccgttctagtcaggggcggatccagcgtggggcggcggggtctcgagcctccactactactgatgtaaagactatgagagcccccacaaagaccccactaaaattttttaccatatataactttatctagtttgtttagacctcattgctatttctttattgatccgccactgattctagttcatgacaccataagttatcgatgtgatccgccactgattctagttcatgacagcataagttatggatcacatcgataaaaacatatgccggtttagttctcaaccgctgtactaattctttagctggtttcaaacaaaataggacaagcatataaagatgcgatggaatttgaaaacataagatgccaagtggcatatctctactgttttgccagtttgtccacgagccaaaagaaggctccaatgagaattcccccgtacatgccggggtggcgccacatgacaatgactgacaggctggccccacgtcctacctggctggccccacccctgctctttctctttctcttcttccctttcgtcttcgtcttcgtcgtcgtcgactcgtcgtggccgccggcaactcacgcccaccgcgcgcgcgcgcgaattaatacaaacacattaacacacacagagagagaaaattggcgcgcctcgcgctgtgcgccttcgaattttggaggcgacgcgcgggaggacggaatcggccggggattcgctgcgtcg

SEQ ID NO: 9745 - DNA, 652 bp, Oryza sativa
gcgagccgccgcgcgctgctcatcttccacaggccgccgcacaccgtggcctcctcgccggtgaagactcggaggtaatagaggtagagaggggagaggtggacgccgccgccttgccgctcctactcgcccgccgccatcctcgccacgccgtttcccatccaccacgccacgccgctttcccatccgccaccccactgcgcggcgccgcccctccgctggccgctgcctgtctcctcctccccgtgcctccgccgccgcccaactccaaggcctcccccactggcgtcgcggccctcgcacggtcgccgaggagctcggccgggctgccgcggccgccggccgccgtcgcggcgccgcccttctctcccgcctcggcccgccgaccggcctcaggctgtcaggcacagagagcgagaggagtaaccgaggaagagggggagagtgactcagcctgataagtcgggcccacgtggatcccatgctgactcagctgccacgtaggataaaaccggaatcggatccaccgaaggactgaccggttttaattagttaaggggcgccggatatctggttttgcagtttgcggatgattttgtaactcgatgataagttgagggaccttcggtgtactttttccttgtttgaaagg

SEQ ID NO: 9746 - DNA, 1501 bp, Oryza sativa
cctaactggttcaaagtacctgatttctcaaagttttcaggacaagacactacatcgacttatgagcacattagccgatttttagctcagtgtggtgaggcatcggctgtagatgctttgagggttaggttattccggttgtcattggctgggttggcttttacttggttttcttcgctgccacatgggtcgattaacagttgggccgatttagaaaagcagtttcatagttatttctatagtaggattcacgagatgaaactgtctgatctcatgtcaatcaagcaaaagcatgatgagccggtacatgagtatattcaaaggttcagggaaatgaggaataagtgttacagcttgagcttgactgatgcccagttagccgatttggctttttaagggatgattgctccgatcaaggaaaaattctcatctgaagattccgaaagcttgtcgtaccttacacagaaggtaggtttgcatgaacaaaggttcgcggaagctaggaagaactctaggaagattaatcatgtttatccttatatgtatggatcggatggtgaggatgatgattctgaaatagctgcagctgagtgggttaggagcaaaaaggttataccttaccaatgggtgaaaaactcaggaaaagaggagaggtatgactttgacataactaaggctgataagatatttgatttgctagttcgagaaaaacagattcaacttcctgctggacatacaattccatcggctgaagagttgggcaaaaagaggtattgtaagtggcataattctgggtctcatacgactaatgactgcaaggtcttcaggcagcagatccaaacggatattgagggaggaaaaatcaagtttgatgattcgaagaggccaatgaaggtcgatggtaatccttttcctgttaatatggtacatacagctggccaatcagccgatagcgtccgtgcaaagggttttcaagtgaattcggctaagataatcaacaaatatcagaggaagtatgagaagcagcaggagaagcattatgaagaacacgatgatggttttgatcctcattggggttgtgagttctttagattctgctggaatgaagggatgaggttgccgtctatcgaaaactaccttgggtgcaatgatatcattgagagctcaagtcagtcatataataggagtaatcggctgaggcaggaaagagtgtctgttcgtcaaagattgggcccagtgaatcaaggtcgtggccaggaggatgacgtagtcaggacaaatcaatggtgtccttctagtattttcatgaagaatcagaagagaagggttcaaagattgaggaacagggagcgccttcaggaggttgaacaagaaattaaccatcggctgaagaaagcaaaaccaagacaggaattgcgtgttaagaatcagattcctatagccgatgatgttgtagccgatgaggcaaagaggttggcaaaagggaagagtgttgtagtgg

SEQ ID NO: 9747 - DNA, 1501 bp, Oryza sativa
atcaaatcagcaagtagagcctttacagtaagctttcagcctagtctcactgtgcagactctgatacgcacagcgattaaaaaggctttttgtctgtaaactatcaggaaatctgcctagtaaaagatagcatactttcattgcgaaatcatgtttggggtctttttctatgttttcgacaagcagacctaggtcgaatacgaggtgggattcatttcctgttattttgatccctcatgatctttctttcctcatccaggaaaagaggtcacctcagatgatctagggaccaacagactctacaaaagtcccagagaactattaaaaaagtttatataaaaaagagggatagagagagagagattaagagaggggtggagagggtgagtcagaaagagagagaaaagggggaagaagttggaggagaggaagagggagaaagagaaagagagtgagagtaagagagaggagatagagagagagagagagggtcagagagagagagaaagagaaaggaaatactgcctctgacaatgtctacctagtcagaacaaattaatattggtcgtattcctctaaattacatgttatgatagaaacggatatgaatcaaaacggtctttttttccttcttctttttcaaggggaggggtatttctcgttatgggttaagacaaggaatcaatacattgaaagtagctgtcaattcctagttatacaaacacctggaagttatacgatttctcagacctcgacataaaagaccaattaaagggacttggtaacgttgttcaaatgagggaaaatggtgctaaagtattagtaggagtagtagtttgatgacttttccgtttggtaactacaatgctagatgtacaattaaagataatctgaaagtttgagtgaaagcagaacattattaatgataaaaattagaaaaaaattatctgatggattccttaattctcccagctatattattataatttgattacattttaggtgaatgtaaatcgtcacaaagcaatgaattggctctatataccattccattcatggaaaaacggtttggaaaattaaaagattggttgggaaaacttactgttagaatgggggttacatatctacgccttcaaagaaaaccataaatatctttgaggtttgagaattttgtcaggatttgtggcatgttagagagtaagtacagtagaaggaagataacaagtaacatttcataccaaagttacgcattttttcatcaaccttcaacaatgttaccggtttactttaaggaactagaagttcacaacattgggcgcaataaaactcgttgctgcctgatacgaacgtcaattgagcgtttgccgtcgtcggtgtggcaccccttttgaattctaacctactgcatgatcagtcaaggtgctgcagattcctcctagatttggtgaagacgaaacaccttgccgaagacgttgtcaatgaatgggtgtctcgatcacca

SEQ ID NO: 9748 - DNA, 1501 bp, Oryza sativa
ttaggtggtctgtacgttatacagcccacctgaaaagagcataaatgcccttcttactattatctactcaaggaaaccagtcagcaagcacacactccgaattgacacaaatcctaaagcatgcattgagtagagtctagctctgtcagtctctggctgcatcaagagattggtattatttcctgttattttgaactctcatgatctttctttcctcaaccatgagcagagttcacctcagataatcaaaggatcaacagactctacaaaaatcccagggaactatttaaaaagtatatagaaaaaagggagagagaggggaagctctgtcagtctctggctgcatacagagatgggtattatttcctgttattttgaactctcatgatctttctttcctcatccatgagcagacttcacctcggataatcaaaggataaacagactcgacaaaaatcccagcgaactatttaaaaagtatatagaaaaaagggagagagaggggagagagaggggaagctctttcagtctctggctgcatcaagagatgggtattatttcctgttagtttgaactctcatgatctttctttcctcatccaggagagatgggttttatttcctgttattttgaactctcatgaggcccaacaaaaaaaatcatttggttgttctcgattgcttttctggagtaggggcgggcgggtggattttttttattttgttattatttgttttataaatatttttccctaacaaaaaaaaagtcatttggatgtcaagcatttcaacaacaaagtctatacaacactttaatatggtaaaagactagtttgatgtacaatgaatagcaaatccaatacagaaagtatttttggctttgaaatacagcaccttttaaattcccactgtactacttatcggtacttgcgcccataatattccaaacaatgcctaatcggtggccattggtcccccatgatcctctttatattttggtaacttagagctgatttgatgagataaccacctgtccagtgaccttgcagggtggtctaatccctcctgtaaactagtacagatgtgctttaaaatgaatttaagaatgctcagaacctgatttaaatgaacggcatttttgacatataaaaataaaaatgacaagtttaataaatacagaattgcgtactgaaaagaccaaactggcaacaggacgcgttttgatccttgcaaaatggtatgtttggcatttaagattactcccccccccccccccagaacaaaaaatcaaatacaaaaaaaaatagaattaaaaaaaaataataataataatacgagcagcccaaaaatgacgagcaggcggtcgaggataaccaaattattattatttttttttttttgggggggggcctgatctttctttcgtcatccaggagcagagtttacctcagataatcaagggatcaacagactctacacaaatcccagggaactatttaaaa

SEQ ID NO: 9749 - DNA, 1501 bp, Oryza sativa
ataatgggcgaactatctttcatcacgtgatttacttttgaccaatcgtagagcaatattcttagtatgtggaatataacaagaaataataaccatctcttgatgcagccagagactgacagagcttcccctctctttcccctccctctcttccttttttctatatactttttaaatagttccctaggatttttgtagagtctgtttatcctttgattatccgaggtgaactctgctcatggatgaggaaagaaagatcatgagagttcaaaataacaggaaataatacccatctcttgatgcagccagagactgacagagcttcccatctctctcccctctctctcccttttttatatatacattttaaatagttccctgggatttgtgcagagtctgttgataccttgattatctgaggtaaactctgctcatggttgaggaaagaaagatcatgagagttcaaaataacaggaaataatacccatctcttgatgcagccagagactgacagagcttcccctctctttcccctctctctctcccttttttctatatactttttaaatagttccctgggatttgtgtagagtctgttgataccttgattatatgaggtaacctctgctcatggttgaggaaagaaagatcatgagagttcaaaataacaggaaataatacccatctcttgatgcagccagagactgacagagcttcccctctctctctttttttctatatactttttaaatagttccctgggatttgtgtagagtctgttgatcccttgattatctgaggtaaactctgctcctggatgacgaaagaaagatcaggcccccccccaaaaaaaaaaaaataataataatttggttatcctcgaccgcctgctcgtcatttttgggctgctcgtattattattattatttttttttaattctatttttttttgtatttgattttttgttctgggggggggggggggagtaatcttaaatgccaaacataccattttgcaaggatcaaaacgcgtcctgttgccagtttggtcttttcagtacgcaattctgtatttattaaacttgtcatttttatttttatatgtcaaaaatgccgttcatttaaatcaggttctgagcattcttaaattcattttaaagcacatctgtactagtttacaggagggattagaccaccctgcaaggtcactggacaggtggttatctcatcaaatcagctctaagttaccaaaatataaagaggatcatgggggaccaatggccaccgattaggcattgtttggaatattatgggcgcaagtaccgataagtagtacagtgggaatttaaaaggtgctgtatttcaaagccaaaaatactttctgtattggatttgctattcattgtacatcaaactagtcttttaccatattaaagtgttgtatagactttgttgttgaaatgcttgacatccaaatgactttttttttgttagggaaaaa

SEQ ID NO: 9750 - DNA, 1501 bp, Oryza sativa
actgacagagctagactctactcaatgcatgctttaggatttgtgtcaattcggagtgtgtgcctgcagcctagtttccttgagtagattccttaaccatgataataataagaagggcatttatactcttttgaagtaggcctgtgtattaagtcaaaatccctctggttcaagttgtatgttaattaatatccatagtgttatgaataacgatagagtcatgtgttaaagaattccccttttttattttgccatatgatctaatcggtcgaaatgcgacctcttcaattttttgactcgttcccttagctcgcgtccgacgatcacactcaactgcaaggcattgtggtgaagcattatcttagaccacgtcgagagaaaatctttaaagtcatccctgagaatgtagtaggagtatatataaatgtttaaaaaatggaattcttctccagtgcaggtgcacgttcccccacccagaaagtaccatctttgttggagcccccccccccccctcacgttacaagatgctccgccaccactggatcatagtcgaccaaaggttgataccccctcccccatgcctgagcctacactacgccactgtctatcattataatttataataattacagaaagagagagagaaagagaggacaaaagagagagagagagagagagagggaggggggggggggttggggtagggagagagaaagggggccatgtctttgtagtttaaaagtcattcattaggacgaattatttttgttttaatcgccattttcatgtttctggaataaagacaaaataatgctatcaatatgtgtataatatgttttagaataaaatgagacaatacagaaaacagatctatgaaattgtctttaaaggtaggtatcccttttgcagccaacagccaacatgaattatgaatttgtcacgtatgtcctatctgagaaatgttaactttagcagtgccctactattcaaatttacccgtttactttttagacttcactgtcagacactattgagtgactgactgaccttttttctttggtaataacatacataaaatgagctgtaaatgatatgagcttttgtacacatcactaacccgcttcttgtaatggtcaaaattaagctgcttaaatctttgcgcagctcaaaacgtaagaccgcacgtaacaaggctctgaaaatcagactattttcgacgcattaatttaaggagcgcgtttcgtaaattcctaccggtcgatagatttcaataaagcggcaattaccagttctaatcttttaagatgagttttaatttggtattatattttgtttaccccaggatttacataattctatattttcagcttgcaaaagggacacacctcctttaagagagaaggagagatgatttctatcgaaatgaaatgattgtttgtttgtttgtttattttattttagcacggtagcacttcagccaatggctgttcttcagcatggc

SEQ ID NO: 9751 - DNA, 316 bp, Oryza sativa
cgctggttttttaatcccctggggcaagttcaacttccgtgctcaaaccacgtaccactaaacaccttcgttgatgggtaggtatttatatttgttacggtcacagatcaacccgcaagcgcacagataccgatgtagcacttcagctttagagtattctgagtgtatcgaatcatagctaaggggtgtgtatatcaaggaaagagattttatccaaggacaataactaatggtacgctttggctagaaaggacagcaatggaataattaactagacataacttacaggcctgtagctctatgatgtatccaaaca

SEQ ID NO: 9752 - DNA, 1501 bp, Oryza sativa
cgacaccattgattagtgtagatgaattcttgattgatgtttgcaggtgttgttcgtgatatttgacctgacggagaagcgatgcctttttatgttatggatctattccttttgaccaagttcagctcgttgtgccagggcatcactttgagcttgcttttgaagattttgattaatgcgatgatggttattctgaattcacgttgctttgccatgataatgttccgtttttcatgaaacaactgtttggcagttggttgttaggcaagataaagcctaggagattactgttagcgaagccgtagtacacaaattggccgtctcctagggttgtagccaaggatggcagaataagtttttgttcttaaatcctttagtggcatcaaataagtctttgtaagcgaaacggtgcgggccatactcaacctcccaatcttcacgtacctccttataccttaaatgtctcctcacgagtaaaacaatagcaacaccaatagctagtacgaatattgctgatgctattggtagaacaatctctaagagtttggattgaggttttggactaagattaggcagtttaggtagctttgtggggtcaatgattggagcaggaatattcagcccaaaactccaaccaagaacatagtgatgtcctgtgcttaagcccgttgaggatgagaagccaaggtatgcttgatctgttagcactgttgagaggttatagactacaaagagtagtggcctcttaggtcttccaataccaagaggagctaatgtcacgtcaatttgtgcggcattcccgtcatactctacccaaacttgcattggtttatctccaatgaggctcacatttgtgagcgcgccattgttgtcattatagaagccggcataagaggatcttactgagttgagactgttgatatcaatcccgacatgattattgtcgatgtctccgaactcatcattcctaatggtatcaagctcaattgcaaagaggtgattggtcgaactgccattgtttatatcattaagaagacccaaaaattggattggaaaggcagtggagaaatcattgcttggggcaatgaagaaagcaaatccatggcctcttatatcaccaaatgaagagagaataccaaatacaaaggagacagagaaagattgcaccgtgccattgggggacttgcggaagcgtagcggagctgggtgagatgcatggcctttgatccggaatgaatcgtttgtcagcccaagaaggccggtggctgtgatttttgctgcaccatctagagtcagattgctaccggtgaagccggtgtagatgaattggtcatgatctccactagcactgatggctgaaaggctaatgcttatggtaaggaagaggatgactggcgaagtgtgcttcatgctactagtcatagcagtggcaaattggttgattaaaagatggcttgcattgcaaccatttatatatagggcacactcacatcctgcaaag

SEQ ID NO: 9753 - DNA, 1501 bp, Oryza sativa
gtatccttttatatgattattaactagcacggtggcccgcgtagattgcgcggctagcaccattatatttgttttcttatataatagcttaaaatttttaatactttattactaaaatatattaaaaatagcaacacaatatttattttttattatattgatagttattaattattttctactttcaaattttacttatttttaattatatttctatatggactctaggctcttctcttattcttgcttatttttaattttagttatttataaaattttctttctatatgaactataaatcctacttttaatttttaaaattattttaattctgacttccagtcagttctgttcttcttccaatattcttaattttaattccaaatttccgttactataaattgtattcctacaagaactctatttccaatattccttattttttaaattccaaaataaattatattcttatgtcacatcctgattttcgtttcaggatttataaattatttaataaattattaatagaatttatattaaatgttctttaatttacaagtgaagttaaatgtgggaataaaatttcctaaatttaaagcatggatggatttaatttttattaaattctccatgcttaattatactctctgaaattttctcggatttttcagagctcaattcctaaatgatacaaagaacagttcagtaattatttgatcaataattatctaattataattgttaagagcttttcttgtttaaaaatccttaaattataaattgttgtttaaaaggaattattagaaatgattttaaaagcctaaaagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaaggtttttaaaagtcttcttttggctttgggccgaaagtcggcccaaaacctctcttctctctctcctcggcccagtcggcccagtcagcccgcgctcctctctctcggtgtcgctgacaggcgggacccacctgtcagggtcgtcgtcctcctcgcgccgccgccgccgcccgaaccctagcgcaagccgccgccgtctccttccaagttcggccgcgtctttccttctccggccgaatcttttgaggggaaatgatcttctcgacctcctcttccttttctcttttggaatctccggtcaattcggtttggaaactcgaggattcgaagtcgaatcggatccatctctctcctccgaaccccgttctttccttctcgccgccggtcgccgtgggcctccgtcgccgctcgatagcccctataaaaggacccccgagctctcctctacccgccgcctctctcgccttcgcccgccgtcgtgtttagcgccgcctccgcatagc

SEQ ID NO: 9754 - DNA, 1501 bp, Oryza sativa
atgggaatagggtggtttctcggggattagtgggatggatgggaagaaggcgaatcagcagtgggcaagaggcgccgttgccgccacgggagctatggggctagatcaggaaagtggtgggcgaggttagcgacgaggatgtcttggtggtgcgagctatcggaaacatggaagacgagcgaggtaggggaatatttgccacactatttggggaggagaatatgagaggggtgagaggggggaggggtgggaagagggaagcgataggcacaggcagcgctcattgttagcagtgggactaggaagtagcgaattggggatagggagatgttgtcgtagtgcgagtggctcaatctggtcgacgcattgtggaatcgggggagagagggtagaggggaagatagggtttcatgtgctgcatgaatctcggtgcaatctaagccgtccaaacgtgactaatttttttttgatactttcaggttacttgaaactaaacagttccattaaaaaaaactaaaaattgtggcgttcctattcttcactaatctgcttttatctctcttttgctgatgctaactagcgctttaattaataatttcagctgatcatcaggctcaactactgctagaagacagtcctatcagcaaaaacaaattggtactggtattagtaagctgagggttgtcacgtacgacacgcacacgcgcactctgccaacactaccaacacaaataaattcagcagctactctccacaatccacattactccagcagcacacacactggtactgcactgcactactgctgctctgcctgatcacacacactcacctctcaccactcaccacatgaggtttatcaatgctgcactcactcacctccatgacacctggaaacaccagccacctgcctcaccaattggcctcttcatttcactcctctcactcccagtagctgcaaaaccaaacaccctatcttcttcttcctcaactactactcctgttcttgctactgcctagctcagctactctgcttgcccccaacctatccaacctactaacattgtagtacactacacacaagcctagcttagcttaggttgcagctgtgtgaggtggggatccagatcagctttgctgttggagagatccatccatccatatagctagctgtaactacatacagttgttcattcagattcaggcattcagccactgcctgatttaggtgagggaagaagaaggttcaagcaactgcacaccagatggtccatctcttgccatgcacccatgctcacttgcccctgcctctcttcttctccatcctcctcctcatcttctccatggaggtggcacattcagatgcaagtaagataccaagatccctctctctttttgctttctttctagcattagcttctcactcaaccatatttgtacttcttcatatgcatagggaggttgccactgaagcttctagaagttggcaacatcaaggtaa

SEQ ID NO: 9755 - DNA, 156 bp, Oryza sativa
aggagggcggctgtctgccgaggagaaggccgatgtcggggccaccgccacggcagtccgctccatcgacgggcgcacggccatcgccgcggcgtcgggcggggtagcggccatgggcaaccccaccgccgccccttcgccaccccgtcctccagg

SEQ ID NO: 9756 - DNA, 1501 bp, Oryza sativa
gacctaaaacatattataggtaacggtttttatttaaagcggaccctatctctcaacaaaggtaccggttctagccgatggtgtgccatggatgcgcgttttgggtggaaaacgcacaatagctaggtttcggttttaacatttccggcaaatatactgccgatcgttatgttattgcatgcgcttctacaatttcattcaccaaaaggctaatatgctggagtgcatgctagcatgatgatcaacattttaaatcatttgcgctattctaagctagtaataggtatgcactgtgcttttgctagccacctaatagaaacaaactaaagggactaaaagtaacgcactgatctataaatatcaattgtttgtacaactatatattatatcaccacatgaggatcactatcatatgcgggaatatgtgggatcccagttgcttctgacacagctgtatttcctaaaactctcctattccacaatctccaagtgaatctagttaattagtagttaactaatttccttgaagaaatctctcttctcaaaatcatatggaatgagtgttcttgagttcatgttttagcttacaacatttcaaattacagcatattaatttcacagggatttaggtcctgtttgggactactccagattttagacccataatagacttgaagtttatacattcaattacagttgctttaaaaatttaagtttcatctgcaatatgcacaaaaactttatctaaatgttatcaatgtaatcatagatctagatccatgaatttgtgaacctaggaatatccagctccgagaaattttggattcagagttgtgccaaagagggccttaatattacgcgtaatggcggaaacagaactccagtctcggacataaattttaagaatttaaacattgttttcttctgacctgaaaaaaaatgctggaaagaatattctgccaggtgggccaacacagaactaaaatttcaatccagaatttaacatctgcctccaacctatgtaaatagtgagaataattctaaaaataagtcgagaggtactttgtaatgcatctatcgtcctaccaaaagttgagtgtaaattatgacttatatagaaagaaaaaaaagaaatagcatctgtgtgtaaagtatgtaaaacattttcaatagtttagggtgtagaatgagctaaaaactagtttatgggctaagtacttcaatgaaataatttagaagagtgaaatggtgttaattttctcattaatatagatatattactatacaaacatgcaagttaaatttgatccatagatcgaagaaaaaaataaattactcttgctaatacttgtactatttacagttaaaattttcttcttcatttgcttgtaatatgtttgatttaatctagtgtgattttaaggaaaagacgtgcatttgtaaagtgatatatcacccacgcatataatttatattttcaattttttcataagtacttttt

SEQ ID NO: 9757 - DNA, 584 bp, Oryza sativa
caaccgggactaaagtcccacccctttatatatatcttcttcctcctccagcccgagcaagcttcaaaatttcttcaaaaaagaggggaggtcatgccaaaatttatagtgaatttactttggtgattatatacaaatcggaggtgcctaaaaggttagcaactttatcctccaatgttttttttggtcatattacatttggagctatgttttgcacacttttttgcctccaaaattttgttgtaagttgatgagagagaaaatttgtgtggaaaagaaagaatatatacaaattttgtttatttgctaaataaggttttataaaatagttgagtaggaaaatatagtgaaagttaattttaaataaaagaaatcaaactaaattgaaaattaaaagaatttaaaacttaaaaaataataaataagaattatttggtggaatattttataatttttgtatgaataatgatatgtcattattgtatgattattgaaagagtttgtgattattttatcattattgtatgactgtcattattgtacgaatgattatttgtgtacgattttttttcatttcatgtaga

SEQ ID NO: 9758 - DNA, 1501 bp, Oryza sativa
tattcatgatccttgagaagcgctgatcacgcttgctcggcttaccggtaatgctaagaggatattcacactgcagtggatgtacactttacccacactccacgactgcccaacacatgagcctcgtcccaacacatgagactcgtcacggcaaagcttttcgataaccttgcaatggcagtacccgctccatgaacctaaatcctcatgcactctaggcgtccatgtttctagcagtgagaggagttctggctctcccgggaaagagaagtctcacacacatattaaattatggttcaagttaagttctctctcacacacactcatggcagtcctaacaatggcgacaccgatgtagggcacgcctctcggccctacctcaacggctgtcccaccgtagcgcacctgcctcactcaggggtgaaccatctatgcagagatactgcctccgctcggctatctaatccactaggtctatacccatacgagaagtgcggttgtacgggggtcgtttcatgcttaacttcatggctcggtccttaattgaccggggacggtactagccttttccatataccacccaaatcctccgtccgccccagtcgaaaacagttgtttagttttatttctcctttcgcaaatcatgtcatcaatatcatggcaatgtggtgctcatgtctccacatgccgcatctcaattaccttcccaaaggcaattgcccaagcatatagcatttgataaatatgagtatgcatgattctagaatagcatttctaagcatttgtcacagtggcggcaagacgcgtcggcgacggcagaggggaggcggagcggcgcgcggcgcacggggcgcgaggtagcttggtagaggaggggctagggctagggaacgagatgcgcggcaacacgatggtgcgcggcgcgacggcgacggtgatgacgacggcagaggagggggctgggttagggggaccacgtcgaccacctagagtgcaatgaacagtgcattttcctatttttctcattttagtctatttcttttataaatttgattccacaattcctagtttttgcatatatggattttactcaatatttgtgttatcttaactaatgaattcaccctagactaatattacccatattttatttatataatttatttgaatttttaattagggttaattcttattccatcgcatttaaatttaattgatacaaatatggtcgtggtaatattttatttatttcaatccacacctaatctttattttaaattataatttatttatttctttaaccaagctaatttcagggttaattcctaattaatttttcctctatgaactccgagatcaaaatctaataaaatcatcgaacaaaatcggcatgatgcaatttatttataaagttttcgaaggtccgcatttttagaatttcttttattggtcgaattttttgggtattaaaaaaccgattgcaaaatagcagccttccctt

SEQ ID NO: 9759 - DNA, 1501 bp, Oryza sativa
acatgtgtgttagttgagcaagaattaatatcaatgaaaaaaactacacaaaaccagatagtacgtgaaatagacagggcgtaccgaacgctcttggaatctgctggctagtatgcagcgccttgcagttgatcactgacggacactaggcctgagatatgcacagcttggaagctacaactgaaagaacaacacgggacaagatctgaacttagtggtagtgtagtttatgcatgtgctttacatttaatcagcgtctatgcatgtgctttacatttcattagctcaacaggcttatagctcacgttcgaagctaacctgatctatctttttaatcagttgattctataaacaatgacaaattaggtgaacctatttacataccgttagcgaacatggtataaacctgatggctgcctccctctcgacggcagcgtgcgcggccactcccctccctctccttctatctcccctcccctccccttcctgccctccctgcatggccggagggggaccgccggcagagcgcggacgaggcagcacgacctctcccctccctctcctcttgcttccctcctagatccgatggagtggatgggcatcgacagtggtgcgcctagagaggagggtggcgtcggcagcagtggggtggcatgggggcggtggatccggcaatggtgacgcccttcgcttgcgcctccaccggaaggaaggaagcggaggggagggagccggagggaaccgcgagagagagagagagttgatggaatgagtggtggggagaggataagatggaagatgagaagataagataggacttagttttttttttcatgtaggcatgattttttttaggcggagcacataagtttccgcctgcaaaaatcatagaaataaaggtattttcgcaggcggacctcttaagcggttcgcttggaaaaatttattttcgcaatcgaatgatgaaaatccacctcggtttacattttcataagtgaatattgttagatttaattgagtaattgattcatttaaatcattaattccaaggctcattatgctaggaattcatgtgtattcattctcttaatgggatatcaatgggatgaagagttttgataattaatccatttgattggtgaattggtaacttatatcaattactcctgattgatggatggttgatacttgtggagtgaagaatggttcatggctagttgctagttgatgacaattagttggtctattgctcttcctattccgttggtaacctacatcaattactcctaattgatggttggttgatggttgtgtaatagaggatggttgatgggtaattgatgagaattagttactctatttctcttcctattccatgactcttactcttcatcttccattcctcctataaaatgagaatggattttatcttcctaaggagaagtgagacacactttcatccatttccaaggcttttgctgctacggtaatcccatcccga

SEQ ID NO: 9760 - DNA, 500 bp, Oryza sativa
tgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtggggaatgggatattgcatgatgaattttatgctgatggagccacttcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatgctaggttttaggcttgtgaaaagaattgtaaaattagctttatccaaaagaacctgaagccattccttgaaataccctctatcatatgcattgttgttgtggtggcttgctgagtacggttggtactcacccttgctatttatatatcttttagg

SEQ ID NO: 9761 - DNA, 742 bp, Oryza sativa
cttcccctccccctcccctccggcggcgccgccccctctccccctccccccagccggcggcttcccccgccaccggcgccgcttcccttcccatctccctcctttctcgccggctcggcgcggcaacggcggggttcggcggagacggcgccgtcccaacggcggcgacgacggcgtccgcggcggccgcgctccctctcccccctccttcccgtctcgtcggcttggcgcagcgacggcggggtgcggcggagacggcggcgacggccgtccctccccccctctctctccccgtcggcctcgacggcgacggcgccctcccaacggctgcgatggcgtcggcttcatccgcgtgcggattcggcagcggcggctccctccggcggcagtggtggcgtcggcggccgccctttttttttttttgcaattttttccatggctattgctaaccgaataggattgtgcatggacaaaagatggacgaaaattagatgtcatatagattttttttctagatcggacttctttttttttcgcacttttttacgtccggttattttggatcggaaaaacctggtttttttcgcccggtttttttttttcaccttttttgttggatcggactttttttcgtccggtttttttgatcggacaaacttggttttttctacccggttttttttcacccggtttttttgacggacgatggaagcacctcttattttttaagtagtagtagagt

SEQ ID NO: 9762 - DNA, 1501 bp, Oryza sativa
gaactagctagttctgaatatttgttctgcttcaagcacaacatctccatgtgttctgaacttaaatactgagattcctgaagaacagattctggaagacgagtgcattccatctgaatacgcggtttgcagacgtcggctcggtgacgacacatgagtcagaagcaaatcaggattcgataacgttcatgctttccttgacttgacctataaagtaacgtccttattactcccgtcaatgaatatgtatatcgtcgtattaagaagatagtgcgctgcatcatgcacctaaccggcctgatgttctttttcaatacgggtgaatccgaagagaatgatgactctctgaatagtggatgaattattagatcggagggattgtggttagggaatcttttaaaacatagacactattttacaggatttttatagaaattaggaagcaatcactacttaaaaaaagcatttttgccaacgttgggtctctttttccgcagacgggtatgaccctcggagccaaatatctgttagaaatttaatcataattcggcatattttaatccaaaataacaagataataagcatgttatttacaatgagcatgcttaacatagcatgtaatcaacatgagcatgcttaacatagcataaccatcaacaatcacataataacgcaatgttgacattgcgatgaatattaacggtacaacttctaattgaaataatgtaagatggttataccccaaaaaaggtcctccgctggagtttaaggcagtattgcctctgttggtgttgacaggagcatccttctccttgtctccagcgttgtcgttgtctttagtgttcgatatgttagtgaagacaaagtagacgttgacgaacagtcagtagtcgcaccttgcgctccccaaaaacctgatcgcccacccgtccatgcaaacgtcgtagcagtgcgtggtttcggaggcctattctctcaaagcgtgtgcacacactcgtcgggatgggattaccgtagcagcaaaagccttggaaatggatgaaagtgtgtctcacttctccttaggaagataaaatccattctcattttataggaggaatggaagatgaagagtaagagtcatggaataggaagagaaatagagtaactaattctcatcaattacccatcaaccatcctctattacacaaccatcaaccaaccatcaattaggagtaattgatgtaggttaccaacggaataggaagagcaatagaccaactaattgtcatcaactagcaactagccatgaaccattcttcactccacaagtatcaaccatccatcaatcaggagtaattgatataagttaccaattcaccaatcaaatggattaattatcaaaactcttcatcccattgatatcccattaagagaatgaatacacatgaattcctagcataatgagccttggaattaatgatttaaatgaatcaattactcaattaaatctaacaatatt

SEQ ID NO: 9763 - DNA, 537 bp, Oryza sativa
catcgaccgagcccgtcactggccgcgcgtagtcaccccggccagatctggcggggcgaccggaactggcgacgccatcgccggagccgcgcggagccccaccgccgcgccgccgatgccgcagagagccccaccaccacgccgtcgccgcgacatcaccgtcccgccgccgcgacctcgccgcccagccgccattgtcgccacgcccgcgccagggcgagatggagccaagagagatggccccgccgccgccatcccagcgcgtcgcccggaattgccggcgacgagctccggcggcggcgaagcaaggaggagggagggggaggggcggcggtggctagggtttcgcccccgagccgccgcgcgagggcgacgcgagggcaccagagagtttttttttaatatgctacatattatgaaattacatttttttaattccataataaacaaaataatttaaaatttttgctacatattaatcaagccaaaaaatattgtgaaacacataactgtgtaattgtttgttcactttcaaaa

SEQ ID NO: 9764 - DNA, 165 bp, Oryza sativa
cgcgcacgcacgcggacaagggccggaggcggcggcgaggatggcggcacgcacgcggtcgcaggctcaaggcctcgacctccctccgccgcgcgcgctcttgtcctcgacgcgccgccccatccacgccgagttccgcgtcgtcgtcggtgtctccagcgggga

SEQ ID NO: 9765 - DNA, 197 bp, Oryza sativa
ctgcttccagtcgatgccggggagctccttggtagaggtggcgtgcggattttcggtgtcctgttcgctggtcgtcggccgcgctgttagtttgctgcagctgggttcctgggtgtgaggtggtctctggtcgagctgcagggtgattggctgttgaggcggagtcggagctgcttgtcttgcaagctcggcaacga

SEQ ID NO: 9766 - DNA, 1501 bp, Oryza sativa
atagtgcagccacaatttcaccaatacaagaaaaggttgttcctagccacacgaacataagatttcttcttaaaaaaataacgccaactgtttgcttccttactctatgaaaaagacaatcacacaaagtatatactatttattttgtgcacaaaataaaaccaagtccagcaaactgtcacttcagcatctacacattcatcacaaccaaaaattgacatgtcaaccaacatcatctatacatgtagctagatgatgccccgcgctttgctgcaggatatatatttgataatggagaaatgatgaaatgatttgcattgaaatattatgaaaatgatttgagaatgacgatttagcatgtgtatgtttagttttaaaataaaataaattgtagatataattactatatgcttgcacgttgagctttgtgtgcttaataagttgatgtggcatgcttgcatgtaagttttaggagtgctaataatactatgcttgcatgttgagatttaagtgttgagtgggcattagctttatcaaaagaagatatgacaaatgagaagtgttaaattttgtctcaaaatgtagctacttttctactcacttgcttatctcaatcaaccacgtcatctctaattttatttcttcacctactactactcatctcaaccaattacaaccatcccatttaattccatcctatctccttaatccccatgaagaatttcgagagggcttatattctgggatggagggagtaactcccaatgtacattaacaggtagtgacgggatagacgaacgaggaagcccacgggctgaggtgacagctaaggttcggccaaaccccaatctgagtcattgatcctcagcttccacgtggacgtacaagatcacctcccaatgactggagtgagttagcatgctcggatggagtggcaaattcactgcccatcactattgtcctctatatatgtagttggtcttgctttgacagatatattctttacagaaatgagtataatacccttctgctcatactttttttcctaacatacaaaagaattacaacgtagaagaaaatacgacgtagagcgctggctctcctagccacaaaacaaaggagagaaaaaaaaacatcaagagaagtttaattacatctcgccaggcccatcaacgaggcaatcctaagtgggtgatcggaacattacccacaagaattgtgaagtgaccgggcgatcgaacgggacctaaaaaaatgaaaggccccaaattattcgctcatacatattcctgttcaaacaaggagttttgtctttttgataatctgataccgatagtaatgtgaggctaaggtcgatcctaggaaggatgcctgataagcagtcgctcatacagtcctggcccagacaaggaattttgtagtgtgacatcgatagcaatgcgaggccacgtaccaaccatatacaacgaacgagccttcacttaccagtgaatcagctagc

SEQ ID NO: 9767 - DNA, 1501 bp, Oryza sativa
agaacaaatcattctgtccaggggcggagctaggtaggagaggggggccagggtgcccaagaatctggtcaagaaaatttttagctatagttcatctattttcaccatatgtgcacccctctcaatccaatttcaagcactcatatcagcctaaatttaatctaaagtagagtaaagcaagcgagtagcacccttctccattccattttagctccacccctgattctatcgaaagaggcacatctcgtatctcactagacagtgacataggtaaacatcttacattttcaaatttattcacttcacctataactttcattatccgttcatcattgtttcgcttacagatacaacctgcagattaaaccgcgcatgcaccaccacatccacacaagacaaaacacaatattgaatcagctcctataaatccaggtacttcaattactgtttttgatgatattgttaatgccaaaatttggtaagcccctaggagaattatcacatcgccaatagtcagagtcctgctatattcggttaaggaaattaatctatcaaaggaatcttatccagaagtgaccgagttcaagaaggatgcggcatgtcaagttatctattaattaggaatagttgttaagttccttttatatttaagaaagtgtgttcagtgtcctataaggactttatgttttccttttatctttaggaaagtttctttcttctcctacaaggactagtatctacccatgggtataaatatgtacacccggggtcattgtaaaatatctctcgatcaatacaactgctctcggcgcaccgccaccctctttcccgaggttttacttatcaaccggcagaatttggcacctgacgcggggctgcatctgttcagttcgatctccggcgaaggggtaagtcctacattccaccagccccagtgaatctatcggctacattgatgttgttcaaggttgcatcgcttcgatctcttggatcgctctggtttggtcgatatatttgcctacctgatatctcaattctatctctaattgcattgtatttagagacacatcggttttgttggaattgtctcagttaggtccgatcttctgtcttagccgatatatctctacaatcacaatgctgttataaatagatttgctatatccatcacattagacagatctattggctcatcgagtattagattaccacatataatctcatgctgcatcggttaggtctgacctactagattgttgttgataatataaatcttgttaagctgataggttcatgctagtgttttatcggggtgctagccgataagttatctggacgttacatcggtttataaggatatacatataagttggatttagccgatgacaacaaaggtttcattgatctatctaatcttgtggattttatgacatccgatcttcagccgatgtatgctttaacctttggatcaaaacttcttctattatatcatactgctagc

SEQ ID NO: 9768 - DNA, 1501 bp, Oryza sativa; identical to SEQ ID NO: 270

SEQ ID NO: 9769 - DNA, 1501 bp, Oryza sativa; identical to SEQ ID NO: 269

SEQ ID NO: 9770 - DNA, 1501 bp, Oryza sativa
  unsure (1)..(1501): unsure at all n locations
ggagctattggtggcggagagaggtgcaaatatcatgtgaagggcaggctgaacgatggtgctagtcaaagtgacggaagtgggcagtgcactaggcggagatacatactttccatggtttattattggatgacaattttgtatggttctagcatcatagtttgactatgtaatctaggtagttcacaaatgatatctagaactaaaacttgcaatttgtgatattaataaagaggcaatggttttcgttaatctctattgagctttcatagctatttttcatgttaaactagggggattgccttgcgcaaaactgcagttttgcccgttgctagataattcacatagagtaagatttaatatgtaactccaaaattttatttatataggtaccattatatgtgaaattatatttgaatttcatatatgattcttaggttctatttttataagctctagatttcatatacaactcttaaattctatttctgcagatataattgtattttatatagaacaatatcaattgatctacacttttataatccgaacccaccatgatctaacacttaagatatttttctttttctccaaataattatgtgacaatttctggttttcaaaatgaacgtggtgccttctttcaagtcagtcttagtaaaatattataatagatagatactcccttcgtttcaggttataagacattttgactttggtcaaagtcaaattgctttaagtttgaccaagtttatagaaaaaagtaataacattttcaacccaacacaaatttattatgaaaatatattcaattattgatttgatgaaactaatttagtattataaatattactatatttgtctataaacttagtcaaacttgtaacagtttatcaaaacgtcttataacctgaaacggaggagcagatcataatgtccttatctgtccttatctaggcctaaagttcttcttagcagtaagtcttcagatggaggaaaaaaaaaacatcacgtagcaattttttttgccatgttttaggttcctctctgttcttctcatagattatcttgcaatgagacatttgccttttatttgaggtccaatttatgaggctcttggattgagggtttacttatgttcttttgccatattgtaagcatgtaagtgctggcgttaattacttatgttcctttggtcatatagctgcactatacatttctttcaaatccataattgtggtttgagtaaaatgcacctgcggtccttaaatttgtcagcaggtttcacttaggtncacnaacttgcatattgcacatccaagtccctaaacttggtttattgtatcatcccggtccaaagccgtgtttgaccgtggtcttgctatacgtggcacgccacatgaacgatgacatggaattgggttaaaaaaattctcccttcttccttcttttttcaccactgctacagcccctcccctcgtgccgcctctcaccaccgaga

SEQ ID NO: 9771 - DNA, 1501 bp, Oryza sativa
tatctttggtgattcaagttttttaatttttgcagttacctgaataagcatttctagtttttgcatcacttctagtgtcagagacaggatacgctgtccattctgcactctgaataagataaaatatagacatgacctagtttccaaaaaattaaaaaaaacatgacttgaactgaactgctgaagaagaagcagtatacgcctactacttaacagagtgaccagattataaaaagggattttgttcacttgaaatcatctttaggatcaaaagaattgtgtaaagaacacctgcaaattgcgattaactgggaggacaatttttcctgtgaaccataagatgggataaatgcatcccaatacaaccattttgtgatgattctgctagtgctatccacagatgatgtctgttagcacagaacagaaggcgatgcagtctcgggcttgtttgggaggcctacaattcggcccaccaggattcaggccttagcatgaatttctttcatgacaccaaattgaaatctcttgcaccaaatttttcggtttcattcgccagcagtagccgttgccatgccaagatacaggacagcatcacaacgcatcatcgcagcaagtcagaaacagccaatcacatgatgccacgtgcatatagatcgatcgggttcagagtttcttttttaattcagaccatatgcatgctattattctgagttctgaacaatattattctgcagtacaacaaacatgatagtacttgaaatcatcttgaattatataagcccagttgtttatagctactgtatatacactatacagctagctactatacagatataggtgaggtctgatgaacggctcacctcacatatacagatcataagttttttttgacgcaacagatcataagtcaaaacagaatagcattgacatctccatctctgacagagcacaactactgctcgcgtataaacgatcgagtatacaacaatttttgctgctcacctactcgcaactaaacctttcttgtactatctgtttaatgtcttaacctctctgattctctgattgattctgcaacgcatcacacgcatgttgactctttaatttctttatacaacaacttgtaggtttctcggaaggacccatccattcatttgacgaactattttccttagaaaaatgatataaaatagtgaagcccagtagaagctagcttggttatctagctgatcatgacatgaacaatcaaaatttttgcatttgatttgttcactatctcctctctgtctcttctcatccatgggagcacttctccattttctctccctactactcttcctctccttgctccaaggtaagcttagctcaaaaacaaaatcatcaagcatatgcacatttgtaatttaattcagtggacgacgcagctatctgtttttaagcttaattgttcacatgatttgcttgtaatttctctaattcagtgctcgaaatgttgtttgat

SEQ ID NO: 9772 - DNA, 1501 bp, Oryza sativa
ctccacgtcgagctccaccgcctccgccggttgcaccggctttcgtgcactggcctccgcgccgcaagcgacgccgcactcacctcgcccgaggccgtttcctcggcacctccgctgtcgacgtcgcgacctcgtgtggctcgccgccgccgccgccacgtgcgactccgccagccgcgcgcggctacgtcgcctccccggctccccgcccaagcgcgacacggcgaacccctccgcgtgacacggtggccagaccgccgcaactactcgctggcctccgccaccaaccaatgccgtgcggagccacctccgcgtcgaccgcagccgagtccgcttatgtccgcctgcgcgagctcctagcggcgccgccatgagcggcaaccggcaccctccgctggcaccacgcgactccgcagcctctgcttggtagcacgtgtggatagatgcatgcagtgcatggccctattcatgtggcaaggtgcaggagcgaggcaacctgcagccatgcctgcgtgctcgcgcgaggccgccttctcgttagcttcgctccgccgccgcggtttcccccggttagccgtggtgctcggagccggttccagcgtcatgagcaaggtctaccgcggctccgcctccgagaggtactgccgtggcctcgcaccattccgccgaactccgccatgacgccagacgcgcggcctcgtgcgagccaccttccgccgcatcacctccgcatctgcgtcaaggccccggacgactccacctccgggaccgccactgtggtctcgctcggtcgctgcgatctgctggtgttgacgtgaaaacacgaggcctaggagatctgcttaactccagtacaggtccaaaacttgcctttgggtgtatgagcgtgccagttgatttgatcctgcaatcaacaagaaagaaggacaaagaaaccacggttaaacctataaacgatagccgatcggctaggtgccgatgacatatcatttatctttgagccgatgtcataaatgcatcgatcggcagtcattaataggtaagaaagaactaaatctactcgatcggctgtagatattaacgatatgcaatccttatgtcgatatatacttgaatcaagtgattgggatagatcggtcgccatgccgagacagtataaatcacttagatcgaaatatatgctaacaagagaccatatatgttcatagcatagccgatcagatagatctagcatgtatcggctaatactccaataccactctatgttaatatattaaagcaagtgaaatataccaaacaaaagcctaatatatttaaatgtgacaagatcttaacataaagggcagatttaacatgtaaataaagcgtatgaggaaaagatggttaaatcaggtaagatcggctgaaaccccgatactaccctaatcgacaaccaagaagtaggctagagattgagattctactcacgactcataagatcaaacttaactgatgcagctat

SEQ ID NO: 9773 - DNA, 273 bp, Oryza sativa
ctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccag

SEQ ID NO: 9774 - DNA, 1501 bp, Oryza sativa
aaaggaattagcacatctctattatctataaagttacaacccactacattctaaacgtaacctacaaactcaaccagcaaagatagcacatcatcatctattagcatttattttagagtaaatttcacaaaactacatatatactttaaagaatctatcacaaaactataaattgaagaaggtctattacaaaactacaaatttatgaccaaatttatcaaagaactatatattaaacttcgaagatcaccaaactacagatttagtaataaaattatcacaaactacatgttttgcaccatgttataagtacaaaactacaacatttataactctaacataatagtagtggtagatatttaaactgtaaaatatgtaattttgtgacaactccagtattaaatctatagttttgcgatacttggtcttaaatttgtagttttgagataaattttgtgttaaatttgtagttttttgatacaacgtcttacatttgtagtttttacgataattttgttaaagtacatgtagttttgtgaaatttactctatattttatcatattctaaagttttcaaatacaaacatgttaaatcatcatcccacataatttacataatatttcagcatatatctatttattttctacaatatcctatatactttatccctacttagttaatgttttctatcttctctcattagaccacatcatatcaattgtttctagcctttaaatgattaatctgttgtccaaattatttctctcattttttctctcataaagtcatcaccttacttttagctttttattatcaatctatatagtatttaaattatcataaaccacatatcaacttaagtgatttataacctttttcattggttaataaaaatacaaattcttaagcttacgtcgtctacctatatacattctccaaagccagcttttgtgttcataagaagagtagttttacaactatttgacaagcagaaccatgaacccttctgtgttagctaagggcctagttagggagcttttggcacctacagttttctttcagaataaaaactctcctaaatcgttcaggtttttatgcagattctgagaagctgtagttaaagtgaaagtgcatctaggcccctaatgattttggtgattaattacaatgcgattaaagaggactaaaatttttatttaagcaaatgtgaaggttgttatatcctcaatgagttagcgtaatgcatatcccgccaaatacgttgatgtgatgtgatgtggcaaaggagcaaatggtatattgtaacttttcttttcatttgagtaaataggaatgccgcactattaagagggatgatgcattgacatatgaggagtgatcaaagtgctcaaaatcaatttttaaaagtgtttctcctcaatttgagttgttctagacattttcggagttttccgaaagtcatttttggactttccgaaaatgcacataaccaaatttcgc

SEQ ID NO: 9775 - DNA, 1501 bp, Oryza sativa
attgcgcatgctgaattgctaatactactgtaattattatttgaatttgtcatggtatatcaatttcatttcgatttctttggtcatgatggctaattaagctagagcatggtgggaacagaacagagcgagctcaccttgggcaagtccggcgcgatctgccgcaagaacagccgggccagctcgccgtcgccgtcgaaccgcaccagcgtccggtcgtggagcggcggtgggagggcctccctgacactggtggccacggccgctgcggcggcggcggaccacatctccaagaatcgccagaggccgcggccgtccgccgccgcgtggtgcatggccaccccgaccgccacgcccccgccaccgccgacgaactccgtcacctgcgccgccatgacgggcgcggggagctcgtcgcggcggatgtccgggacgagctgccgcagcgcgtcctcgtcgtgctcctccccttcgtcgacgagcctcccgaggtcgaggtccgtctcggcctccacgaacgccacgccgccaccggcctccacgacaatggacagcgattcctcctccggcgagtagaccagcgcgccggcgaaggggtagaacgccgggagcaccgcctcgagggagtccctgagcgcgcgtacgacgtctccgaacggcggcggggacgggaagaggaagacgcggcggacgggcggcagcgcgacccagtacgcgtcgaacggggagagcggcacgcggcgacagccgccgccatctccgtgcgtcgggagcgcgacggaggtgacgctcctcgtgcgcaccgacggcggcggcggcggcggcatctcggggacggcgaactcctccaccgtgttccgaatttcgccaaagcttgtggggtggtttgaccaccaagcggggtggcgctgaccaccgccccctcgacgggagaaagttcggaccgacaaatagtgggccaaataggcccagaagttctatccaggcccaatacagatcgaataatgggccaataatggtttatgcaatgtagttgaggcccaatacgcatcgaacaaaagctggatgaaaaatttggatattcgtgcacgttttttaaacgtttcgagcggaaacttcctatatgatagtcgctctaaaatatcagataaatatattttttaagtttgtaataattaaatcttaattaataatatgttaataccatcttgttttatgtaaaacacttaattttatcttcataactatatgagtttcaaacgccatcgcaatgtgatgaaacaatataggattactgctatttactatgggcttcaattgagaatattagggacaattactaaaaaaataaaaaaaatcaaaataatcgactgagctattttatcgagtgggatcacccaagtggtctgctactacgtttcgtttttgtaattgtcattcttttatgtgtttaatgttgaaagaaatattctataatgtgtctggcagaaggatctcttgg

SEQ ID NO: 9776 - DNA, 1501 bp, Oryza sativa
gtcctcgttactcaaaccagccggtggatcctcgcgctgcgcgagatggagaggcggcgagatccacatgggaggggaatggggcgctggatctggccctcccgtcaccgccggcggctgatccttgcgtgtaggggccagagaggtagagggatccatgcgggagggggagggacgccagatctgccccttccgtagccgccgctggcggatctgcgtgcatggggggtggagcggcggacggatccgcacgggagggggaggggatttagggttttctctgattttgggttttcttgaacttagctttctaaattaggaacaattagtaatatgtgtgtgctaacgctatggcaacactgctagccaccaaaaccagaaattgataagcagtaatacaagtgacgtagcaggtagaaatccaccaaattggcagtaaaaaaccatatcgatattgtgttaaaatgcatataaagattatcacaaatttcgtcattgacatcgtactacatttcatcaaagttaccgaagaaaaggaatggaatgtctcgcaggtataaagacaaggtaacaaagataataaatggatgagtttgtatcattgaaaataagcccttctttcgcccaagtcattgaagatggtaattgatggctttgctgcattctttcgcctccctttccgagatcaagtcctaagcaaccatcataaaaatttggaaatttcaaaggcacatggattaaaatgtgggtaaacaattcgaaaggattaaaaaaatgaaatagtgattaagacctgagtcctactaaaaagcacccaagagatccttctgccagacacattatagaatatttctttcaacattaaacacataaaagaatgacaattacaaaaacgaaacgtagtagcagaccacttgggtgatcccactcgataaaatagctcagtcgattattttgattttttttatttttttagtaattgtccctaatattctcaattgaagcccatagtaaatagcagtaatcctatattgtttcatcacattgcgatggcgtttgaaactcatatagttatgaagataaaattaagtgttttacataaaacaagatggtattaacatattattaattaagatttaattattacaaacttaaaaaatatatttatctgatattttagagcgactatcatataggaagtttccgctcgaaacgtttaaaaaacgtgcacgaatatccaaatttttcatccagcttttgttcgatgcgtattgggcctcaactacattgcataaaccattattggcccattattcgatctgtattgggcctggatagaacttctgggcctatttggcccactatttgtcggtccgaactttctcccgtcgagggggcggtggtcagcgccaccccgcttggtggtcaaaccaccccacaagctttggcgaaattcggaacacggtggaggagttcgccgtccccgagatgccgccgccgc

SEQ ID NO: 9777 - DNA, 1501 bp, Oryza sativa
gatgtaatgagagaacaatttgggcttaaaccaaaagagactggaagcttgtatcggcagccttatcctgagtggtttgaaagagtccctctccccaatcggtttaaagttccagatttctccaagttttcgggacaagagggcgtgtcgacttatgagcacatcagccgattccttgctcagtgccatgaagcatcggctgtagacgctttgaaagttaggttattccggttatctctgtctggatcagcttttacttggttttcttctttgccatatgggtcgatcaatagttgggccgatttggagaagcaatttcacagctatttctacagtggggttcatgagatgaagttgtccgacttgacagcgatcaagcagcggcatgatgaacccgtgcacgagtatattcagaggtttagggagatgaggaacaaatgctttagcttgagtttaactaatgctcagttagccgatttggccttccagggtatgattcctccaatcagggagaaattctcgtccgaagactttgatagcttatcgcatctgatacagaaggtaaccttgcatgagcgtaggttggcggaagtcaggagaagctctaagaaaatcatgtttgtccatacatgtatggatcggatgacgaggaagatgattctgaaatagctgcagccgaatgggtgaggagcaaaaaggtcataccatgccaatgggtaaaaagtcctggaaaagaggaaaagtatgattttgatatcaccaaggctgacaagatttttgatttactactctgagaaaagcaaattcagcttcctgctggtcatacgatcccatcggctgaggaattaggtaagaagagatattgcaaatagcataattctggatctcattctactaacgattgcaaggtttttagatagcaaatccaggttgccattgaggggggcaagattaggtttgacgattccaaaaagccgatgaaggtcgatggtaatccttttcctgttaatatggtgcatacagctagtcaagcagccgatagggtccgtgcaacaggttttcaagtgaattcggctaggattatcaacaagtatcagtggaagtatgacaagcagcaggagaagcattatgaagaatacgacgatggttttgatcctcattagggttgtgagttcttcagattctgctggaacgaagggatgaggttgccatccattgaaaactgccctgggtgtagtgatttcatcgagagctcgagccggtcatatagtagaggtaatcggctaaggcaggcaagacttcctgttcatcagagattgggtccgatgaatcaagattgtggccaagaggatgaggtaatcaggaagaatcaatggtgtccttctggtattttcacgaagaatcagaaaagaagggtccagagattgaggaacagggagcgttttcaggaggttgaagaggaaatcaaccatcgactgaggaaaccaaagccaagacagga

SEQ ID NO: 9778 - DNA, 1501 bp, Oryza sativa
tgccttaaacaatcgaaagaaattatatgcataataaatttgcaattatggtcttcattttccttttagcacacaagaattttcacaaaatcacaaggcgcacacagtttagacaaataacttagatgggtatgaaaatgaaatctcaacaattttggttatttagtgacgaacagataatacatgctagatcatttttatgaatatacaactacacatattagccaatttgatccttgtgatcgatacacaacccagattatgcacagctcaagtaactcagaggcttcatactgtgctagtaataataaattcgtgagtattcattaaggtactccccagcgatctgtcagccatacggagtacacccttcccacaattaaaaagaaataaagttgagatgctgcaccctataaagactcatcaaccacaggagcaattaacacaaatctgaagacgctctgtcagactgtcagataaataatggggggcagacactggtacagcacgattgcaaacgtattctaattgcacacagtacttaacaaatgcatccaatcttccgccagatttccattagatggtgaatcgttcgcacggagcaagtactacttgcgcaacctctagccatgtgagctcaagcaggaacgccatggctaaccaagacatccggatcaaagtggcaaaacacacaaggcacgcggattggatggcatatgttagtatcaaatttctctaccttaaaccataccctctagagcaaatcacacacgaaaccgatattcaaatccccggcaaactcgggattactttaaaagagagagagagaaaaaaaactacaagcccccaaacagttcatcagcacgtacgagcatcaaatcacccgaaccgcttaagacgaactaatcaacacggaatcgcgagatcccgcccacccaccgacgggccgactcgcacgagacgagacgataaaccctaccataaatccccccatctccagcgccccacccccccccccccccaaaaaaaaaaaaatccggtggaacccaacaaacaaaccatccacgagaacaacacactggcacaaacccagcgaaacccaaaaaaaacaaaataaaaaaataaaaaatggatcactcgacctggagccgggatctccgagatcagcacaaaaccagagagagagggggggaggcctaacctaacccaggagggaggaagcgagcgggagacgacgaaggcgaaggcgaagacgacgcggtgttcgtcccggcttctagaagaaactagaagaagagatgggggggttttgattttgatttttgatttggggggggaggcgacgacgagcggtggcggcggcggagtggagagagtggagacggaccaagaccaagggggaagtgaaactgtgtaggaagcgggaacagcgggcgagagaaactggcgagacgtggggcccacccggtttctgctcacgtgggtctgtggcggtggacca

SEQ ID NO: 9779 - DNA, 1501 bp, Oryza sativa
cgcgtcgtcttcgccttcgccttcgtcgtctcccgctcgcttcctccctcctgggttaggttaggcctccccccctctctctctggttttgtgctgatctcggagatcccggctccaggtcgagtgatccattttttatttttttattttgttttttttgggtttcgctgggtttgtgccagtgtgttgttctcgtggatggtttgtttgttgggttccaccggatttttttttttttgggggggggggggggtggggcgctggagatggggggatttatggtagggtttatcgtctcgtctcgtgcgagtcggcccgtcggtgggtgggcgggatctcgcgattccgtgttgattagttcgtcttaagcggttcgggtgatttgatgctcgtacgtgctgatgaactgtttgggggcttgtagttttttttctctctctctcttttaaagtaatcccgagtttgccggggatttgaatatcggtttcgtgtgtgatttgctctagagggtatggtttaaggtagagaaatttgatactaacatatgccatccaatccgcgtgccttgtgtgttttgccactttgatccggatgtcttggttagccatggcgttcctgcttgagctcacatggctagaggttgcgcaagtagtacttgctccgtgcgaacgattcaccatctaatggaaatctggcggaagattggatgcatttgttaagtactgtgtgcaattagaatacgtttgcaatcgtgctgtaccagtgtctgccccccattatttatctgacagtctgacagagcgtcttcagatttgtgttaattgctcctgtggttgatgagtctttatagggtgcagcatctcaactttatttctttttaattgtgggaagggtgtactccgtatggctgacagatcgctggggagtaccttaatgaatactcacgaatttattattactagcacagtatgaagcctctgagttacttgagctgtgcataatctgggttgtgtatcgatcacaaggatcaaattggctaatatgtgtagttgtatattcataaaaatgatctagcatgtattatctgttcgtcactaaataaccaaaattgttgagatttcattttcatacccatctaagttatttgtctaaactgtgtgcgccttgtgattttgtgaaaattcttgtgtgctaaaaggaaaatgaagaccataattgcaaatttattatgcatataatttctttcgattgtttaaggcacatgggaataactgccaacatgccttaatcacactattttttttttaaaaaaatggataaggtagatgatcttgagtctgttagtctttgttctacttaccatttatattctgtgtatttgtcttgctaaaataaacttcactttccactatcctggatgttttctttcagttatttctaatatgtcttgttggccatgcaggctgtgcactgaagtactgaacgttcttttgtagactgt

SEQ ID NO: 9780 - DNA, 1501 bp, Oryza sativa
tgtcggtttcaggttgagagctttgcactgaagaagtgggggatattctgatctgctcagctaaagggggttgcagctaaacatggcggcggcattagcatggcggttcaatggaaccaatggaggcgcagatctggttggtgctctcctcggtgctgtagttctgagctagtagaattgcagcatgtcactttcttagcgtcgcttgaattgtaagagtgctgtcgtctacgttaacggagttatttggattgcgtttgtttctgatgtggacatcatgggggtgaaacgttgaatagtatagcagtaggatatgctttgaaagtgagatcagtgttcggtctacttgagaaaaagatgtccatgcatatttgtcaatatttaagcgttggggatcttcatttcagctgcattttttaaagcttttgcgctaggcctatctatcatacttgggctatactaatcaggtttgctaagcaactgatggtctattagtctaggagatcttgtctacgtctttatcgctgtctattttttctgtgtaggtaagccaagaatgagagatatcatgcttctgggtcattagtgtttatgcaggtaatggtacaataatggattgaatggctctgtaatgctgttttacaaacacaaggcccacgcaaatgccctaagttgaagctgtttgatttattgtgtaatgcagttatttgggtgaagcaatacataagtatatatagagctgctgcatatcttttacttcatctgtgcatgatcttgatctactaaaactaatgttcacttagtgctgggatccatgtttgattgagaatgcacatattatatttcttatctgttatttccctcattgcaatcttgttcaactttattttatgcttataaaatcaagtgtctgtcagcaatttgattttatgatctacacagcatttttagtaaagttaaggattcatggcatagaaacttgtggcatgcatcagcttatgtaaagttcaaaatttatgtttgtgtcgcatgcttgagtctcaacattaactacctttgcttggatattaacaggaacccaaagttcaagagtcagagccaccaactcctgtctcagtgatgagaatggtcaagtaagtttgattccatttcttggtttgcactgtgaaattctcatcaatagcatgaagaagtcgggaaaatgagctcagccatagcagttaaattagccaaaaaaaaactttgtataactaataggttttctaatttgtgagtaaatcatgaccgtagaaccatttccgggaccttcactttcaccatattgaagataatgaaaaaagggtttatgtgacacacaagttatcactgagaatatgttatgtaccttgataatgctatcttttagaacctaattacagtatgttaattataaaatttatcctgatatgtagatagccaaggtgccaagcataattgttttgtaattgcaggaaccgtgcca

SEQ ID NO: 9781 - DNA, 1501 bp, Oryza sativa
caccaaccaaacgtctattctgttgtctgtcgagccactggtgagttctcctaacacactagtctcatgatagaccctctaatcctaaaattttggctttgctccctgtccatcacatctctactagtaagaggggcagtacgcacaacgcacactccccttgctcgttgccccctctctctacctctgatggtatgaataagtggtgcattgttgatcatccggtcgttatttgaattaattagatcgccactttccaaagattttgcttcttcaacatgatggcgctgattgtctctcactatgtcgttatctctccaaacctccaagattccaatcataccgtttgagaaggtgattgatcgacaaaagttgccatgttgtaggtgcagaaccggcaagccaccgatacgcaaatcataatatgtaagtttatggttttttgcccttgcatctgatcaccatgacatggcaccaaccaaacttccactctgttgtccgccgagccaccagtgggttcatccaacacactagtctggcaaccggctctctaatccttaaattctggctttgctgctagtcccatcacaactctactagcaaaagggtcagtatgcacactgcacactccttacccccccccccccacacacactctctctctcttgactcttgactcccgctataaatagggagtgactctaaatactggcttcgcccatgcgcaggaaggttctatttagagttgtgattcttttctcacgtaataattaaatattccaaatacaacggaaacgtaatgacgctacgataatctatctataggacaaacgaacaacgtaatggtgcagtatatttattgttttcaaccgccgcttcatctgtcgagcgtgtgtcaagtacactcgttaatccatactagtacttcgttaagaaagaaaaataattctagctaccaacctgaatcatagttaggattgtgttttttctttctttttacaaagagggagtacgtgcggtgtattcacattggtgtgtgtgtgtgtgttgcacattcacatatgcgcatgcgcgtctttgtataacgaaggaaaaatgtgacgcgcacacgcgaatcctaccacgctaccaaaaatatgttacagctgtcacctgctaccggaatcccacctcccccaaagaataaatacccaactaatcgagggtgaatctgcaaaaaggccaccgaatcccactcttcctcctcgcctcgcctcgcccgctcgcctcctcgcggaggaagaagaagaagaagaagaagaagaagaaattcctcgagaggaaatcgatccatcgcgttcgcggcgggatccgcatcctcgccgcgcgcggattctcggcgagctcatcctcctcctcctgcggcggctggcggcggcggctgctgctgaggctgcggttggtgggatcttggtcgagcacaccgggggggagagggagatggccagcggcggcggcggcg

SEQ ID NO: 9782 - DNA, 1387 bp, Oryza sativa
ctctgaactatatttgttcacttctgctagccgaggcctaagacacggacattcatcgcccctaccaatactggtagtaccgtagaaaaatacaactacaactctatatctccatgatttctaatttcaaaatataataaattttagttacaaaactgaatacatacatctaaataaattcatagtcaaagcttattatattttgaagcgaacatccatcaatgagccccacgcccacatgtccctcctctaatctttacccacgtcgcagatctcctcctctcattaattcgtaccgactcgttcatgctttcacttgatcagttcaccccaatcgattgaattaattcctccaacttaatcgtggccatccccgtcaccatcagatggagaggaaagcacgcagctgctaatctgtctcctgcctcgtacgtactaggcgtaccactctacaggcaatagcaaatgtgtcccggctcaccaagaagcacaagcatcatgtaggaaaaaagtaaataggctccatctcccagcgcgcgtagctttagatgaggtctaccatcaatttttttttcaagcaggtcccaccaaaaaacgtttccacccctacgcgcagtcctcccggtagtgctaggtatactggaagcctaacccagattagagctaagtttaatagtatagtcaactatctactctaaatcatttatagtcaattttaatagccaatttatataataattatctataaaaatatactatacaattaatccagcttagagcaagtttaatagttgaattctagctatatgagaggtggagctagaattggtgtcgtatcaaacaggccgtatatataccaaccccaagtggtgtgagttatttcagcatgccggcgaggtgacgtggtaattttcaagagggtaggtttatttctaaaattaaaaaagttctaaacaaaacaataaaatttcgcttatctcgccgtcgagttccattcgccgcatagtcgcgctctccaaaacgtgccaaattgccacgtactagtgctttggtccaactcgctcgctgcacgcacgtaatcagaagacaaaaaggcaatgaaggcgtgcagcaccactacagtctacaggcggaaacacttgccggtcacagaacggcaagacaagacgacggctcaccgagtcccagctctcgccggcatcgaatggcaggtagaactacattacaggccggcaaagccggaaacatggacaagcaagagcgaaacggccaacgcaagacatggaaaatgagcagccacattgcaaaggtagagaaaaattcaatgatgaaatgataatgcacgagctgccatggagagcagtagctgcagttcagcagttgacaa

SEQ ID NO: 9783 - DNA, 1501 bp, Oryza sativa
aatgtgaaatactactatttttgaagggccttcgattcaaaggaggttttcttaatgctatgaagtttctatacaaaggttcattacaggtagattttgcagagaacacaagagtttcaaccttttgaaaattttgatttgagcatatctattttattcgatcctttgtctatacgatccaatttaaccatttatatattttgccatcattgtatttctattagaatcatgtgtttttatattcatattttttctattcctgcgatttaaagggtcctaaataacccaatgtgatttctagttgaggaataatttaagagccagtcaagctctgccaacaatttttttttggtaataccatgatgtatttgcatcactaatccaaataataccctccaatctctgcgctataaatatattggttatacctaaatatgtaaacatttaagtacaatccccttcgttctattttatatgtgtttaacattttgtaagttaaattttctttttaattttgcaagttttttaactatctgtacttcgtttcaatttaatttcacatatttttccttttctaaattataccaacatgagcccttttctcagtaatgtttatttcctattttaacctgaatttaagatattttgaatctaagatattgtatgataatatatggataacaacctttgtatgtgtttgttcatatgtgcataggtcggtgatcctttagggtccctttgaatcgtaagaatgaaaaaacatatgaatatgaaaaacatagaattctggcaggaatacaattgtaaaatagaagattgcaaaacatatgaatgaccatttgattggactataggaaaagcgcaggaatcagatgaatgagatagactcaacgaaaattttccaagaggttagacctcttgctaactttcctctaaaatatacataggattatctattccattgaaattttaaaggattggatatgattcaatcctttgtttcaaaggcttccataggattttcttttccatatgaatgaaatcttttaaatttcctacccctataacaaagaaagcccatatgctcgagaaaaaaaagttactatctagaacttgtttcttaaaaaaaacacaccaattaagatagacaaattcgattgactagcatgatttcgtgtaggtttgcttaatttccacggtctacagagaccgacgcagtaacgacccatcgtaggctggcggcaccacgaaagcaatcgagggactcccgtcggatgggaaaccaacgcaccagattcgccagatgacgcgtacgttgcggccgtggactcctcacagcgtggccttggcacccggttgccatctcgtgaatccgggtaactacaaatacaaagaacacgcgcaaggaaagatcgaaagataggtttagctagaaaaaagctggtgaaatcaaatcaacaacaggaagaagagaagaagaacataacatacctggagatgt

SEQ ID NO: 9784 - DNA, 1501 bp, Oryza sativa
gatgatgtggcatgttcacgctgtattttttttctcaagaactatgtaaatcaaacgataattattttgaacaatttaaaaatatcagtgactaaattgaccctagaacgttttgactcttcgcccaaactaaaataatagtatcgaaatcaaggtggcatatacacgaagtagtgaatggaaagagagagggggatgaggtaattaagtatttggttccacctatatagattatgcttggggtaaagagtagtttcttaattaggttgtggagtatatccatatggtggtattaaataggagtattaaatatccatatgtcttgtaaataaatgttacgtgcgccagctagatgtcaagaacatgcggtaaattaaagcaacgtaacgtggcaagttgagcagcctattgtcataagcttaactaagtcgatcatactccacattaaaagccatcagccagagcttgaaaattaatgtcagctcaacacactatattgccatgagcttaatcaagtcataggcattaacgcaagttaggccctgtttctttcagcttaggattattataatccagattattgggagtaaactgaaagaaacagacaatttattgaagtagcttattataatctggatccagcttattataatctgataagcttatttaggtaaactttttctagattattgggtgaaaaaatacccaccatgccatcccaccccctctttagacttgcaaacccaataatttaggctctaataatctagattataataatccaaagctgaaataaacagggctttagccagcttaacgcaagttactgacaattaatacgtatacttgcatgcatgtcctgttcacgttactacttgtaacaaagctttcctgctcacgttactacttgttacataagtgaaaaaaacgtttgagggcacatggaaactgtacatgtacttgtactgcgctaagttcaattaatatagacgtacataaaagagtatatatcaaaaagagccaggggaaactgaatttgcacgcatgcatgcacattcatatgatcgagatcagtagtctaccaaacaagcactataaataggggcctcttatgcacaatacaatcacaaaattaacaagctagctatcattcctccaagtgtcaagtacttacgaaacggtactatgaatatatgtctagttacattttgcacttcaatatatatgtgtagcttctgcccctctgcttgttttgcattacatgtatttgcttgttggagaagtagatagctatatcttaaacatttagatcttattcggttaatcccatatgcgtgaaattagaggggattaattccacacattattcctcttcttccctaattaaataaccttataggtggaattagccgaataagtcaatgattaatttttctagtcctctcttgtgagtggattgattaattactacttagaattggctcatatacgcagaatatgc

SEQ ID NO: 9785 - DNA, 1501 bp, Oryza sativa
acgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatatgaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagccaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggactaaagatatctttagtcccggttgttgagaacaaccgggagtaaagatccaggggtatatatattcccggtgcgccctcgtcttcttcaccaacacttaaacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgctgcatctctggggtgagagccgccgccgccagatctcccttcatgcagctcgatctctccgatctcgatctctctccgtcgcgccgcccgccacgagacgccgcgccacgacgacgacacgccacgccgccgccttcgacgccgcgcaacgccgccgccgcatgccaacgccacgccgccgccgccgtcgccacgccgccgccgccttcgccgccgcgcgcgcaatgccgccgccgccagccacgccgccgccgccacgccacgccacgccaccgccgccacggccccacaacgccacgccgccgccgccgtcgccacgccgccgcgccaaccgccgccccaatgccgccacaccgccgttaacgaacgagaacgaga

SEQ ID NO: 9786 - DNA, 1501 bp, Oryza sativa
aacggcggtgtggcggcattggggcggcggttggcgcggcggcgtggcgacggcggcggcggcgtggcgttgtggggccgtggcggcggtggcgtggcgtggcgtggcggcggcggcgtggctggcggcggcggcattgcgcgcgcggcggcgaaggcggcggcggcgtggcgacggcggcggcggcgtggcgttggcatgcggcggcggcgttgcgcggcgtcgaaggcggcggcgtggcgtgtcgtcgtcgtggcgcggcgtctcgtggcgggcggcgcgacggagagagatcgagatcggagagatcgagctgcatgaagggagatctggcggcggcggctctcaccccagagatgcagcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccctggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttggctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattcatatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacaaatgccata

SEQ ID NO: 9787 - DNA, 1501 bp, Oryza sativa
ttggccacgtcgtccagccatcgttgggctggagactccgggtcatggacgacgggcgggtgtcgtaggagcgcgccagcagcctgaagcgcgccctgaggcgtgctgccgtcgccgtagacgaggaggcgacgctccccatctcgccgttctcctgcatcacctgcgactggtgatgctacggatttgtcgaccctctcaagcgcctccccctgcttagggctttggtgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgaaatctcaagctctcgctctccctctgtatctggaaagatcgtctgcccgcaagacacacgagacacggtgatgtatacaggttcgggccgctgcgaagcgtaataccctactcctgtgtttttgtggatttgtgtatgaatgagctccaaagtgtcagccaacttcttccccgttctaagctctaaatctggaaagaatcaaaacccctcctctatgggcaaggtcctccttttatacttcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaagtgccaggccacgtgggcgattgcgtctgcctcaagcctctggtcatgatactcccggtcccatatcaccgacata

SEQ ID NO: 9788 - DNA, 420 bp, Oryza sativa
ccaattttttttaaattttttataaccatttaagtgacatacaaaaaacgaggggatatcccctcgagagattaaaacagtttccctgatgctccatataatactactactactacaagagtaagcgcccagcgttcatatcatatgcatgcttaaaagcaaagtctagttcttcagataccaaatcatccaagatgctaaccatgtcttaaagctctcgcatggttcatataaccttcaacatgtagcacacgcagttgatctatcgatcgatcgatcgtgtctttgctttcaagcaaaattaacaatcgatctaagaaagaaagaaaagctaagctatatatacacatgcattctctcatctctaccatgcacagcagcagcagcttgtatcatcctactagtagtagcttgcaacaa

SEQ ID NO: 9789 - DNA, 1501 bp, Oryza sativa
ttaagaataggaaaagaataacgaatataacctgcggcagcccaggaatatctctatacacacagctagttagagatactaaaaagaagaagaagaagaagaagaagaagaagaagaagaagaagcgatcgattaggaagaggtagctagctagctaggtggagcagagacaacagcgaggtagagccaaaggaataaagctagctaactgcttaccaagaatcttcagaaagatagaacagctatatatatatatacatacactgcaagctgaaattaaaaaggagctttaatacgcaaggcagaaggggaaggagaggccggtggtaggtgtgtgtgtgtgtgtgtgtgtgtgtgtgtgtgtgtgtgtatatatatatatatatatatatatatcttcaaaatatgaataatctagctagacattctctctccatcggttaatattctatctcatactagctctcgaacgaattgaaacaaataaaaaagagaagacgaagtggtcgatctggacacaagttgtgtgttcaactacagctatagcttgttaggtagcaaggagctttgtctgaagcgaagcaggttgctcttgcatgcaagagatcgatcgatggaggaagagggaaagagagctgagagagaaagagagagagagagatgcatatgccaagccatcaagcgtgaggatggcacatataaatacagaggatcgaaacgggcggcttagctggcttatctgcacgcacctctgcctgccaaactgaaacagttatgcactgtgcatgctattgtggcacacagactagtcatatactcaactcgatcgatcaacatgtacacatatatgataccggtcgagctgatgaagctagctgcatgcgagtgatcgatcaaggactgaggagctacgatactacactactttctgttcatgtcactgtacatgcatgtacttgtatgtatgacgatgatgcatgtgactagctatctagccggagggaccaatgcaagcaatgcatgtattgcaattgatatacgtaagcatatactccctccatcccaaaatatttgacgccgttgactttttaaaaaatgtttgatcgttcgtcttattcaaaaatttaagtaattattaattctttttctatcatttgatttattgttaaatatacttttatgtatacatatagttttacacatttcacaaattttttttgaataaggcgaacggtcaaacatatttaaaaaagtcaacggtgtcaaacatttagggaaggagggagtacgtattactcctatatatcttaggtagccatggtggctagctcgatctgtagatacatacgtatacatagagtggtggttagacatcgccatcggtagtgaggggccaaaagacacggaggcttttactgcatgcgttccctgatctgcattttgctacttactggagtaagagtagtaattgaatttcactgctgttagctgcatatatata

SEQ ID NO: 9790 - DNA, 743 bp, Oryza sativa
cccttatattataagacggagggagtacaaattatgcatatgtattatatatatacatattgtttcccccactgcagctagctagtaatgactgattaattacttaaaactaatcgcatctcatcgatgcacacacacaaggaggacgacgacactgtcagatgagcgccgaatatatactcgataaaagtgaaaagcaaaggtttttatagggaaacaaggaagaataattaagggaagcagagaaattaagctgtcagtcagcaggggcggagacagcatgggggcaaggggatctttagaccccctacctcctaatataccattaaagcccccataatctatatatttatagatgaggggctaatatagactttgtttgaggttgttagaaggcccaaaagactaagaaggcccaaaaagttttaaaaccaaccctaaatctctcttagttgctcttggtcattttgatttagcccccgttataattttatcctggctccgccactgtcagtcagtatgaatatagagcagttttaatagtgtatatagtcaattactaactctaaattattgatagtcaatctaataatctatttatctacaagtatatattacaccattaatacacggtatcacttttcataaatacatagttttaaagttggtgttgtagctagctacataaatatgtagtccaattttctttgttatcttcttcatatgtattaatttatactagt

SEQ ID NO: 9791 - DNA, 1501 bp, Oryza sativa
ggacttgctccggatacatgcaacatgaattcatgatcataggtctattttatatgctcaaagactggactatttattattccccgtaagggttatcaactgaatacttgcgccagtcgggaatcaattgttacatctattttggagtatcccataagggataatcactcagattagaagctattcatatgagctacgcttggtctatattacccggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatctagtgcccaataccttaaaatccttttataccgcagttactcaactttttaggagttggtacaatgcatcttaaaaggtgtcaaacagtaaagctttatatagctgccccgctgactttttatatagtcatggcgctgtttgggtttatcaagcaattgattgaatacaacatcattgctttttgccacgtaagtgtgcatttttattgaccaatattatggcttaggctgattatatattttggtcattttccagacgattgataaatccttatgagtttatttactcggattttataccacatatgccatatatttccaggtgtggtgaaaccatgtgtcttttagggactaaagcacgtctgttaaagcagtgtgcgcatggcgtatgcccaatactttggaaatttatttattcacaacatacaagcttctttatagctgttttgctatgtgaattttcaataatgtagccaactttaggttacactcatcatattttacaaagcagtcggtatatcacttggatcatgttatttggaggattcacaccgcatatgctatatattgatatcaagtcacttggttgattacaattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccacatggcatggttatccgactagttatagaggataacttatatctatagaatatgtaacagatcatgacttgggtattacgtttccttgtatattacggaacggcctaaagtcctggtttgataatattgtagagtagatttaggaaaccaataccgtattggttgaggtttctatcttgtaaccctgccccccaacctatataaggctggcagggagccccctctaggggca

SEQ ID NO: 9792 - DNA, 1501 bp, Oryza sativa
tccatttcaatcaattgactagctagtcgtcggtcggtctaggacttactccctccgtcaaaaaaaaaaaaaagtcaaaccccaggtttccgtgtccaactttgactatctgtcttatatgaaatttttttataattcgtattttcattgttgttagatgataaaacatgattaatattttatgcgtgacttgtctttttaattttttttatattttttttaaataagacggacggtcaaacgttgcacacggaaactagggtttattttttttgggacgaagggagtatatatcttgggcgttgacgcctgctttaatcaagccgctaattgattgaccaacgtactagtgactgcatgatctgtacgtactactatctgtctgtagctagcttatcagattaatgcatgcattcatgctcctatatactactccagtagtggagtagtatatgctatgactaggagtatctgatatcatcgatcgagcagctgctaatgctgatgctcatgtcgatgctatggcggattggcaggcgaattgaagggcagtgtgcacaacgtagtagagcttgagatgcagagcagagagcagagtagagagcagatgtgacgggcgggccacatgcggcgcacgtgcgagattctgttggccacgttaattggttcatgcatggatctgctgcccgcccgtacattttcggttgatagtactaccctcatttctccgcctgccaacacgaacaccacacccatgcaaatgcaaccaacccctcttccattttactcctccacctatctactagctagtactatactctatttactgtcctgtaaatatcatcagttactacaaacttaactacaagacacattaatcaagcatctaggagtatgcatgctgttacatactgtatactactacactctgcatatgctgctactaacattgttaacatgtcatgaatgctgagcaatgctagcaaagcaatgcaatgcaatgcaaagcgaccagatctgtgagttggaggcctcaacagtgcgtgccgattacctttttctttctttctttctttcttttgccactcatccactgcaggcaggcaggtcgtgcagctgcagcaacaggacagcaggccccttctccttggctctgtgtgtgtgactctcatgactcacacgctctctgatgactactagtgctactaggacagctagcaatttggccctccatccctgaaacacacacaaatgcatgtgcacgcaatccatccgtctatctgccttgagtattttattatgaaaaataagacttagaagattaaaaaaaaaactagtactgctacattttgctttaggtgtaaacatatatatctcattatctaaaggggaaaaaagaggagaggtatatatatatgtggtctatctatgttgagttttgattataacaatccagattgatcaatgcagttgtgtacaaaatgctattggatttgtaaaa

SEQ ID NO: 9793 - DNA, 1501 bp, Oryza sativa
caagttaaaatttggctaacttgcacaaaaaatctactccaacagactagctaaatacctctccaagccatctggctggctaaattccccaccagactagccaaagttggccagccaaaaccggctaaccatatgtgggacccacgcctgtttccccctctctctccacgcggcacgcaccaatgatgagggcgccaccgccccgtcgtcgcgcggccagcccccgccgccccgtcgtcatgcggccggccaccgccaccgccaccgccgagctccgcctcgagctccgccgccgcccccttctagatccgccgttgaggtcgtcgcgagccgccgccgccgagctccgccccgagcggcgtcaaggtcgtcgtcgcgagtcgccggcgtctcgcctcccgcctccccgcgtcgccgcaccaccgcacgcgaccgcccacctcctcgcatcgccacaccaccgccggcgaagagagctccctccctgcctgccgcacgaatttgccgtcagagcggcaccggcggtgcatggggacacagctcgagcggcggtggggatggggatggggcggcggcgacggatgggagtgggaaggggggtttggagagaaggggagaaagatgagggagaaggaggtgtagagactgacgtgtgggcccaattatcatatagactcagaatagagaggacgaatggagaggctgttggagtaaaagagagtttaacttgctaaattaaatggagagttgaccaaatagatgggcctgttcacattgataaaaaaaaacattaccaaattttgatatagttgccaaaattttggtacgtttcttatatagttaccaaaatttggcagcaaactaaatgtagccatttttttggcaacttaccaaaatttggtaaggttgaaaataacattaaaatgaacaggcccgatatttggagagtcaaatttgaagtgattgttggagatgcttttactgtgcataaacgaaaaaccgtgtgcagccgccagtttgctactttgcaaacgcgtcagtagagtactactccgagtgatgagtgtgtgggtcgtcttcccaaccgaacgcgggaattaaagcgcgggaagcaaatggctaacggctgaagaaaaaaaaaaaacagcagcggccatggccatggtggacagccaggttagctcatcacgggccaagccgctggtttttcttcccattttccactaccacggctagggttagggttagggcagagagctgagctttcacgagctcgccattaatgtcacactggagcgagcattcatgtctccctttcagatggtagatggctccgcatttactccccccaccccactgtgtacatgcctccgccgctatatatctctcccacccacccactcttcctccactccggcgagctataccaagctacgaggtgaagaagctgagagtgatcgatcgatcgagtgttcgacggcggcggcgaggtcgaagatgg

SEQ ID NO: 9794 - DNA, 1501 bp, Oryza sativa
cagctgcgccgtgcccgccgcaccggcgagccgtgggaggtagatggcgccaggggcaatctcgccatttcaaaaaatttcttacctcttttgacccgaaaattataaaatattgtctacagtgtcctatagccaattacacaatttttgtagtgtccatcaaccgtctcacgttttttcggtgtcttccagccaattacacattttctgagtgtcctgtagtaaattttgccttaaaaaaatcccatgttttctctactcaaggataaatattcctttatggttcctccttctactaatacatccaaaagcaccaagctaataaaatccacgtacggatgcatgatatactagactcaattctctgttactatgagaatttagatggttcatttgcaaatattatgaggtctaaggtttgaaagcaaaccatcacctttattgtaaaaaacatttggtttatgttcattccactgtaatgttccactagaatccacatgacataagtcatgtccatcccactgttggaattaatagatgggctaaggcccattcgaagattaattctttggaaaatcataaaaacccacctcatgggatggcatgcatgtagagtttagtaccaccttgcttattctaggagagagggacctccttaaaagggaggatgccctcctagccaattgaagcatgtgtggtggagagaagaggggaaacaagcgcgcgctcgctcgcctcgcctggcaggcgacgcgcatgcacggcgtacgcgtcgaatggtccgcaaaattggctcctcacctttgcgcagatgcagtctccttttgcagttttgttttgctgcaggaaattcggatttgttttgttttggaaacattccgaaaaatccggtgcgtgaaaacggcatggagccaggataggttacgcgcgacttatccggttcggtttacgcggcgccctgatcaggcgatctatctctatataaaccgagccgccgccttcacgcaacacacgcgaaatcaatctagggtttgcctcctactctgtaatgcgccgtcactcgtagactactccatcccgctcgccggcgtgcaccggcgatcaggagagcaggtctccggaacctctgccttcgacgtcctgcaccgggagaaggcggcaataaggtttttgggaagcgcttcgcgcgactgctccctgttcgtccgtgacggctcgccttcttctccgctcgcgtgcttcgcgccttcatcgacgctcgcaaccgcgagtagttcctgccgagcaaccggtctttccgccacctcggtacgtgttcgatatgttgtgcatatttgatttatttatgttttactgcttagtttacatgtgtagatctaatgatgtgttcaatctagtttacatctgcaatgtcatgatttatttatggaataaattaaatcactatgtgcttataatttcaacaatccaaaaccttattgtaggcactgtgattttacaa

SEQ ID NO: 9795 - DNA, 1501 bp, Oryza sativa
aattatactaccaaattagcaccttcaaaaagctaatggtatgatttaaggagttcaaatttatacccactacattgataaatccttgtcaacttttactaaaatggagttaccttggcaataatttgtttatgcccattttgacttctccattaataactggattatgggtccactgcgtttttggcgggcaagtaaatgaggaaaattaatgaggccaaatgagtgaatattaattggaaagcactcatgggctcgtggcacatatttgtgaacaaataaagtagtaaaaagccatagtaaaaagttacaagtatttgtgaaggatatcaaaatcgaatgggattctgattttggttttgaacttcgaatatgtcagaaatatattcagttgctctttctctgacaataaatggtacaacctgtggcttttcagaaataacacgtcaggcactgacaagctatttcttaacatagcgctgtaagatagattgtgcttgactgctccttgtgtcaatggactactttgatggtgttctctttttatcatatctactttaccttctagtacttttatctacatggtgggaaaataagtaaaaccaatggattgaataacaagattgctgctcttgtttgttttgttgcagtgccacttttcaacagtagcttcatgtgttatactaattccttttttttcttctgtttcatatggtttgctttatagtgactccttagaaactacattattttctgatgcttctgaacacatgctatttgcactggcaacgatggttttgtttgataaaatgtacctttttgttgcagactaaaaattctgatgtacttctggaatcttcaaatgggtctgattctttaaaggaagagaaaaaccattactatccaggttcatattatttcatagtactctttgtatttccttaaagtatatagtccaggtaaattttatatggcaaatggttgttttataattcggtatcagaaatcttatctaggtacaactctataatagtcccatcaaattaggctgactttgaacttcttgaatcatgatgaaactgaatccattcttggcccaactttctcattgaagcattgaacacaacaggatatattatgttttagcaaccaatagaaaggacgcttctgatccatgaacagacttgcacatgaattgagattaccccgaacgtgatgtcgaggatgaaactgctctcaccaaaaccagatagagttgaattacataactaggtgacctgacctgggatgtttcactagagccttttctttctctaaaagattctaccttttcttttccatgaattccctttttttattcatgtacagaaactcttttgttattttatttcagatttgcattggttaccttcatccttaatgaggtatccaaaggcataagctgaacgtgtcatttttattttgacaaaaatataatttgcttccttttatatttataggc

SEQ ID NO: 9796 - DNA, 1501 bp, Oryza sativa
aaaataaccataacaccatttccgagttcctaatgagtttcaattgaaattctaattggtctatacttccaacgcttgtagatgtctactgtgtggcaaccactaggctattccggagattatgaggaaggatcattgcctcacatcttgtggctcatgctgcaacatcttggccataaccacccaccggagtatcatttcttttctcttgaacagagttcatctctccgagcttatatggctgagctgtgtatacaaggattttggacccatgaatcacccatttactttcaagcttatggttgggatgcaccctcagcaatgcatgaggccgcatttcaagcgattgtgtattatcgacatcacaggccagggatggatgtgttctttcactattttccaactcgcacaaatcaagcaactaccaattactatccaggtcttgagggaaacatgagagagattgaaattcacagcttttcttagctggcctagttcgtgctatggatagatatctcgcgaatactatagctgagttgtgtagattgcaagccagagtcgttatgcttgatagaaaaatagaacaacttgggcatcaagggcactttgataatgccattatttatgggaatcaatgaacttcaacctcttactgagactttgcctcctcaatggcgtttataaaaacataaacactagagcccgcataagagttggtttccactgcaatcgtccaaccatgccagaccctgcacttgttggagatccagtgttgctgggaccattctacgtgtttgagcggaatgggagacaataccatttgaccatggccactccgtcaaccacggtgcctcaacctcctatcggattctcccaagttccatagaatgatgtactaaaggaaaaatgtatggggcgtaacttacatttctttttccaaaagatgaatgagatgacaccctattatgtaatccttctaatggtcaaaatttgtaacaccgaggcatgaacttggtttcttatgaccattatccaattctatgtatctatgatcacttagatcctttggaactaatgtactggaatgagacttatactccttttggaataaattgcttgttgtccagaaatttgttttatacaaatatgacacgaatgacttgtaaattcagctataagaaatcattcctatgttctatatatttagggtgattgtcacgcccataaatttagcccaaatttccagactattttgtgtattaaatccctgtccaggaccagccggggtacacaaaacgacaagtaaatatacagatccaaacgtaaataaagcgtaaaatacttacagaagaggcacttagtcctcacaccgaaacgaaagcagcagcagctgaaaaaggcaatcctagcggggcttcagctccactccacaggcaaaaactcaactggggtctgagccttggtcctctaactttgtctttagctcagaagcactacactt

SEQ ID NO: 9797 - DNA, 1501 bp, Oryza sativa
gtccaccgtgcgccgcccctttgtgccgctgacgtgcggggcccgcgtgtcggcgccggcctccccttgatgacgtcagcgcgtccctattcctctgagaaattaatcattaattgtgttataaattgtatttaattctagaaattcatttaaatggctcaaaacttctaaaattcaaatctaattcatatgaactccgaattgagccgttcaacttgcaaaattcatctaaaattgagctctacatgttttttttactttttatgtactgttcccttagtgtttattagagtttttccttgttttgtgtgccagcgtatagaatccgtcgtttcggaagtctacggtctcgaggaaaagagttcagaagataaaagtgaagaagcaaggcaagtcacacatcccccttgagcatgttgatccaaatttataaatgttttattgtttgcaaataaatatgcatcgttttactaattacatgggtatagggtttacctatctgcttgcttgtaccatgttatttgatatgtgtcctttgtcaaccttgggtgataaatcgactagcttatgttactttgatgacctagctagaactatatgcttagcgatgcttaattaccactagctcagtagatgggataattgcagtattagacatgttagtattatgatgagctacgtgctcgagacatctggccatgtttcatggtcataattatccaactaaaatacgactgaatagcgggttgtgggtgcatggttttgctggtcgcacccatggcaattaaggaccggttcgcgggatgcactagaagacatacaacgcttgccacaagcgggaatgggtaactgcctgccttgaagtgtagcttttctctggttgacgcatccaggcaagggtgggcgtgatggagcagggcgggccctgcgacggcctctgtcgcttccggattcacctagccacgagaggggactgtccgctacctgctgggggcgggggtgaagcctgaggtgtggtgtgcttggtcagagcgggttatatgaagggtcttgtcacaatcactcgacatggtgacgtgtctggccgggcacggtgacatgccagtggattgtgtcttgtgggtacagttgtgcacctttggccagagtaaaactattcgaatagccgtgcccgtggttatgggcgatcgaccagaatcaccgtgattagtctcacacttaataaatcgacccaatgcactgtagttcaggtgggtttgttgggcctgttcaacgtggtgtagcgttgaccagtggagatttaatattaccttaattactcaactgttttactgtttgctaaataaagtgttttacaaccgcctttatgcaaatagccaccaaccgtccttgtatccccttgcacgtctgcatcattggtgtggcttgctgagtacggtggttgtactcagccttgctattattttcccccttttaagaagtgtagtgcttctgagctaaa

SEQ ID NO: 9798 - DNA, 1501 bp, Oryza sativa
agataactcatcggctgaaatcccgataaacccgtattgccaatcaaacacatgttagtatttttttattctaagcacaacttaataggtcaaactcaattgatgcaacactaagtatgaaaagaagcataaagtctaaataatcaagcttttgactgatttttagagtggtgaatactttagctaatctagatcgatgaagcaatttaactatcaccaacaaaataaattgagacatcgacttagattaactaagataggtgtttacatcaacaatgttagagtgtcgtggccctagcctcgtcgatacaaacagccataacaagccttaaccctcatcggagatcgaagccgatgcaacccaacttgttgatcgagagataaattacaaggacctcatgagtatatatttatagccataggtagatgctagtctatattggacacaattcaaattttccttaagatgaaaggaaaaacacaagtcctgatcgaatgctgaatacacttttctaaaaataaaagaaaactaactaaatctgcctaattaatagataaactgccaagacacgtcctccttgaacacgatctcttctagataaacttctttgaccgaatccatcaagaatccaactagtagcatttcataatatccatcggtcgatttcaggactgtgaagctgatactggctctaggccgatgatgactttggggcttaccaaattttagcattaagagacggcgggcaagtggcaacagccggtgggcgcgcagcagccggtggtagtcggccggtggcgcatggtggtagagaagcggccacagagccaacgttgaccgaagagagtcgaagacggcgaggggtgcatagctgtcccctgcgtggatctggcggcggtggcgagaggagcatggcggcagcggcgggaggagcccgacggcggtggtaggaggagccctccggtggagggcgtgcggcgggtggacggtcccgcccggatccagcagcccacgggtccgtgtgggcgcgcatttttattttttgcgatttcttttttttttctgttttttgttattgcgttcggacgacataagcaccaatggattttatttttgcatgtgggtgcgccacccgcatggaaaaattgtgatttttgcggacacttccgagcagacgggccggaggcccgcacgcggaaatctcttttggatgtctggagaaattgtttcaatactagtgcattgaatttgttagtttgtgtatctaaattattggggctggtttgtacttcgttcttcatacctgatttgttaataaggtccatgggtaaagaatcgtagatcctcctacctatctggtgctatataaacgaaatgttatatatagagcttgccggcttactgctttgagcaatcatgcgctgtagcagcagccccttcagtagtactagtagatcgagaacacttaagccgcaagccttcaaaggcaatagagaaaaa

SEQ ID NO: 9799 - DNA, 1501 bp, Oryza sativa
gagagctataaatcgaaaccttaaaagagttgaacaacctcctagtagccaagtaattcatgcaagaaagcaaagagatgtatcttacaactgattggctcagtgacgatggaagcatggtggtgtgagtggtagcgagagtacagggcatgatggtgcagtgcacgatggaaccagtaggatagaaactcaaccgggccagcgtgcatcaggaccattacaagggcgccgtctcttctccttagtggcattccttgcccgagtggcatcaacaggaggactaggtattccaagtggctgttaagatgaaggtatcatccctgcaaaacaaaattaattttcttggtttagatttttactgaccatttgtctgaactcaaaagaattaaagcatacacgaacttggcatgtccatataaaaaatcatatatagagatagaactagaggagattttgcaggtgagatacatatataccagttgttctcacgatccactttgctcgaattcaataccacgttctacaatccggcgccgattgccacgggcatccatgagccgggagatggttagccagacctggctatggagaatccttagcaacatgaaaggaagcacactgaggtaggccacatctttctctcccaacttcttggcagtggccattttgtggcatccgtgaagcacccatggagccaggggcggagctagagcgaaacaacaggtggtgccccttgcttaatttactctattttagattgagtttaagctaatacggctgtctaagtttgtattgaggggtgcatacatggtgaaaatagatgaggtagagctaaaaaattttcttgaccggattcctgggcaccctgcattagcacatgcatagacagcatccacgcatgtttatttcgtttatgctcatcttagcatagaatcattttttctctctctacgtaaattcatgtactggttgctaatgaatttgaaaaatcactagcagatcatttgaaatggaaaattatgtgcagaccatatgtactcccgagaacattgttacctttaggtttccaagcttttgccatggcgattcagtacaaaaggccaggatttgtagccatttttctctattgcctttgaaggcttgcggcttaagtgttctcgatctactagtactactgaaggggctgctgctacagcgcatgattgctcaaagcagtaagccggcaagctctatatataacatttcgtttatatagcaccagataggtaggaggatctacgattctttacccatggaccttattaacaaatcaggtatgaagaacgaagtacaaaccagccccaataatttagatacacaaactaacaaattcaatgcactagtattgaaacaatttctccagacatccaaaagagatttccgcgtgcgggcctccggcccgtctgctcggaagtgtccgcaaaaatcacaatttttccatgcgggtggcgcacccacatgc

SEQ ID NO: 9800 - DNA, 1113 bp, Oryza sativa
  unsure (1)..(1113): unsure at all n locations
tggggtgggggttttaaaaaaaacaaacccattttttttttttttaacaccaaggaataggggggaaaaaatttaccccaacaccggcgggggaaggagtacccccccccccccaaaaaatttaaaaacctgggagggggggtttttttaattttaaacccaccccccccccccggtgggataaaaagggccccccccccattatttttttgatacacaacccccccaaaaagccgccttgttttaaccccctccttttttgaaaagggccccttaaaaaagaagccccccacccctttaaatatttgggggaaaaaaaaggaacaacacggttttttttcctttctttcaaaaaaaaaaaaagggggcgtgcccaactatggtgttaagtttccaaaaaaggggcctcacccctggggaagaagcaccctctttaagattttttttccccaaattgaaatttgtttttttttggaaacgtccaaaaaatccaatgcgtcaacacgggtggaatccgattagtaccgcgcgctttatccggttcgnttacgcccagtagatatcgtccgggccccctgatcaaggganccttctcttatataaaccgacccgcggtcttcacgcaatatatgcgaaatccattctagggtttgcctcttactctgaactgcgccgtcgctcgtagatactccatccggttcgcgggcgtgcacagcgatcggaagagcaggtctccggaacctctgcctttgacgtcttgcaccggaagaagccggcaataaggtttttggaaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctacgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 9801 - DNA, 1501 bp, Oryza sativa
gatgccgatattaccaaatttggttgttaacacacgcccatgctgctcaggcccaaccattctgaacaaccataccgagctgtacagatctaactccgaaccaggagctaagcaaattattaccaattattgcatcaataattattgtgagaggtatgagactaatcacgaaaacattgctcaactcacccataaccacgggcacggctattcgaatagttttactctggccagagatgtaccactgtacccacaagacacagctccacaacatgttaccatgcgcctcaataccaccacgatatctcagataggaactgtgacagtaccccttgcacaacacaatccaccacagtgcaccattcctggatcataatcaccccctcaataaccagaggcgtggactcccagtgacccccacggacttctcgccgcttcacagtctggtgccccgcaatgtaccatactatacaaaaggtaaagccgttgcccacgctggcttgtggttggcacggttaatgtctcacaacagtagctcgcgtactggtccttaattgtcatgagcacgaccttcaaaaccatgtgctcacaacccaccattatcaagttttaattatcaattaattatcataacacgattaaccatcgtgagctaccattaaatataagggacaatttcgtttctaaccctactttgttgtctaatattgattttacccctactttttagggttttcgtttttgcccccacttttttgaaccgaactatcgttttgcccctactttggatggttaagttaacggtgttaagtaattagcaaaaggacatttataccctctcatatctctgttcattaattatatctttgcccctattttatgcatgtagctttagaactttatttttgtgagtatatttaaaattaaatgaagcacattgactaatatctaaagagaacagataattacattttacataatgttgccaaaattttgtttaagttctatcaaaatgctgaaattttgtcaaaattcaatcaaatacagaatttttccaaattgttatattagtcaatgtgcatcatctagttttaaatatactccaaaaataaagtttcaaagctatatgtataaaatgagggcaaaaacacaattaatgaacatacatgagagggtataaatgtcattttgtcaattacttaacaccgttaattttatcatccaaggtaagggcaaaacaagcgttcggttaaaaaaaatgagggtaaaaacgaaaaccctaaaaaataagggtaaaatcaatattagacatcaaattaggggcagaaacgaaattgcccctaaatataaccataaataataatgtagtaggattcatcccattaatgaactaatgtttctaggcatggctaagcaagtatatatatagcatttagctgaaccaaaccaatacataaggttcaagctaatcaatttattacccaaggtatcaaggaatagg

SEQ ID NO: 9802 - DNA, 1501 bp, Oryza sativa
aaagattataagagttgatagcatagccgatcaaatagacccagcatgtatcagctaatactccaataaaactctatataaagatattaaagcaagcaaaatataccaaacagaaagcttaatatacctgaaagccacagcatcttaacataaagggctgatctagcatgtcaatcaagcatataagatataaagctaaatcaggtaatatcggctgaaaccccgacactactttaatcagcgaccaaaagcaggttaaagaatgagattctaatcacgacttataaggtcaaactcaactgatgcagctataagtatgaaaacaataacaatatctaaacaatcaagcttttggaaacttcatagagtggtagacaccctatataatctaagtcaacgttggtatttaacctaattggccgcctcccattaacagatgttagccgattgagggttaaataacaatattgctagagattacatagaatatatgataacttgacaacttacatgaacaagattagagtattataatgatggaagcactaatcccgagaacgcaagctgccatgacaaatttacctctagttgatcgaaaccgatgcagctcaacccgaaagcaagaactcgtcgggatgaaacgaaagtaaaaagggtggcaatgcgccaagattgatattgaacgtgtgttgtttgattacatggcttcgagtcatatttatatccgagatacaaaatatgtccttgtcggacacgactcttatcactaagaaactctaagataccataagtctttgcggcagacttttgcccaagcttatctctaagttatttacataaaatatcctaattaatagatacaattgccttttcagaactcaatccgtgtgtggcaatccatgtgaagcacattaactcaactcgatgatgtgtatcgggacactttgacggaatcggctcaatcggctaccttgtccgactcgaactctgccaatcctggtcgcagccgattcggatttcagccgattcttactctgtttccggaagatccatatcttggattctgcttcgattttatctttaccttcgatgcctgaattaccaaatttggttgttaacagatcctacatagttaatgctatttctctcttctcttattatgccacatgacctcaattatttctagcatttggatgatagagctgtggttcaaattgtctcttctttcttctctcataacaccatgcaatctcaattattttcggcttaaaattcataagtatcaatttgttttagttttaataattgtattgtatgttatttatacatatgatataacttaatttcccgcagcaatgcggcggggtattcacgtagtaatatgacatggaaggagtaatagcattctaatggccagagcattcactataaattgaggcatatggtgcaagctactgcatcatatcaaggtcgatcagcacgtacgtaccccttgaacgta

SEQ ID NO: 9803 - DNA, 1501 bp, Oryza sativa
tagttggttggcgtgtgtgttacttgcttggagttatcatgcagcagcttgctggttttgcttgcgtgtgtgcaggaccagcagaggctgtcggcctggaggcgcaaggcagagatcttcccattttgttctaggattcttttttttaaggtcatttgtggcatctttgtttcatgtgttgcatccaaaaatggttaattaagtaatagcatttatattaccaatttgctttcaactcttaatgaaaaaagctccgaccttggctgtttagcagtacatccataactctgagctaggccgagttggtgtcagcctgctcgaggagaccgagtgcgttcgggatttgatgctggattttctgtgaccggtgcgtgcggttacaggttttggaaattgaaggattgagtcctactgggaataggagttttatatgtactttgaatagaggattttttgctataaatagatgagcggttgaggctagaagataacgacttctaggaaagaaaagttagggtttacttcgtggttttaatcctatttcgtgaattgagagatgagtgctttaggtgaactttgtaaacacatattgatgcaaaaatgttgatatactttcaagtgttttgtcgataagtgtttttctggatcccaccggtttgaccggaggcgagtcatcggtctaaccggcgggcggtcacaccggcggcagggagacggtttgaacgacagcaaggcggcggtctgaccggtgggagtacggcagtctaaccgaaggcggcgcgatggtctaaccaggcaaactacggcggtcggaccggcggcttagaagcggtgtgaccggcggtgacatgactacgtcgtgatttccatcgatttgagggtaacttttatttccgctaaaagtttttgggttttaggttttccctaccattcacccccctctggaaggcttggttacttgtgttcgatcccgttgatgcaaaaaacacacagtggcctggaagatctgcttaacttcagtgcaggtccaaaaaacttaccttttaggttcgtgagtgtcccagttgatttgatcctgcaatcaacaagaaattaaataggaaaatagcagttaaacccataaatgatagtcgatcggccagccgccgatgacatatcgttaacctttgagccgatgtcatatttgaatcgatcggcagttataaataagcaaaatagaactaaatctactcgatcggctgtagatttcatcagtatataatccctttgtcgatatatatttaaaccaagtgattggaatagatcggttgccatgccgagacagtataaattatttagatcaaaatatatataaaacgaaaagattataagagttgatagtgtagccgatcaaatagacccagcatgtatcagctaatactccaatacaactctatattaagatattaaagcaagaaaaatataccaaacagaaagcttaatatacctaaaagcaacagca

SEQ ID NO: 9804 - DNA, 1501 bp, Oryza sativa
acacatacattcttcaccaagcatgtatcgatcacacatacacgtacagcacacgtacatgcatctctgctacagtgcctcatgtactgtagcagccctttttctcctccaatttaatccaatctccttcgcgaacaccgacgcttgcacgcacacctcgtgaagcccgttgcataaatctcccccacacggtgtccatccaccgtgcgccatctcgtatccaactttgtcacccggtatgcttgaccgtatggacctcaactccgccttgagtctagtcccgatccccaccgttgaccgaagttgacctccaagaattctgattctagtcaccttctcaaatggtatcctgaccgcactagacctctgctcctccccaagaatagtcccggtcctcaccattgaccaaggatgacctcaagtcacctgcacacaatcagacaaaacaaccgttcctgggcacatatatcacaacatgacccacattagtcacacgaactcacaccaacatccacacatcttttcaaaccattttatcgaataaattattttgcaaagccaattattcatcacaaatattaatcatgacaatgatttcacaaactacacttagtgggaatgaactatatcagtatataggataagtcacttcgaattttttttctaatcatcttttagtttgatcaaatttatcgaaaaatttgcaataacaacaacattaaattaaagtttcatcaaatctaacatttgaatttatattaataatatgtttattttgtggttgaaatgctactgtgcaaaagctaaaaaaattgccttataatgctagaagttcaattgctctcatctggcggtagattaaagtgttagtatcagttaccactcttaattctgctcttgatatatagttccaataggtctatttagtgtgtgtgcgtaaaatttgaagtttattacaaagttcttttgtcccataatttacacagtgcaaataatctattttctgatgtgttttacatatatacaaattcaattgctgattcgccttttttttaatgttgattcatgtgagagtatcctcgagtgttacgacttgcatcttctatgaaggccaaaaaccttttaagaggtcaatctaggatgaaaattaacaggatgcttaaggtatcttagaatagatcgagtaatatattgtatgcccatgatgtcgaaacaatatttcagcaatactaaaagggtgtgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 9805 - DNA, 1501 bp, Oryza sativa
cttggtcaagttaattaacagttattttcctagacaattatctacgtgtgggaattaatggtgactaacaacatatatattgtatgattctataatcttgcaggaactgtgcaggccgacgcagtccgtagcctttgtttcaaattaattgagtcgtcaagctagtaattaataaaatgaaattgtgtgtcgtcgtgaagccagtaataattgtaatggatttgatatttatcgatcggtctaaggaagcgttgtggtctactagatcgatcaattacttaatttgtataatttgtatcaattctcatgatcggcctctttaattaattatctatatgtatgtctttgcttcagttgttggggagactgactttcttgttggttaattttgaaagctaagaacataacaacagtcaacaaaagattatttgttatgtccaggcttgtcttgtcaatttagtagcccgaagcgaagctagaaaaatggatcatttaatacaaccactataacggataccctcatctcaatcgggcggtaagcctcatctcaatcgggcatggcgtccgtcacaggctagaagtcactgatgtgaagagctatctcaatcgggcaaacggccgtcacggatgattctatctcaatcgggccctaagtaaagcccgtcaccgatagctttgacccagacgaccagtcaaactatagcccgtcacagatgacctatctcaatcgggccacaactagcgtccgtcacagatgacccttatctgtgacgggcattaactatagcccgtcacagatgactcatctgtgacgggctagtataggtcatctgtggtcaacggttagctactatacgatcagttatttattttagttaaagtacctactactatcaaatgcgtcatgacttgtgcgtcaccggaatgccccatcgatgatgtcactttgatagcagtttatgccaggcacgaggcatccacaagctacagcgcgtgcgggggcgggggggggggattaacggcgtgcagcgctggaaaatgcttacatcttagtttggggtaccaaccgaagccttgttggcccatatgtgatctccttgagcacagtctagatagagcttaaaatttttggatggattttccttagaaataagtctagattgagtccctcaaataagggtccaatctaacttgtacctctcaaccacaatattagaaatcttgacccccgtaacaattgaaaccattactatttaactctatgataaaattgatagtggtatttgttgatgtgacatccacgtgtcatcctagtcgtcaaacaaaataaaaaataaaatatgactcaccagccacacttcccttgctctctctctctccttccttctataacccctctctctctccccccatgttttcttggcggtagcagaggggtacacgtgcagagggtggccgcagggcgacagcacaaagccttccgcatcaagcggtgcctcga

SEQ ID NO: 9806 - DNA, 1501 bp, Oryza sativa
taccgccaagaaaacatggggggagagagagaggggttatagaaggaaggagagagagagagcaagggaagtgtggctggtgagtcatattttattttttattttgtttgacgactaggatgacacgtggatgtcacatcaacaaataccactatcaattttatcatagagttaaatagtaatggtttcaattgttacgggggtcaagatttctaatattgtggttgagaggtacaagttagattggacccttatttgagggactcaatctagacttatttctaaggaaaatccatccaaaaattttaagctctatctagactgtgctcaaggagatcacatatgggccaacaaggcttcggttggtaccccaaactaagatgtaagcattttccagcgctgcacgccgttaatcccccccccccgcccccgcacgcgctgtagcttgtggatgcctcgtgcctggcataaactgctatcaaagtgacatcatcgatggggcattccggtgacgcacaagtcatgacgcatttgatagtagtaggtactttaactaaaataaataactgatcgtatagtagctaaccgttgaccacagatgacctatactagcccgtcacagatgagtcatctgtgacgggctatagttaatgcccgtcacagataagggtcatctgtgacggacgctagttgtggcccgattgagataggtcatctgtgacgggctatagtttgactggtcgtctgggtcaaagctatcggtgacgggctttacttagggcccgattgagatagaatcatccgtgacggccgtttgcccgattgagatagctcttcacatcagtgacttctagcctgtgacggacgccatgcccgattgagatgaggcttaccgcccgattgagatgagggtatccgttatagtggttgtattaaatgatccatttttctagcttcgcttcgggctactaaattgacaagacaagcctggacataacaaataatcttttgttgactgttgttatgttcttagctttcaaaattaaccaacaagaaagtcagtctccccaacaactgaagcaaagacatacatatagataattaattaaagaggccgatcatgagaattgatacaaattatacaaattaagtaattgatcgatctagtagaccacaacgcttccttagaccgatcgataaatatcaaatccattacaattattactggcttcacgacgacacacaatttcattttattaattactagcttgacgactcaattaatttgaaacaaaggctacggactgcgtcggcctgcacagttcctgcaagattatagaatcatacaatatatatgttgttagtcaccattaattcccacacgtagataattgtctaggaaaataactgttaattaacttgaccaagattatattttgatcagtggtcgatcaccttgaatattgtggtagagacgcatgcatatgatcagtcgtggata

SEQ ID NO: 9807 - DNA, 365 bp, Oryza sativa
aaccagttgtgtccacctagatatcaagcacaggaaagaatcagcctatttttaattgagaacaaaaacgcttgcataaagcaagccaaattgttccaccgttcttttaactacttaattaatctatctaatcagattgattaatgcctccctctttagctttaattaatcctctctctctctaccatgcgcacaaatttttagttcagcatagtttggctttttctagctagtgctcacctccagctatatatacacatcacaagctagctgctctctttccttgcttgtttttttctcaactcgatccatctctctctctctctcgatctctccattaatttctacgtaagcattcgtagcta

SEQ ID NO: 9808 - DNA, 1501 bp, Oryza sativa
gcgccgtgtaccgcgacgcctacgccttccaccagtaagtaaattcaccactccgtattttcgttcccaaaaacacacaaatacacataagggctcaagagacggaggcaaaacgataaatcggtaacctcactaaattcttattgaaaaacatcacattcacacagttgtctcctttgccaatccgtaacctcactaaattcttattgaaaatgtcatatttatacggttgtctcctttgccactccacatctggccacgcatacccaattactcactccgttttatgttttatattattagacgctttaattttttaattaatttttttaaagtttgataaagtttataggaaaatataataacatttttaatgtataacaaacatgttatcaaaatatattaatgttacatctaattaaactaatttgatgttgtagatgtaggcaattttttttatgaatttaattaaacctaaaaaaatttgaaaaaaaatcaaaaggaattataatatattataaaacaatggggctagtaaccaagagctatatatgtgtaattaagttggccgcggctagctgctgccggctaagctaggataagcattcgtgattcgtcgacacccgatcgagggcattaacacgccttcctcgccgatttggacggcaaacggcctgaccaaatgcagccatcactaaactctacactacacggatatatgaattcttcgtacgggctcgtgcgatgactcgatgatcgatcggttgttggttgatgggtgcatcgctttggctctgctctttgtttggtgagacatgcatgctttgtgacggcaacgcctagctaatcttacaggcagagaccacactgctccattattagaggtcatcacaattcatcatcatcatcagccggcttctagatgattttgtaattagagtactcttaattatttgtgctcaatttatagatataacgtgtggacctacctaattataacctacctagtacacgtagtacttcactactttgacaaaatgcacctgtagtatactagaggtactatatacggagtatatgtaagttgtcatgtaatggtagacgatttttataaattgcatgcaattgaatttcactctacttgcgtacccagtacagtaaaattttgctactagagcattgtactgtactacatttatttttaataaacgatgccgctgattttttaatacacgtttgatcatttgttttatttaaaaaatgtaattatcatttattttattatgagttgtttgatcataaaaaatttgatattcatcaaagtttttaaataaaatgaattatcaacatcaaaggacgccgtacggaggaagcaatactatcgtaaaacaaggggaggttaattttaattgtggtcatgattaattaacagccaataattaactgttactgcatcatttgatcattgattatactatcatcaggagttacattgagatgg

SEQ ID NO: 9809 - DNA, 1501 bp, Oryza sativa
gacgacgaggacggctgagagcttcccacagcgatgaggatggtcgcgacaacaagggagagcttctcgaggcccggcagcggatgatccatgctcatgaggcccaacggcgacggatccaccgctcccgaggcccgcggcgccggcagacccgcacgcttgatgcctgatctgcactctcgaggccggtgacggtagatccagcatgcttgaggcccagcggtggtgaatgcaccacgccgttgccatcatggtatcggttgtggttgttattgccgttgccatcacggtggagatcctttagtctcctaggggcccgctagttgcgggcgtggtcgacaatggtggcgatgggtgggagtggaggaggaagtctgggtgcgatgatgagagagaacggaggaggaattagaccgaggagagggaggtgttagggcaggagatgaggatgtaggagagcctgctcacttgggagatggagtagagagagccgagggaagagagatggaggacttagccatggttggctcttgttctgaatttaatagcacgcttatatttgcagttgggcctctttagtcctgactgcgaaaatcaatttttacacgtgaggtctaaagtgctctgcctgcaaaaataaaaacaatgttttgggaaaaaatcgttttttatagttagtgtggctcttttaacacacgtttaaagaaatggaggtcagggcaaatcccaagccttactaaatatctattaacattacactgaaatatgccatgtgtgtaatcgtaggtaccaacatgatttgaatcctaagccaatgggtagactcatatatatatacacttacaactctaccctcacatctctgatgcttccagagaaaaaggctatttagccacacgttccgttgcattcacacattttatccacacaatctcctctgaaaatggacactcgtatacctgtatcctgaaaggatccccgcccccaaaagctgagggctcacagataaggtcaccaaccaaagcaatcctcacatcaaaatcaaagtacatatatacacgcgactcacgaaagctccacccatgaatctgtcaatgatcaagttcaattaagtgggctaaataatcaggtgtcttggtttagatatatattgttttgctgcgggttgtatgaatgactagtatatgttaattaatataagaacgacgagggttaaaatattatgaaaatgatgtgaggaagatcatttgacatacttatatgttgaattttatgttataatattgtagataatgtgccttttgtttgtatgagatttaatatgctttaaaatagtaattactaatagacgatgatgtaacatattaatgggtaccaactatataagtatattaatggggttagctttagggtgtttttgataggaggggaaaagagaaatggagaagatgcgtaaatcgagatgaactattagcatctgactaattaagtattgattatt

SEQ ID NO: 9810 - DNA, 1501 bp, Oryza sativa
aaacataagccatgttgagctacgagggagtatggcgagctcttgtcggctagcctaatttctcagccggagacggaaccccggggcgtcaggattgaggaggcagaggcaaccagcagcaggtaatgctgcctgcatgcatggctatctatctccggagtagtttatgtagaagtatatatacttatttatagtcctatgattttattactcagtgtgttttcatatgactctctcctatgaatatgatatgatcctatactaggagtgagtagtgcagtgtactggtgctcaactgaatcaggtgcatgtacctgctacagttggtagctgtacgcatcacgagagatttttccttttttttttctttccacaagacagctcaagctttgccattgggtttctattcacaccgtacgatcagagcatgcgctgtcctcgtgcctttactaaataaacataataaagtttactctgaaacttagctctttgaaattgatgggtatatatatatactgcaacatagtataatccatttttcattgtaacccatttacgttatcctatcttaaaaatattagagtcctattttacaaaaatctgtttagccctcgaacccttttatattgggtaaagacacggacataatagtagatagccaataagtgactccttaatcaacattacatccacccaactagagatgaggatgtatcatttccaccacgcctactccctccctcccccgtcgccttttagtgccagatccagctaggggtcagtagatctagcggccctatccgctctgaggctagagttcacgaaccactgccatcctcttgttttctccttatcggcccctctagttcccccactctcgctttccgtgcactgattttcctcacctctccaccctgctctatgcttgactaccctattttatttccaaggagtcacatcattgcaacaataaaagtgtaaacactttgatgccatgactacaattttaagtctatctagggttgtttgtgtaaaggcaatgcctcgtagaccctcgtatgcacaccgagacaaaaaagaattttatacatgctcgagcctcccttaggataataaccctacatccttttagttattgtatatatgtagatgtgtatagagtgcaatatgtagagaggctctaatttatacctacatgtatctctttgggatcttctaatcaggaacttgtcatgatcatcgacttggcttgttaagatcaatcctctcttcaccacgaggtctgtatatttgtacccataatcttggttttcttgtaggattcttggagataaactttgtatatcttggtcttgtccgagtaggcctttcaaagtcttgccatatgaggtgatcatatcctaatagaacctttgccttaggttgtattcttttcatacccatccatcgtactaggtgtggtaggttgtattcttttcatacccatccatcgtaccaggtg

SEQ ID NO: 9811 - DNA, 1501 bp, Oryza sativa
tcctcctaccaaatatagcaacctccaaactggatcaagcatggaattttacgaattcttaggttttcaaaatagtgtaatgaaaaaaagaagtgttttgaatcatcggagaggccatggaggtcctatctcctagcggacgcgagatttggagatagaggatgtagtttttgtcgttgtactaaatatatgatacccttcaagtatggaaacatatctaaatacagaatttcctatatataccacacctggtacgatggatgggtatgaaaagaatacaacctaccacacctagtacgatggatgggtatgaaaagaatacaacctaaggcaaaggttctattaggatatgatcacctcatatggcaagactttgaaaggcctactcggacaagaccaagatatacaaagtttatctccaagaatcctacaagaaaaccaagattatgggtacaaatatacagacctcgtggtgaagagaggattgatcttaacaagccaagtcgatgatcatgacaagttcctgattagaagatcccaaagagatacatgtaggtataaattagagcctctctacatattgcactctatacacatctacatatatacaataactaaaaggatgtagggttattatcctaagggaggctcgagcatgtataaaattcttttttgtctcggtgtgcatacgagggtctacgaggcattgcctttacacaaacaaccctagatagacttaaaattgtagtcatggcatcaaagtgtttacacttttattgttgcaatgatgtgactccttggaaataaaatagggtagtcaagcatagagcagggtggagaggtgaggaaaatcagtgcacggaaagcgagagtgggggaactagaggggccgataaggagaaaacaagaggatggcagtggttcgtgaactctagcctcagagcggatagggccgctagatctactgacccctagctggatctggcactaaaaggcgacgggggagggagggagtaggcgtggtggaaatgatacatcctcatctctagttgggtggatgtaatgttgattaaggagtcacttattggctatctactattatgtccgtgtctttacccaatataaaagggttcgagggctaaacagatttttgtaaaataggactctaatatttttaagataggataacgtaaatgggttacaatgaaaaatggattatactatgttgcagtatatatatatacccatcaatttcaaagagctaagtttcagagtaaactttattatgtttatttagtaaaggcacgaggacagcgcatgctctgatcgtacggtgtgaatagaaacccaatggcaaagcttgagctgtcttgtggaaagaaaaaaaaaaggaaaaatctctcgtgatgcgtacagctaccaactgtagcaggtacatgcacctgattcagttgagcaccagtacactgcactactcactcctagtataggatcatatcat

SEQ ID NO: 9812 - DNA, 1501 bp, Oryza sativa
aaaagaagagtccaagtagaaatactccctccatactcgtaaaggaagtcgtttaggacatcgatacaatctctaaaacacaactttgacttcttatttctataaaaatatttattgaaaagtgatacaggtatacttttatgaaagtatttttcaagacaaatctatacatataatttttatattttcaaactcaacaacttgagagttattcatgatttatattcccaatgtttgacttaaacattgtcttaaacgactttctttacaagtatggagggagaacaatttaaaaatagctgaaagtcggaattaaaaataagcaatattgaaaaaagagtccatataagaacccaacacgagattaatcaaaattcggaataaaaataaaataaaatacaaaattagaaaagaaaaggagagttcaagtaagcatacaatttaaaaatagctgaaattctgaattaaaaataaggaatattgagagaagagtccatataagaacccaatacgagattaattaatattcaggataaaaataaaaataaaatctgaaattagaaaaaaaagagaaaagaatagttcaagtagaaatacaatttaaaattaactgaaattcggaattaaaattaagcaatattgaaagaagaatccatataagaacccaatacgagattaattaaaattaggaataaaaaataaaataatatccaaaattagaaaaattaaaagagagttcaagtaggaatacaattttaaaacaactgaaaataaaaaataaaaaataaaaatattaaaagaacaatataaggaattaattaaaattttaaaaaaattctgaaactagaaagaaaagatttcaattaggaatacaatttataaataactaaaattgttgctaaaaaaaataaagattattgaaagaaaagatcatctaaaacacatgacgagataaattaagtaacaggcctataaaagagttaataaaaaactgttaatacgacatataaaaactgttaataaaacaccaaatagaatactaataacgattaaaaggagggacaacaaataggccatgaagcaagcaggcaaggcggttgccgggacttctagaaagtaaaaacaataaaccccattgataatcatattcgatttttaaatctcaatgataataaaaaggagaagcaacggggcatggtgtataggagtatagttgcagagctgtcgacggttggcgggacttctagaaaataaaaaaaaagaattccaaagatagttatattcgatttttagaatgccaatgacaataaatagtaggcggcggatgtgccgtagaggagtataggggcatcgtttaacaagacttctaaacattataaaaaatgaaacccacgagacaataaactctaaatactacaaggtccaatttttaaaggttcggaacttctaaaaagtaaaaaaaaaaacccaatgataatcatatttgattttaaaatctcaa

SEQ ID NO: 9813 - DNA, 1501 bp, Oryza sativa
gtggcccggtacggtgcggaacaaaaaaataaaggctcctaaatcactataaaaatacaaggtaatatttaaaaagtcattgtcattaacgaatttcacactaataagtttaaaatacaatcaagcagtcacgactcacgatatcctcgatcgccgatcggttttctatctttcctctaagcctattaggcctgatattatagtatacatattttagaggcctctaatttttggaggcccagtgcggtcgtaccgtccgcactgccccaaggccggccctgacagcgaatgccccaactgttctctcccccaattaatgtacgcagatatactacttcactgccttaaggccattcacagtggcctcagtgacatttagtctcgataccaaaaggcgaatattccttgctacattctccatccgtgcagtttcttaaggatcgtgtagccaactttgaccacgggttcctcgtcgcgggtgggacccatattcgtggtccatgacgtcaagaatgggagagaggagagaggggagaggccgcccacggggagagaggaggggtggcgccgtggggcaggtcgcagtggtttcacgcggctgcccccgctgtccctcgctcccgcgccagaggaggaggaggaggggaggcacggcggaggagaagagaagaaggagacaaaccgacgtcgattcggcgacggcgagcttgatccgtagtcggcgccgccgccgctcgggccgcccggcgcctccgtcgccgctcgcgcctcgcaccgccctcactccgctgccggcaccagcaccgctagggccgctcagcgtcggcgtcgtcgctcttctctcccgccgtcagcttcggttcctccgctaggggaagaaaagagagaggagaggggggggcttcatttggtggggaacaaaaaaggagaggagagagggagagttcaaaagtgaaaaagatggtaccggtgagacccactacaaacaacttgcactgtgaaacatgtagcttaacacgttcttggtctgtgtggcatgcgaggaacggcaaatatgagcgacgcactgttaacacccttatgagagcacgaatctcacccactgtcctaaagtactttagtaatttttttcgtaaaagttacggtaaattaaaaaatatatctcagaaattcttgaccttatgatctattatacagtttgagttccaataagcttatcttctatctccggtgctatcagatgaactctcttgtagttcggtcctaaccaattagaatacaatggctacgggcacagggagcggccgtgcggggataaggagctatttcccaaatttacatagaggatgagcttattttcaaaagtgaacgaacttaaaaaccgactcatacacatatgacgttccaaagtaccgataaaaacatattcaatttttataatagtagagatatggtaacagaatggaaaaagtacgaattacccccctccctgaactatcgc

SEQ ID NO: 9814 - DNA, 888 bp, Oryza sativa
gtccccgcgccgcgccatgagtgccggcgtgcgcgctactgcccaatgactgaccaagagagagagagaaagagggtgtatgacatgtgggtcctactattttttaaaaaataaaatgctaaccggattgccacgcatacgctacgtaggacaaaactgctctggattgggtcgaggagggtaatttgtctggtattgaaagttcagggtgaacgatgtctggttttcaggttcagggggtaattcggtcgaccgcgatagttcagggaggggggtaattcgtactttttccattctgttaccatatctctactattataaaaattgaatatgtttttatcggtactttggaacgtcatatgtgtatgagtcggtttttaagttcgttcacttttgaaaataagctcatcctctatgtaaatttgggaaatagctccttatccccgcacggccgctccctgtgcccgtagccattgtattctaattggttaggaccgaactacaagagagttcatctgatagcaccggagatagaagataagcttattggaactcaaactgtataatagatcataaggtcaagaatttctgagatatattttttaatttaccgtaacttttacgaaaaaaattactaaagtactttaggacagtgggtgagattcgtgctctcataagggtgttaacagtgcgtcgctcatatttgccgttcctcgcatgccacacagaccaagaacgtgttaagctacatgtttcacagtgcaagttgtttgtagtgggtctcaccggtaccatctttttcacttttgaactctccctctctcctctccttttttgttccccaccaaatgaagcccccccctctcctctctcttttcttcccctagc

SEQ ID NO: 9815 - DNA, 1501 bp, Oryza sativa
atttgtaattacactttactatagtatagttacatttgaatgattttcttaaaaaaaactgttgaatgttatatagctaataaaaaaatctttggcaaagcacagtcaagctagcttcccatgcgtgcgtgaaaaggaggttgagattaagttattgtttgttactacttattttaggtgcgggtctaccaaagatatgtccctatgtatatattccagaaatcatatagatactaacttatacatcctcaacacatagatgcaccaaccggttttcaatgaataacatactttttaagcataatacatacacagatgcacatattcacgcatatactcacttatgtaaatgacacatgcgtacacatatttaaaacgatcccactaccacaaaattattcaaaggtaacactctattagtaccggttaaaaaaaacctagaacacaaccgctccgctcgcgccctctttagtgacagtactgaagcaaccagccgtgatgagaggtgccggtttaaatctaattggctagatgaccagggtgtttcctaaaatgccggtttatgccaccaatcggcatttatgacccccacttctgtgaccattttttctaataatcctacactaaaaaatgatcgagctgagctataagctaaaccaagcagtgaaaacatgttttaagtcctctcctctactcttccttaccatgttacccataaatttcttgtgatctccatctctccctcttgctctctcggtacctccttcttcctctctctctccacaatcaacagcttgtcatctcactagacaagctctattgcactgccaccgccggcgagtgaccaccccagaaaggctaaatcctacctctgacgtgcaatgacgttagcctctccctcaccaccgtcgggtgcctgcatcttcttattcacccacctctccccttatgagcctatctctccttcgcctgatccatatcctctccggcacataggaggcggcagcatggtggccataaacgatggccccgaagctccatctagccagatttagtggatggactgagggcacgccgggagcagtggcgggctgtgggtggagagggtagtagggctgtgtgggggggggggtgcaacggcgggtccatgtacaggcttggtccttggcaggaggaatgacatcaatatagctggaattttttgttgaaattgttgttcgatctattggatgaatattttgttaatgatctctgttggatattaaaattattgatttgttggagtaatttctatctattatttgtgattgaatttgttatgaatctagctatttgtgattgaatctgagattaatgttttgagaggttggttctgtgattgaatttgttatgaatctagctatgatggatcatctcgaatcaagccgagctgcctgttttttaaaaggaaaaagtatgaattacccccctgaactttcgcggtcgtctgaattaccccccc

SEQ ID NO: 9816 - DNA, 1501 bp, Oryza sativa
aagtgtgaatgcagttgtctttaatttttttctcacccatcgatgctaatgagccgactgagcagtcacttcgtaatcagcagcggttgaatgcttcttgtttttttagaagtcgtctttttacgggacaaactcttctcgctagaaattctctcttttcgggacggagtcttactctaattttttttagttgtttaattactagtaaaagatacataggctattagtttaatacatcatatttttaatggaaagatgaaactttaaaaacgattttacccttgggcagttttaattggaacagattttggtttaatttatacatgtttgaaaaattcaaaacttgacttagattataaaattcgctgagtttaatcagttgattaacttgcgtccactgtttcaacggtgctgatcaatgcttacatgattgcctccatatagatggtgacgtgtataaaagcaagtttgatagtacacctggcttgcaatataggagtacataatatctacgagagtagccacatcagccgaaaacaatgttaaagagtctacatcggcggagccacgtacccccagatagttcgggctaggtgggcttaacaaattaacaagtgcatgcagcaatgaaattggcgatgcatggctccatccctataagagaaagtatttagggattggtagaaatgattggacggtataatcaacaagaactctaggcttcttaggctgtgttcgtttagaactaatgttcccaattcttccatctcgttttccacgcgcacgatttttaaactgataaacggtgcgtttagagttgttcccaactctcccatcttgttttttccgtgccagggagggtcactcccgaacacaaccttagctagctcgagagcttcgcatactttgtacgaactttgcatatggtgaacaagaacaggtgtaagccggttgtcaccttcgggaggcctaaacctatatatatgttatatgtgttcatctttttccgagcactattggacaagacaagtgcacccagagccttggtccatcttggacaagtgatttctcacatttgtcggtgctcatatgtcgacacatagtccggctattagataccaacttcaccaccaataacttctcatggggccatggtgctagcacaactgcatggcatttttacaataaacagttgatggtggagcacaacgcttaatttacaagtgttctcgttcgttattgaggtaatcccaaccatatccgatgaaatttgcctagtaccaccaaactcaccattagcgattacatcttagctctagagatcgagattgcttgagtatggttgggtgatataatacatgagcccataaaagacacacgctagctagaggagtactccagaaagcatctgctttcgctatctttcaatgcctctcttgtccacataaaagcacacattgatgtaggcttggctaatataaatagctggtatgtgtgggtt

SEQ ID NO: 9817 - DNA, 1501 bp, Oryza sativa
atacatacatacatatatatatacatacatacatacatacatatatatatacatacatacatacatacatatatatacatacatacatacatacatatatatacatacatacatacatacatacatacatatatatacatacatacatacatacatacatatatgtacatgtatacatacatacatatatgtatatgtatatatatacatatatgtatatgtatatatatacatatatatatatatatatacatatatatatatacatatatatatatatgagatagatcagcagggccagtggccaagctgccctttcacatgcctccccatggacgcaaccctcgaaagggtaattcaccatacgcgtactgcattcatgcacatttgctatcatgcaatgcaatgcaaatgcaaacaaacaccctgaaagcaacatgtaccagcatgtccccctgcccctcagcactgtccaagttcagatttcaatgatcccccaccatgttcttaattttatccctttgtataattatcaatgttttctttctctctctgatcccctacatgtgtacacatgtacacatctctatgtttttttctctctgtatatatgtgtgtctctctctggttgtggtttggccggagtttctgtatgtgcaaatgatgttgtttcgtgggggcgaaatcggtgcggttttgggccgttttggggtgatgagagcattggcatcgagagatagaatatatagctaggataggtatattttttttagataatggaatataatattccggtctttgctcaaaaagaactacagccaattattacaaagatccactcaagaagagagtgtagttcaagacaagttgaacacaccaaacaagagaagagaggacccaaactgagaaaagtaaaataaaatgtggagctagaaggcctcgtccaggcctaggactgaaattcgaagccaatgcatagaccaatgacaatatccttgcacgaagagatttctccaaagcggtgcccccaaggaggatgcgacgtggatcgccgccaccgctcgttcggaaccgaagcaaggttttcacccggagaatatagtagggaaaggaaaggggtatgctaaaacaacgcctccaaggagaggaacgacgccaaacggcgtcgccgttgtcagccggccaaatggcttggcaaggctttcgcccgcgattccctgtccaaacccacaccaccaatccgcacaagaaggatcgtcgtcggtcaacaacattatcccttcagcgattcggtcaaggccaccgcccacaattgttcccgccgtcgacggcgcgcccgcacccggactccttccccgccgctagaccccttctccgcctccacataccgccgtcgacgacgacgcaccgtcagccggatgatggccttcaaccatcgctgccataggtaccatcgtcgacagccgccaccgccactgccacagccaccaccgtcgccagc

SEQ ID NO: 9818 - DNA, 1501 bp, Oryza sativa
gtttggtgggcgggtggagcaaccggacgccgacgaggtggccgccgtggaggcggcgcgccggtgagccgccggcgaggagggtgggggtggggatggtggtgcgccgccgctgacgaggcggatgggccgggatgcgagtaccggaaaggcccatttgttttagattttggatccacaccctatgaggcccatcggggagtatttgtggatagctttagttggtgtttatttcttttttcgccataaatatagctacaccctattattttatctcgattttcgtaaacgatgtgttctgtgcgaatttattttttagaattttcctaaaatatgtcaaataaatatattttgcgtatagtagtgtattcaggtcatttataagagatcgacaaataggtcagagtcattgattagccaccttgagcattgttttaggaggcgaagaaggctttagagatgtttcatactccctccttcccataatatgatacccaaaatcccttttattataggacggagggagtatatcgctattgtgatttgaatgttttgtaatctacggtaatctaggatatgaagttgtgatatgggctaaggacaaggctaatgtatactctccgttccataataagtttatttgtgtctctcctatttatcataaggttctttttacgtaaccattgtattggagtttgtgaaagtaaggaataaatgtgctaggagtagataaagtataaaataattatattgagatttgataaagggtattttagtctttttgttgttgtattggtatgtgtgggatgggtgaaaaataaacttattttagatagtgggagtatgtctcaatggataataagagtgggcccatgtgtatatagtaatatctatggctctctctacaatggttaatatgtgtgtgggaggagtttaaaagtgagtcctgttggatctcactaagtctaaaaaatggatacctagtcctttgaatgaaaaataaatcagtatctatctatacctaattaaaaaatacgcgaggcttccggaaaaaaaaatcgtccatcttttttttcggtttttcctttctttctgtccgttttctccgtccgtccattttctccctgttttttctcttttttttttttgtccttttttactgtttctctccatccgtctattttttcgctatttttttcgtccatctttttctccgcctttttccgtccgctttttgttacctttttttagttttttccatccgctttttttttggtaggatttatttttttatctgccatatttatttcgtcgtcgggccaaaccctagcgccgccgtcacatcgatctgcctccccatgcctgattaactgcaaaaattgatgttgcactactccctcgtcattttcctcatgattttccctttcaattccgctttaattcactgaatttaatctccatttgaaagtcattttttatcgtgaattttaggattcactcc

SEQ ID NO: 9819 - DNA, 1501 bp, Oryza sativa
ctccatgcttcaaagccaccggagctcgtcgccggcaaagccgggcgacgcgttgggatggcggcagcggggccatcctcctcggctccacctcgccccggcgcgggcgtggcgacgatggcggcaggacggcgaggtcgtggcgacggggacagcgtggcgacggcgcggcggtggggcgctcggtgtcggctctccgcggctccagcgacgggcaacggcgtcgccagatctggactccccacttggccggggtgaccggcgatgggctcggtcaacgccagcgccgctccgcggacctggcaggggggtggctagcggcggcgatggtggcggatatggaggcgacgaagttggcgacgacggcagcgcactgcggcacgtgccgtgacgccggccctcgtcaagaacctcgccaccacgagggaggcgcgacaccctcgtcaatgctccggctgtgaacgccgtgcccttgacgccttcctccatgatgccaacgacccgcgcttcgcactgcacctccgatccgcgccaccccggtcagatatggacggctggcgtctggcggcgctggctagcgacggtgcggctggacggtggtggctggactgggggtgtccgtggcagtggcgatggcggtggtgatggtggctgacggtggcggctggcgacggtggtggctgtggcagtggcggtggcggctgtcgacgatggtacctatggcagcgatggttgaaggccatcatccggctgacggtgcgtcgtcgtcgacggcggtatgtggaggcggagaaggggtctagcggcggggaaggagtccgggtgcgggcgcgccgtcgacggcgggaacaattgtgggcggtggccttgaccgaatcgctgaagggataatgttgttgaccgacgacgatccttcttgtgcggattggtggtgtgggtttggacagggaatcgcgggcgaaagccttgccaagccatttggccggctgacaacggcgacgccgtttggcgtcgttcctctccttggaggcgttgttttagcatacccctttcctttccctactatattctccgggtgaaaaccttgcttcggttccgaacgagcggtggcggcgatccacgtcgcatcctccttgggggcaccgctttggagaaatctcttcgtgcaaggatattgtcattggtctatgcattggcttcgaatttcagtcctaggcctggacgaggccttctagctccacattttattttacttttctcagtttgggtcctctcttctcttgtttggtgtgttcaacttgtcttgaactacactctcttcttgagtggatctttgtaataattggctgtagttctttttgagcaaagaccggaatattatattccattatctaaaaaaaatatacctatcctagctatatattctatctctcgatgccaatgctctcatcaccccaaaacggcccaaaaccgcaccgatttcgcccccacgaaacaacat

SEQ ID NO: 9820 - DNA, 1501 bp, Oryza sativa
atcaatataattgacctaagagaacatccaaattcgtaacatgcagaaattatattttcttggactctttatagttgcgggaatatactcaattttctatgtattgtacttgtgaaagatgatggcacatctgaataatgaaaatcgatgctattaatttttcctgaggtagtattgtattgtgttttatttataaatttcatttgaggtcaaatatcagtaaggctgtgttcgtttattgaggttccgaacctccagtgtctcattttccgctacatttcccaaactattatacgtgacatttttttaacaatatatatatatatatatatatatatatatatatataagttgctttaaaatcatattaatctatttgtaagttttttaggttatacttaattaatgtgtaaattcattgttctgttttgtacgtggaggggaggggtttcttttggagaacacgatctagagaacagcctaaatataccggagaaaaaatggaagccgaacagatagggaggaaaatattaggaagaaaaaaaattaaagatgagctgacagtgaggaaaaaaaaaaggaaggtaagccgacatggtgcacagattatagaaaatattttttttgctaatgtgaaaatttaaaattattaaagacaatagaattgtacagtagcatttagcacgggcatattactaatttcaatatcccccctaagctgtggattcaatccagataaccaattgatactaaaattgtaagaagaaccccttaactatctatctagaaaaaatatggagtgaaaaccacatattttatggaaacctaaaaactactgttagatcgaaaaatggatgtttgaaatttgtccacatcaccatgagtaaaagttttactgtcatgagtaaaactacgagtaaaaataatttttgttcgtgatgacgtggacaaatctcatacgcctattcactggtggagaaaccatctttactcccagtttgtaaccccctgtagtccaagttttccaaccaggactacgaatccaagactaaatatcgctatctttagtcccgtgtgaaataaccgggagtaaagatcgatctttagtcccggttggtgtttccttccgggactaaagagagggatctttagtccattttctttttattttctcccaattcgagtgggatgtatatacccaaatccaaccccaaatgcccaaatcaagtgccatgcataaacccaaattaacccccaaatccccaaatcaaactaccatcccaaatcattcacatcacaaatacaaatcctaaattacttacacataaatcaaatacatcataaatcttacaaaattacacacaaatcaaatgcatcacagatcgattatacatctcagatccatgtaataaatcacaaattctaaaaaaaaattatacatctctcaatcacaaattataaaaaaaaccggagaggagaactggcgcgctgctgccttcca

SEQ ID NO: 9821 - DNA, 1501 bp, Oryza sativa; identical to SEQ ID NO: 7281

SEQ ID NO: 9822 - DNA, 1501 bp, Oryza sativa
cggcgccgccgccgcctcgccagccgccgatgcgttcgccggcgtgtcgccgttcaagtacccggtgttccagggcgggccgaggacgtgcctcggcaaggagatggcgttcgtccagatgaagttcgtcgccagcgccgtgctccgccgtttcgagctccgccccgtcgacgagggccgcacgccggcgttcgtgccgctcatgacggctcacatggccggcggcctcaacgtgacggtgcggcggagaacgccggcgccggcgacgtcgacggcggccaatggcacaggaggggaattgaccagtagttaacccacgtgtaagtacaacaaaacaaaggattaattaattaattaattaattaatatactatacaactgtgctaagcttacactgcagcttacagctaagcactgtacacactctgtatcatatgaccatcatatgaaattaaagagatacacacaccatgtttcattgagatccttgatagatccaaggtaaacattgggtggtgcttttcaaggtatcttccctgctgcacaagcagcttcgtttgttgtgccgatccggccacgttttttttcttttcttttttttttcaattaaggatctgtttggtttgtttgcggctacggtttgccgcacatcaattaattgtcagacgagatgccgtagcttgttaaataagtgtctggttgatcactgtaactatgatccgaaaccatgttagcgacaccacaccggtcgtgctgctctacccctatgccaacttataaacccctttatgcggctctttcggcatttttacgcccgattcatcttattatcaaattgtactataatgcctcatctcgactcgcatacatatgcattgttatcacctgcttgaaactaatcacgaaaaacacatcatacacatactacattaactggaattcacacacattccggacggttaaatcatgaacggatagagatgttcaccgatttactgaaaatcaaagttggcatcaccttttaacgcacacaccccactacacacaccgttaggtgggatttgatgcttagctttttgctgcctgaaatattgcagtcagcctctctctgatgtgagctccatttccatcatcaatcaattggaaagttcatgggttcagtttctagttatatgaccactactagtactagcaatgcatatgcgtagacaaacaaacagacagacagacatgttgaatgataaaagagcatgtggggattttgctctaatggggttaggtgaagggatgagcccaagtgcaggtgcctatcacagttgcatagaggggaattaaacgttgtggaaatatatatatcaaagagagagagagagagaaaaaaataaagatttggtaaaactgagactagaatatatgcatatatttatgtgtgtgtatggagtatggttgaagtgaagaggaggagaaaaagaaattccatgtgttgccacaccacgtgctg

SEQ ID NO: 9823 - DNA, 1501 bp, Oryza sativa
aggggggaggggccaaatgacactgtttgtgcgtttcggcagctggcggtggaactggaggcagggagtgtgtgcttatcgtcgtgcattggcggcgtagagggaggaagaaggataagagggaggaggttagggctagggagtgtgcgtaaatcttaaatcaatcgaatggtccaaaatttacgagatttgactgtgttttctgttatcagtccattgataaaattcattaaaatgccacgcatatataacagattatttttaatgtgcagttttaatttatgcatagcatgtggtaaacggtgaatcttttgagagggattatgtaaagatggtaaaagtgatgctactgatatgtgccaagatacaaaataggctcaccgctgacatctaagaacaagttttataagtaaaggtaatataatcatctccagttttatccacattatctactcattagttaattaagaagtgacacgctcaacatattatctcaagcaatttgtcctaatagactacaatatttttttccttctttatctttcaatttattgaccttcttctttgatcttttttgaagtttatatattgagattaccctttacataatggacgatttcttctctctcctctaacttattgtttgagtttatatgacagtttaaaggttttatagcaattgctctaagatggtgtgatagagagcatcaactggatatatgcaacctttttaaattaggaacccaatctgaaattcgctcctatggagatttgaactcaagacttttaggtgctactcaagtcactgcaaccactaggctacactgcccattacagtaatggaattgatttattacaaatgaattaactatttaagtcttcatggagggggttgagagggagaaatcggtatatgtgccatcaaaaatagctggcttcgctaaaatgcttcgataagtgccatggttgaacggagggtgttcttgctagaatgcatcgtggatggtattgcccttggatcttcatcttccttcttccacttccttccaacgttgaccattcctctctatgtcatgtcatcgtccgatgacggagcccgccatcttggccgccaccgccgccgtcctccgtcaagcataggacgagccagcgtcccctgccaacctgctctccatcaacccatttgtaatacgccttgccctaaacctttagctcatcgtcgacgaggcgactagaagtccagaactcgttcctgttgagttgtgatccaaattcattttcacatatataaaggccagcttctgccggagcgaagtggaggcctgtcgccggagggtttcaccttcatatatacttcttgtaagccgctgttcggtgttgtaacctcaccccgatatagtgaagatatttttctagctggcgcccgtgattttttctctcctgctttgggagggttttccacgttaaatctcatgtcttctgtgattgatctattttcttt

SEQ ID NO: 9824 - DNA, 1501 bp, Oryza sativa
cttggccgcgccgccctccgatgacatccccagccaggaggctttccggccgccgccgccgccgcggctggaaccctcggccgccatggaaaggcacctcctttctttcccctttctcgcaccgcttctttgattttcttctgttttcttttctcggttcgttccttcgagagttggagtctccttttatttataataaaatcgtggtagaaattaataagcttttaaattttgcgtctaaaagagaaaagagaagttaatgctatatgaaagatttagggaatgatttccatttaatttattcgtatggatgtttatggaacggaattactaacctttcgtcgataaaaaatccatccccaaatattacctaatttaggccatcggatgagttttgtggctcgtactctaaacccttgttgttcaactccaacaaccttctcttcttcttctccggagacaccatgaattccgaagaaggacatatggattatggtcctgatttagagatcggagtaagaagaaggaaagagaatgagttcgcagcctttagatggacacaagagtgagaggtggtggcttgatgatgggcggcggagtaggcggactgcgaggcacaggtgtcggcgccaaagccacaaggttggtagcaggtggtggactgatgttgataacggttgtaggtgatagatccgatgaccctcgtcggagacaagaaagacgctaaggatgggagtacctcgctgccgtcggcttgaggaggagaagagggaggaaaggggaaggaggaaggggggaggggccaaatgacactgtttgtgcgtttcggcagctggcggtggaactggaggcagggagtgtgtgcttatcgtcgtgcattggcggcgtagagggaggaagaaggataagagggaggaggttagggctagggagtgtgcgtaaatcttaaatcaatcgaatggtccaaaatttacgagatttgactgtgttttctgttatcagtccattgataaaattcattaaaatgccacgcatatataacagattatttttaatgtgcagttttaatttatgcatagcatgtggtaaacggtgaatcttttgagagggattatgtaaagatggtaaaagtgatgctactgatatgtgccaagatacaaaataggctcaccgctgacatctaagaacaagttttataagtaaaggtaatataatcatctccagttttatccacattatctactcattagttaattaagaagtgacacgctcaacatattatctcaagcaatttgtcctaatagactacaatatttttttccttctttatctttcaatttattgaccttcttctttgatcttttttgaagtttatatattgagattaccctttacataatggacgatttcttctctctcctctaacttattgtttgagtttatatgacagtttaaaggttttatagcaattgctctaagatggtgtgatagagagcatcaa

SEQ ID NO: 9825 - DNA, 1501 bp, Oryza sativa
gacctcgccgtggccgtggtgcgccagcccggtgatcagggcgttccacgtcgccgtttgccgctcgggcatccggtcaaacaccgccgtcgcctcctccatggcgccggtcttggcgtacatgtcgaccagcgccgtcccgaggatggcccccaccacgggcgccgtcacccgcctcgacttcatgagctcgtgcacgcgccgccccatctcgagcccgcgcgaccccgaccgcgcgcacgacgacagcacggacgccagcgctgcgccgtggggctcgatcccgtcgccgaccatctcctcgaacgaccgcatggcgtcctcgtgcatcccgttttgcgcgtacccggacaccatggtggtgcacaccaccgcgctccgctcgggcaatccgtcgaacaccctgcgcgcgagggggacgaggcccgcgagcgagtacgcccggacgaggccgttggcgacgtaggcgtcgcgctccagcccgtgcctgacggcgagcgcgtggagctgctcggaggcgcggagggggaggcgggcggatgccttgaggaggaaagtgaaggtgtgcctgccgggagagtacgagccgccgccgccgccgctgccgcggcggaggagggagaagaagcggagggcggaggccgggtcgggggaggaggcgagggcgcggagcgtgatgttgagcatgaaggagtttggggcgcaggggagggaggcgaggaggcggagcacggctcccggaggggagagcgcggcgtgggcggcgaggaggcgggacgccgcgaaggcgtcgtcggcgaggcggccggagacgagcatggccgcgtggacggcggcgagcgcgcgcggggtcgcgcagcggtcggccaggagggacaggttcggccggcgccggatgccgccgcgggcgcccacggcggcggcggcggcggcggccattggcgtcgcgtgcgtcgccacactgtacacggaatcctcctctctgcgtcgccctcttcccaaaaaaatacgtatatagggcgtgtttagattaaaaaaattttcgttaaagttccaacttttccgactccgtcacatcaaatgtttggatatatgcatagaacattaaatgtggatgaaaaaaaccaattacacagtttacatataaattgcgagacgaatcttttgagcttaattacgctatgatttgacaatgtgatgctacaataaatatttgctaatgacagattaattaggcttaatgaatttgtctcggagtttacatgcagaatctgtaatttgttttgttattagtctacgtttaatacttcaagtgtatgaccgtatacttaaaaaaaaattggcacacgaactaaacacaaccatagtatcagattttaaacaacaagtaatatgattttatgaatttagatagatcatgaatattaggcatccatttataactgatggattttactgtaattttgtaaaacgtccatataaatccatttaatttgtgttc

SEQ ID NO: 9826 - DNA, 350 bp, Oryza sativa
gctacccggtcctcttcgttttgatcttgctagaaatagaccaaagacagcaaaagacttgtttgaaagaatggaaagttttgcaagaggagaagaagatgagttgagagtgcaagaggaagaagccgtcttgttgggaaaaaagcagtcaaagaacaagcaaatttcccaaggggaagaacaaaagggagagaataccggaaagccctggaaaaagttcaagtatgactataaataagatcagaaaaaacaggtaaattttatcggagatggatccaacaatgaaagagaaaaaggaaaacatcaatgggacaacactcgcggagggagaaacaattgggggcaatctg

SEQ ID NO: 9827 - DNA, 203 bp, Oryza sativa
gtcaaagaacaagcaaatttcccaaggggaagaacaaaagggagagaataccggaaagccctggaaaaagttcaagtatgactataaataagatcagaaaaaacaggtaaattttatcggagatggatccaacaatgaaagagaaaaaggaaaacatcaatgggacaacactcgcggagggagaaacaattgggggcaatctg

SEQ ID NO: 9828 - DNA, 1501 bp, Oryza sativa
caagacatatagctgaatttacttcctttgtttccttaagataatctgtaaatgctcgttttgattgcaggcacggtgtttcatcaggatcagtcgtgtctatttctgtctgccctgtgatcgcttgagacgaggtctgctaggaaggaaaatctgcttcatctgaataaacacatatatactgatatctccttgtagcagacactctcccgtcggtggatgtcaacacattcacctgtatttttggtattatcccattgatccttctagttaaccttctgaatcattcaagttttacatcggtataatgagcatacacttcacctcttattttcatctcccctttttgcagttgtagcagcacaatcagtggttctctcttgatgactggctcataatgttctgaaatcctttctacagttggcgtatccactgagtttcttttgatcttcactaatctgagtctgtcgagtatctaaagtagatgggtcagagcaaacttctagcttgtgcaagatgaatgctactatactattgatccttgttatgtgacttatgtcttttcatgctgaattatcactccataaggtaagatttgcatgcaatatacttgagtaaaacccctcaacttgtttccggttacttctttctcctcatttacctttaacccaagaagcttacccgaaatgtaaccccattattccagttctttagcttcagtatgctaacttgctcaaaactcatggcaaaacaacttattaaaaaccttaccgaaatgtaaccccattattctagatactctgaaactgattgaacttttgtccattttcagatcgtgtaattctcataagtaatttacttagaaattttggtgcatcaccatcaacgagtttctctatggcaaccatattgggttctttgattggatcatgcgtaaacaagttgcaaggcatcattacagaggaggcaatactaattttaggtgtagaagaagaactcaaaaaactgcagaaaagaatgaaacaaatacagtgctttctcagtgatgctgagcgaaggggaatggaagactcagcagtacacaattgggtttcttggctaaaagatgctatgtatgatgctgatgacattatcgatttggctagttttgaaggaagcaagctattaaatggccattcttcttcaccaagaaaaacaactgcatgcggtgggctttcacctctctcttgcttttccaatattcaggttcgccatgagattggtgataaaattagaagtctgaaccggaaattagcggaaatagaaaaggataaaatatttgcaacacttaagaatgcacaaccagctgataaaggttcaacatcagaactgagaaaaacatctcacattgttgaacccaaccttgtggggaaagagatattaaaagtttctagaaatttggtgtgccacgtgcttgcacacaaggaaaagaaggcttacaagcttgctattgttggaacag

SEQ ID NO: 9829 - DNA, 1501 bp, Oryza sativa
tccgctgctcttatctctcctcatgtatcttctcgatatgtatttatagctggcttatagtttgctattatacttgctcttagtatcatgtatggctttcgatttgataaagtcttggactaaaattaatccagagatggcgaccaatgtaagatgtgtagtactagtactactcgcacaaacgcgtttgacagaccagatattattatcataaattaattatctactccctgtatctaaaagtcaaaaacatatttcttttatcaccaaatataagaagaaattaactcattcatcatgtgataaaaatgaaaaaaattatatacatgcatataaccaattagtatcaagatggctcatcggtacaatgaacaatttaatttaacacatagagacagaaatatgcttagatttttagaaaaaaaatgaaatataccttaaacttttggatagagggtttacttcatttaagggtaggataaattcgttcttaaaaataaatttcaaataagtggtataagcaatgcatgcataaaagaaagttttttttatataaaaacgtatttttacaaagtggagagaaaatttacaacaataatccgataagtaaattgaaaataacataattttaggaatttaatttgtgtctttcttttttgtacttgcgtcagttggataggaggccaaggcatgcttatttggaagcttatttaagaaaaatatagatgatgacccaaactatcactcagtaaattgtaattgctttagttttttttctcgaaagattgatggattaagatggatatgagaattgatgggtttggtttagtgatttcggatttttgcaggtttacgttggccatgttttgtgcatggtggtaaaacagaggttggccgtttgtgcaggtttacgttatcacatccttttgttgtctgtgttattacttacattattcacatttttttcgaaacagaaacttcacaaaagttcttggctagctagctcctttccttgaagatgggaaaaagaagctaattaatttgttcttcaacggaacgagattggttatctctaacgggcttaaaatatcatctctttcggacatggttagtgatgtgagaaaatatctcaatcgggcatccggctgtcacggatgacgcatctcaatcgggccaacacaaaagctcgtcacggatgactctcatctctaacaggcctagattatagcacgtcatggatgactctcatctctaacagacctagattatagcccgtcatagatgactctcatctctaacgggcctagattatagcccgtcacggatgactcatatctccaacgggcctagattataacccgtcacagatgagtataatccaaaaaaaaataaattttgattttttgttagcctcaggcctttgcaaaaaaataaattttgtttttttggcctcaggcctttgccctcactcgtgtgccttcccggtcggtcacctatccgg

SEQ ID NO: 9830 - DNA, 1501 bp, Oryza sativa
caactacggactctacactctaaaggagaaaattgacattgtgccatcatcaaaagtgggtttcgtccaaataccactctgcaaaatggattcgataaaatgccactgtcaacacttggttacacgctaaaatactatctcggaccaaattaccctcctctcatcttcttcctccctccatcaccatcagctctcaccggcggccaccatcccgccttcgcgtgagctctcctccatggctccatggagaaccacaggccacaggcccctgcgaggacccctcccatggctcccctccccgtgccccctcccatcgccccatcccagccccgcctccgcgagaccccgcaccccggctgccgccgccatcgcctccacctccgatgaccaccacgccacgccttcgccatggtcatgctcaccaacgactccaccgtgcgggcgcgcctccgccgcctggaagaacaggagcggctgggacggtgggttggcacgaaagatggagatcgccgacatcggcggcagcggcgcggatggtgtggagcgtgaccacggggtcgtcggttgggggtggtcgaggcggggaggaaggggagcggaggtggaggaggatgagtcaggcgtggtggaggaggggaggaaggggagtggaggtggaggaggatgaggcggaaggggagcggaggtggaggcgggcgcggtggagacggcgaggaaggcgagtggaggtggaggcgggcgtggtggagacggcgaggaaggcgagcggaggtggaggcgggcgcggtggaggcggggaggaaggggagcggaggtggaggcgggcgcggtggagacggcgaggaaggcgagcggaggtggaggcgggcgcggtggaggcggggaggaaggggagcgggggtggaggcggatgaggcgggcgcggcagaggcgagccggcaaggcatcccttgttagaggtggaagaaagtagtaacaggggcatttttctccgttcgggcattatagcgtgtagtctttaattgaaagtggcattttaacgaggcccactcccagcgtggcatttgggcgaaacccacttttgaggatggcataatgtcaattttctcactctaaagagtccctttcagtacagttaggcagtagccatgagagctatacgtacgtgcaagtgcaactgcacaagaagaaatcatggaattattaactaatgcccttgttgtgattaagaccatctaatccatctgatcagcgagtgacacgcatgagatgagcgagctgcgcgcagcagctagtagtagaagatgctagcgtagtccgtgtaataacctacccgacttaaattagcagcagttactaccacctgcttcgcaacccccaccgccattaatgcggtgatctactgcttgctgctgctgctactagcgtcttctttccttgagcttcagcttaattaagcttcatctccatcggtcgccacctgacctccccaactgtgaat

SEQ ID NO: 9831 - DNA, 1501 bp, Oryza sativa
ccccctttgcagtatcatggtgatacttcggggcatggcgacatgtgtggaatcgtgtcttgtgggtacagttgtacatctctggccagagtaaaactattcgaatagccgtgcccgcggttatgggcgatcaaccagattcaccgtgattagtctcacccctagtttagcttattgaactggtgtagtacaggtggttggttgggcctgttgcaacgtggtgtagcgttggacagtgattggttaatattgattaattactacagctgttttactgctatcaactactgctttgaaatgcctgctttatgcaaaagaacccctagcttcctttggttatatcctgcatcatacctcctcttccggtatgacttgctgagtacagtgggtagtactcagtcttgctctcttttcccctacactagagttgaagttcttctcagttggagccgtctcagagaggttggtttcgtcgctgccgtcaaggtttgcctgtggagtagagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctagacagggatttaatgcacattcagcttagaaattctggttcgagaatttctgggggtgacaagttggtatcagagccgaccttgaccgtaggacaagccaactggaaacctaagagccttctgaaccctttttttttcatatgcatatgcccttttgcacttggattttgtttcgggaaaattttggggtttgttcttttgatttgtgggaaaaatcttggtcgcttatttaattggatttctcgactagggacagtctagggatttagtaaaagtttattcgaaatttattcggcagtcggtcgggaattgtcgggtgatatgcattaggtcgtgtctatgttcggtggggtaagtttatgcgtatcagtatgactatgcatctatttcatgcattaagttattgtttagtcagttgcattagtgtcttttgtctcggttcgtgaaaaatgttgttctatgtataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacatatccccttcaga

SEQ ID NO: 9832 - DNA, 1501 bp, Oryza sativa
aaggaacaatataaggggtaaaagataagggagagagaggggagagggggtttaaataatttttctagatttgagggtgttaattgtaaattttggacctacatataaattaaaaaaagagaactgaaacaaaaagtgttaggggctgaaatacaaactaaagtcacttgcactatagaacccaaatgttggacctgtagctctagcctatgctctagcctatgtgccattcgaggctcctcagatttgtgtgacgcattgtgaatggcctaaaatggttgaagccaacaaacataccatatagagcaattttacggtccttaagaaggtaccataaggtatcacttgttttactgtaaatttagtacttcttagtacttaggtagtatgagttactataaggtaccaaatttacactaaattattgttacctgctcaaggaccgtaaattgctctaacatataaggtatactttctttctttgtgctgaaaagttaatggtgctattttttatgtgcctgctatgattttgtgtggacagacgcctggtgctgagtccagtgctttccttgatggtggatccctgcatttcttccaggcggccttcgtgcgagcagtcgggtgaaagtaaaatgttcgcagttgttgcttgtgctattcaatctcctttcattctgttgcattattccattcatccggacaaaaatccatagtgttatctgtacctctcctggttttattccattgccttcacaatggtcatgtctgagcagagaagagaaagaagcgtgtgatgtgaagcagcaggggcattttctgtgcgtcatccaaacgcctaatcctgttaaatgtgttaattttatctagttttaatcatttgttattgtattattgcattttccatgttcacatatttatgcagagagaattacttatatgccactagctcaaattcgcgtaaactctcatgccactcccgtatgttggccatgcattgactgttaactctagagtataaagaccgtatttgcccttctaacttgttagatatgtaattgtaccaattggttgtaatatggcagttatttgaagttgattgacatgtacatgtatgcatagcatttcaatattaatctagctattgaaggtatgaattcttagtcagtcgcatgatttttaaccaccatcatcacacatatatgttcctcaaacaaattcttttagctatatatacatgtgcatatcaaccaacttcaaataattgccatattataaccaattgatgcacttgtatgtctaacaacttagaagggtaaatacatatttgtactctagagtcaacttagaaggacaaatacgtctttgtgttctttgtgttctagagttaaaaaagatttccgtgcatcctgtcccgaatctcgagtcagagtcgaagccgactccgactccgatcagcgatccctatctgaacacagtggcagcctatatataaatctatagg

SEQ ID NO: 9833 - DNA, 1501 bp, Oryza sativa
ggattgagtagtctatgagcgacggcgtagtacagagtaggaggcaaacccaagattgatttcgcttgtggtgcatgatggcggcggctcggtttatatagagataggtcgcttgatcagggtgcccgcatgatctccacttcgcgtaaccgaaccggataagtcgcgcgtaacttatccggactccacgccgttttcacgcaccggatttttcggaatgtttccaaaacaaaacaaatccgaatttcccgcagcaaaacaaaactgcaaaaggaggctgcatctgtgcaagggtgaggaaccaattttgcgaaccattcgacgcgtacgtcgtgcacgcgacttatccggttcggttactgtgtttcccctcttctctccaccacacatgcttcaagtggctaggagggcatcctcccttttaaggaggtccccctcttctagaataagcaagatggtactaaacttcacatgcatgccatcccatgaggtgggcttttgtgattttccaaagaattaatcttcgaatgggccttagcccatctattaattccaacactatggatgtgtttagttcacactaaaattggaagtttggttgaaattggaacgatgtgacggaaaagttagtagtttgcatgtgtagaaaagttttgatgtgatggaaaagttggaagtttgaagaaaaagtttggaattaaactcggccttagacctgtttagttcacaccaaacttcccgtaaacttccaactttccatcacatcacatttaaaactttcccacacataaactcccaactttttatcgaaactaccaactttccccaaacttctctccaatttcagaaactaaacacagccttagcatgtgctttttttagagagtagcacatgtaagatttgacacttgtcgaacatgtgacatgtgattgatcatagagtaaagccactaactgcatactatatcaggaataaatgttgacatgtcttttatggttgtaatggcactttggtgaggttgtgtgtaacatttggtgaacctctagttcgaaataagtttacttttatttaaaaaaaattaaaatatccttactttatcaaatatcagtataattattaaacctcttttatctactcgtaacatatctatatcgtatttattttcataaactccgatgcaatgaatatgaaaaaataaacatattttgaaaaaaccgaagcagaaaaaaaacaaacttatcattgaaaaaaagttaagcttattctgagcacctaataaagataccatttctgttgaaagtgaaacaaagatttcattttcatcttccaaacattgtcccataaattaggagtcgtccattcaaaatatatcctagaatttttgccgagtttttactggtgttacaaatattaaacaaacaatgctataaaactcgacattctttgcccaggctggacggcaatccctttgcccaagcttgtttatacacccatcagttt

SEQ ID NO: 9834 - DNA, 1501 bp, Oryza sativa
tgatttcgcgtgtgttgcgtgaaggcggcggctcggtttatatagagataggtcgcttgatcagggcgcccgcatgatctccactccacataactgaaccggataagtcgcgcgtaagtgttaacaaccaaatttggtaacatttgtatcaggaaaggggatttgatcaaagaagagttggaggcggagatcgagttctggaacagagcaggaatcggctggagtccggatcggctacggctaggatcggctgagattgagttgagctaaataagccgatatagccgattctgacaatacgacttgtgcacgacgtcaggctcaagttgatatacttcaatatgattgccacgcatggatagagtcctgggaaggaaattgtatctattaattaggaaattttatgtaaattccttatagataagtgtgggcaaaagtctgccgcaaagacttgtgatattttagagtttgttagagataatggtcgtgtccggtatgggcatatcttgtaatcctcgggtataaatagaccccgagccctatgtaacaaaaaaaagagacacattcaatacaattccggcgcatcgccaccttttgcttttatttcgacgagttcttactttcgggttgagctgcatcggtttcgatcttcaacaagaggtaaaattcgtcatcacgaatcgtgttcttaggattagtgcttacatctttatgacactctaatcttatttatataattcgtcaagttatcatatatcttatataatcttcagcaatattgttatctaatctactaccggccaacatctgtgtgcagaaggcagccgattaggttagatcttgatgttgatccagattatataagatatctaccattctatgaatcttctagcggcttgattgtctagatattgttcttcttttcatacttaatgctgcatcaattgagtttgatctattaagtcgtacttagaatattgatttctaccctgctatctagttgccgattagaatagcatcggggtttcagccgatcatatctgatttaactttatttgttctatgtgcttcattgatacgttaaatctgccctttatatcaagatattgctgagtctaagtatattaggctcttgttcgatatattattcttgctttaatatcctaacatagagtagtatcagagtattagccgatacatactagatctatctgatcggctacgctatcaacatatatagtcctgttattgatatatattttgatctaagtggtttatactgtctcggcatgatgaccgatctatcccaatcacttgatttaagtatatatcgatataaggggtatatatcgttaatatctatagctgatcaagtagatttagtcattctttacttattcatgactgccgatcgatgcacagatgacatcggcttagatataaatgatgtgtcatcggcctctggccgatcggctatcatttataagtttaaccacggttc

SEQ ID NO: 9835 - DNA, 259 bp, Oryza sativa
agacttattttagctatatatatgtcagcccaaagaggagggagggaaaatatacttaatttagctatatatatatatatatatatatatatatatatatatatatatatatatatatatatatatatatatatatatatatatatatatatatatatgtcagcccaaagaggagggagagaaaatagacttattttagctatatatatgtcacagcccaaatagaagggagggaaaatagacttattttaaaaaggca

SEQ ID NO: 9836 - DNA, 1501 bp, Oryza sativa
gtctcctaactttacagtgactttgattttgattcttgaaacgaaataacagatacaaggatcccttaacttagcatagtactccaatgcacccgctcagagctccgtgcttcagcaaatacgttcgatgttagccgcattttattacgttgtaagacgttttgactttggtaaaactcaaactgttttaactttaacaaagtttatatacaaatatagtaataattataatattaaattagttttatcaaatcaataattaaatatatttttagaataaatttgtcttaggttgaaaatgttactacttttttctacaaatttggtcaaatttaaaacaatttgactttgaacaaagtcaaaacgtcttataacctaaaacggagggagtacctttcatagatcaacatatccagtggccatttttttttcccgagcttagaccctgcttagattggactaaaacttttaagtccctatcacatcggatgtttggacactaattataaatattaaacgtagactattaataaaacacatccataatcttggactaattcgcgagacgaatctattgagtctaattaatccatgattagcctatgtgatgctacaataaacattctctaattatggattaattaagcttaaaaaatttgtcttgcgaattagctttcatttatgtaattagttttgtaagtagtctatatttaatactctaaattagtgtctaaatacaaggactaaagttaagtccctgatccaaacaccacctaagacttacataaaccggcaatgagatcgagggcctatttgagggagcttctagcagctgcagcttctcttagaatctccagttgccagaagctctccaaacagtccagctttttacctagattttgagaatatgtagttatagaatctggaaaatgaactagaagccataagctgggtttcccagcttctccagattctcaacatctcagaatcttaagctccccaaacatgccccaaattaattttaggcttctaccattttttttcttgattttagttctagacttttactgctaacgataaaaaaaagagaagacaatgtaatacagtagttgttttgcttctcaaacttgccataaccccctcccccccccccaaaggtagataatgaaggtttagagggaaaaaaaaacttactacaaatgttttcgtaccgtttagactgctaataattggaacaaaccctcaacgttcatgcgtgcaacctcctcacttttaaggtcttgtttagttagagaaaataaaatttttggatgtcatatcagaagtttgaccggatgttagtaagggttttcggacacgaatgaaaaatttaatttcataactcgcttagaaaccacgagacaaatttattaagcctaattaatctgtcactagcatatatgggttattataacatttatggctaatcatatactaattaggcttgagatttatctcacga

SEQ ID NO: 9837 - DNA, 1501 bp, Oryza sativa
gcccttgatggcgtcgctcgccgacttgctgtcctggaagctcacgaacccgaacccgcgggacctccccgtctcacggtccacagcgatctgcaacccaaaaccagcaacagcaagtcaccaaaccaatctatctatgtattggagtacgtactagctatagttcatgaagattaaagagatatttactgatctgcatatgaaaacgcacaaagatgaaccaagaaatgtgtgtataaattggcccggcgaattgggcaaatattagatgagatcccaagaaagtggcgaatcttccgaactaagaaaagaaaaagacgatgttgggaatatggaaatgggggcacttcagaacagatgtgacggataacgtgtatcaaatcggccaatcaaagctcgggaaagacgaacaaaaatcaacaaaaacgacgcgaaatggcactgatcatagatccatcacagaaaatcgtcaaacctgcagatgaacagaaaagacagaccgaccggaacgggcggaataatggagcaagcgcagacaaatccacacataccgaaaaaaaaaacgtcaagcttagcgacgaacaaccgagacgacccaaccggaacggaagcaggaggagcgaagaagaagggaaggggctatatatatactgacctcggagctgacggcgccgtagttggagaaggagtccttgagggagcgctcgtcggcgcggtacggcaggttgccgacgtacacgcggctctcctgcccttcgagtcggagccggtgcggccattgtagtcgttgtcccaccacggcgcagacatatccttccctttcccttaattccctctcgaaaccccaactcttccctttttcttcggatgcgaaacgagcgagagaggaagtggagagagatgatcttggacgaaaatggagagatgatcccgggtataaataggctgggaatgggatacatatccaacctgatctgatcaccacgtacggcgcaggtagattagagaggtagggccgaatcgatcggcttcttgttttgtgagatatggccgatcagttttggtagcattatcgagttcttgggctgggtcatatgggatgtttgctttgggccgtgaagaatatgtgaggcaaaggattaagttcactttgaatccctcattttgtcgccaagtccaaaattcatctatggactgcaaaaccggatccctcaacttacaaaattagtaacaaggtctcccgttttagctgttttcaacttacaaaattagtaacaaggtctcctgttttagctgacgtggctcttttgactatgttttcgtcccatgtagtattggcgtggcgtttacgtggcaattccatccgggaaaatctgtgggacccaaatgtaagttacacacaaaataataataaatgagatattagggggggtgagaataggggtggataggctcggctcggtctagctcgttaggataacgagctggctcggctcggctc

SEQ ID NO: 9838 - DNA, 1501 bp, Oryza sativa
acaagtgtcaaatcttacatgtgctactctctaaaaaaagcacatgctaaggctgtgtttagtttctgaaattggagagaagtttggggaaagttggtagtttcgataaaaagttgggagtttatgtgtgggaaagttttaaatgtgatgtgatggaaagttggaagtttacgggaagtttggtgtgaactaaacaggtctaaggccgagtttaattccaaactttttcttcaaacttccaacttttccatcacatcaaaacttttctacacatgcaaactactaacttttccgtcacatcgttccaatttcaaccaaacttccaattttagtgtgaactaaacacatccatagtgttggaattaatagatgggctaaggcccattcgaagattaattctttggaaaatcacaaaagcccacctcatgggatggcatgcatgtgaagtttagtaccatcttgcttattctagaagagggggacctccttaaaagggaggatgccctcctagccacttgaagcatgtgtggtggagagaagaggggaaacacagtaaccgaaccggataagtcgcgtgcacgacgtacgcgtcgaatggttcgcaaaattggttcctcacccttgcacagatgcagcctccttttgcagttttgttttgctgcgggaaattcggatttgttttgttttggaaacattccgaaaaatccggtgcgtgaaaacggcgtggagtccggataagttacgcgcgacttatccggttcggttacgcgaagtggagatcatgcgggcaccctgatcaagcgacctatctctatataaaccgagccgccgccatcatgcaccacaagcgaaatcaatcttgggtttgcctcctactctgtactacgccgtcgctcatagactactcaatcccacttgccggcatgcaccggcgatcgggagagcaggtctccggaacctctgccttcgacgtcctgcaccgggagaaggcggcaataaggtttttgggaagcgcttcgcgcgactactccctgttcgcccgcgacggctcgtcttcctctccactcgcgtgctgcgcgccttcgtcgacgcccgcaaccgcgagtagtttctgccgagcaaccggtctttccgccacctcggtacgtgttcgatatgttacgtatatttgatctgttcatgttttactgcttagtttacatgtgtagatctaatgatgtgttcatgctagtttacatctgcaatgtcatgatttatttatgtaataaattaaatcattatgtgcttataatttcaacaatccaagaaccttattataggcgctatgattttactatggctggttttgccgatgcactgaggccggataaattcaccggtgtgcactttaagagatggcagatcagggtcactctgtggctgacagatatgaaatgcttctgggtgagtactagcaaacctgaaggaattcttactgctgatcagtagaagcaattcgagg

SEQ ID NO: 9839 - DNA, 456 bp, Oryza sativa
agagcggtcctccgaagctgcagcgtctacacgaccaagggaaagacagggcttttactctgataagctccatatagcaagcaggaacaaagcacaaaaatgggttcttgactttttaaggaagaattagagacttgaacggtccaattccgagttcaaatggccaagttatggccatttgaaggttatatgctctttaaatgaatatttgcgaatttcttcatttaaattttaatttaaaaatggatttattgcgtcagccgaggggaggggcgcgcggaccgggtccacgggggtggggcccacgcggcagcctcacggtccacggtggaccgggtgcacccgggctcgcaccgaccggcgccgtgggtcccacgcgtcagccgcacccgagggcgcgggcggctgacggccgggccccacgcggcagccgcggggcgcgcccgaaggcggcca

SEQ ID NO: 9840 - DNA, 1501 bp, Oryza sativa
attatgatcgaactcctgttttgcctccatactttctttctttaaaaggtaatctatagaaaagttttttatattcacaattttatactagctagctatgtgcaacacaatacaggtagatgtacactcacacgagcatgtgtgttttgtaggaggctaggatcagtatgttgttatatttaactcatatattttttatcgttctctgaattaagttttttttccaaagaaaatcgaataaattacaatcacgacaacccatgtctccttttgtaaatacgacaaagctatcttttagagagaagcaaaattactctatcatagacagcttaaatcattgcagaaaaaatgagagataattcagatgaggtaataagaatgattttgaagtccgaatgggctatcagacttgtaaaaaacgggggccactagatgtcattttaacctttaatttggcgtgttgacaattatacattattttacaggcattatatatttttaccaagcagagtaattataaaatattgttcataatgtgacatgctagcgatcttgataattactagttactatatagacaaatatatgaatagctggccatccagaacaatccaagaaaccactacataattccctctataattagtgacttgtaacctcttcttcccttccccttcccctcccctagcattccccatctatcctctcctcgctttcccaactgctccctgatctgctagttcatcgatcctagataaaattctcttgtagacaatcaagcagaaatctccgcagcttgaatcttgaattcaagctggctcctagctagctagaaccgcatgccatctcgatcggctaattattcctagcttctggttaattagctaccataacagtgctctcagatctcgatatatccttctttgtagatggtaagtacatgggagatcgaagaattcattagtttcttgccattttttccccagctagatagtacaaaccatctacagttgcatctctgctcgatcgatccttcactgaaatattccttgtactagatcactggccagcttctctttctctccattccctcccttggatccatgttgttcccaaagttctaatggaatttggcttagctaggtagcagtatatagctagcagcggcagcttgggatgagagtatgagaccacgtgtggcgcctccgagcaacaagtgcacagccctctatatatgccttgtacaagcaccaaatccgtgcctcaaaccgctcaaagtgtactagctctgcgtctccgctgttttctaatcgcgtctctgcactgcttgcgccgcgctggtgccaccactacatgatgcagttcacgcacaccgcgccacctccaccgcctctgcaccctaatgggcatggactagggttagggttgtaccttgacgtcggcgcgacgaggggaggaggaggagcgcggccgtggtcgtcgtcgtcgtcgacgacgacgt

SEQ ID NO: 9841 - DNA, 471 bp, Oryza sativa
gggattcgccggggtttaggggttatggacgccggcggggtggtcgccgccgtggatggaggaggattgggtggacgtgggcaactccgcggtttggatggattggagatttgaaaatgacgggtggtggtagtgggccggggaggggacgggctgaagtgatggtgggctcttgcgtagtgggcatcactgggcggggttgggaacgtgactacgggctactgggcctaatacagcctaagacgagggccccgtttgatttgagggataagtccattttaccatcctaaactcttcgctttgtctaaaatacaccctcaaacttcaaaaccgggtatttaacacccttaaactttcagtaccgttcatttttcatccctaatggtttgtagggcagtattggtacagtaggatgccacggggttggtggcgaactcgacgcggtctagatctaggggctagaggcatcga

SEQ ID NO: 9842 - DNA, 1501 bp, Oryza sativa
tttaaatcggagccgcttcaatacttaccaataagttctactgcacatggtgagttttctctgtgataatccaaacacccgcaagcaagaacacatatcagtacaacctctatcctacaaagactttattttatactgacttggcctctcacatcgccccccgtgtagacaaccgcaccggggaagggggggggggggcttcaaccctagtcgtcatcaccaccaccctccctcctccgtctcgatgccaccagaaaccacgcacggaacgatacggtggcaacatatcccgtttgcctcctagctccgccatggagattaggtggcagtgacgatgacaagcggcgtggtggcttcactattgaactcgacgactagatctggtgctttttgagagctgaggtgtactgggtcgatggctggggcggaggtggcgcaaggtggccgacaatgacaacaatagtaggttgccatatccgatatcaatgtggctagatctgacaccccgatagtggattccacagaggttgaggagagcaaactacaacataacaacgagagcttggatgcgtcgtgactcggcttggtccatatggaggcgaggcggcaagatgcggctatagaggagggggtgcagcctgaaagatctattccctagaattgcctttgtaagaggagattggaagatctattaccctaagagtgtggtgattattttggtgatttatgacaacacatgttggaagatattaggttgagttccgacatcaagctgaaagattgaaggtagaagatggacattacagcttgatgaggagcaagtaaagatattgacgatacggggacacggggtatgagtggctatatatggcaagatcgtgaagggcaatcaagactcggctacaatggatcatgaggaggtgaagggaaagcaagaggcttggcgccgatggactcaatctggtggtgaagggcgagcaaagactttgtcacgatggatcgtgcgaggccatttgaagccatgagtaatccacatcaattatttgaagagcgcaagatggaatgccgaagatcaataggatgtaattcgttgatgaacatcaagccaaaagccaaagtggtcattgatcaagacaaatatatagtcaattttggattaatgtgcttaatgagttataggtgagaatagtcctagtagtgagatggcgttggtgttggcaactgtcaaggtaaagcaagaagatgacaagaaaacattcctagtggtatagatttcctatttgcatttgagtatacgaattccgtactattaagagtgatgcattgttgatgtgtttgtttatctctcggtactcaaagtgacccatgcaagtgttaccttgagagaaaccagagccttaaactaacctatgagtggttcagagcttggttgggttggataactgtcagggttacgggtaaggtataccctctacccttcgatatacgtcacatatcgata

SEQ ID NO: 9843 - DNA, 1501 bp, Oryza sativa
cagatttatgactgctaaattcttatgaataagtgtaggcgtgtagcaactttttctagattgactgctaaatcaatttaccatcttttattggattgtcaatttttctagattttttttagatcaattcaatttttgtttggattataccatccacacagtgtatctcatatgtttgggaattggttatgcgtgttaataaaaaaaattaaggaactattttttaggggcttccactatatattgggctctttggcttagtagaaatgatatgatttttttgataaaaacactctcaaaaacttatttgtaggtacttttcaagacaacatattggctccagggttgggctcaactacaaagacatgatgatgatataaagctaataaatgatgcatgtcgtaaacttgaatcgacgattatgcacctttttaccaacttcggagggagattctcaaatactataattcagtaattgtggattcttttatcttgtgttggtgtttattagtttgtgtttattttatgttatgtcagtgcgtgctatgtgtgtttatctgtggattttgtaataattgattatagcttattgagcaaaggtcggattgtttattctattattttaaaaaaaagtatagcaaattggctagaaaataagatgcatgtgatggacaaaccagctagtaaaacgtgctttgtctcagtcgtaggcttgtagccttacgtaacaaactctaatgattggattttggatcctcttacttgcatggtaaagtcaaatgagcacagtatctatgactctggggattttgtagctgtccaattgtgcaacgaatggacaaaatatgtgctatattatccgatagaaaatttgagccgctacaggatatgtatacttctctgcaccataactacagtgaatcactttagataattgtagcaacatactcgtgctaccattcctctgccttaatttgtacctgcaaggctagtactccctccgtcccacaatataagggattttaagtttttacatgtaacgtttaatcactcgttttattcaattttttttgcaaatataaaaaacaaaaagttgtgcttaaaatactgtggataataaagtaagtcacaaataaaataaataatattttttaaaaaaattaaataaaacgagtgatcaaacgttgtaagcaaaaactcaaaatcccttatattatgggatgtgatggagggagtacaagttacgggatccttttcttgagctatattgtttaaattatgaaattctagattttgactttaacgaccaaaaccaaactgacgatagccttccagaaggcgacatttagtgttggggttgtcaacgatgggagcaccgatatcagtgatgcttatgggcgtcacacatctttttggagacgatgttagctgatgccttcttccccaacttcgtatctcggggttgactctctaagtgaaaatctagttataaatgttcaga

SEQ ID NO: 9844 - DNA, 1439 bp, Oryza sativa
cacaggcacactgctagtactgcgactgagccacctccgtactccgtcgtacatacactacactactccctccgtctaaaaaaaagacaaactctgagttttcgtgtgcaattttgaccgtccgtcttatataattttttttataattcgtattttcattgttgttagatgataaaacatgattaatattttatgcgtgacttgtctttttaatttttttcataattttttcaaataagacggacggtcgttgggcatggaaagcagagtttgtcttttttttttggacggagggagtgagtttgtcttttttttttttttgacggagggagtagtttctggagaccgtagagcggagagtattcgtctgcataaaccgtagtagtttcatggagtacttgagggtgtgtttagttggggaaaaggaaatttttggtgtcacatcgaacgtttgaccggatgtcagaaggggttttcggacacgaatgaaaaaactaatttcagaactcacctggaaaccgcgagacgaattttttgagactaattaagccggtattagcacatgtgggttactgtagcacttatggctaatcacggactaattagacttaaaagattcgtctcacgatttcccccataactgtgtaattagtttttctttttatctatatttaatgcttcatgcatgtgtccaaagattcgatgtgatgtttttgaaaaaaaaattttgggaactaaacgggccctaaattgaacagcgcggtaggcagcccatttgtcccgtaaactcggcgatgtaacaaaaatgaggctctcatagggaatacatccaatcacacaacctttccatgtacaccaactagcaaatgtcacaaaaaattctataaaaaattatacatttacacctaatagaattactccaaagtcttatatttaaattcattatattttagctatataaaaaacgaaaatctgacaattttatcttttttcaggctaaaatataatgaatttaaaaacaagatttcacacgtaggtgtaatattattggaaatatgtgcctaatttttctaaaatttaatatgatatttgttagttggtgtataggatatattcctctgatatattgccataactagctagatatagatcaaggagcaagtctagggcacgcttttggataaaattgagtagcagatgcacggtaagcggccaaggaggctgttgcctgttgagacatgacaaattagtgaaaactcaaggctatctaagctgttgcctacttgcctgtaaaattagtgacgtgaatgaaaactcaaggctggttcaaattacagggaaaattagcaaatttcacgaaccaaaggaaaacgtcgaaataggtgaaacagtggaacttcatcttcgtaataagtagctcttcacggttttcctgcaga

SEQ ID NO: 9845 - DNA, 1501 bp, Oryza sativa
gtgcagtacgagagagacgaataagttcaccggaggtctctcaacttaacagcgagattttttaatgtcccttaactataaaatcagaaatgtatacccctaaactcatataaaccgtacacacaaggtcctatggcagtaaacatgggtggtttcactgacgtggcatcctagtcagcaaaaaaaaatttaaaaagtatgtggggcccacatgtcagctgcaaatcttttcttttcttctccttctcttcttttttctctcttctctcttctcttctccaaggcagcggcgggcgaagtggcgatgggggagcatagcagcggagcagcggctggcgggtgagcgcggcgtacggcacaggcgacctcggagacgttcgtgcacaccttgttgtgtcggtccttgctcctggacgcggcccgacgccccccggcctgctgtcgctccgcccgccccgccgccactccgtccgccggcatgctcctgccgccgctccccgcgaggacgagggagaccaaagaggaagagaaaggagagccgagagggacttgtgggggcccacgtaggcccaaccatctttattttttagctgacatgtgggcccacgtgggccccattattcttttattgatttgtgtgtgagactgacatgcgggtcctactaagtttattattttttcgatcaaattgccacgtatgcgccacgtcaatgccacatcagatgaagaccaagtaaaattttccacgtaggcgccacgtcagccaaaaccaccgtcaaaaccgtcgagggacctcatctgcactgattttgatagttgagggacccgttgtatatagttttctggatgaagggcgaaaatcagattcgttggcaagttaagggacctcaggtgaacttattccaaactgaattaatgggctgtaaactgggttggattagtagatcaattgggatgagcttgatggggaaaaggttcatttaacatccctcagctatggaccaagtctgattttgtcgctcaaccacaacatcgggtacaaaaagcctctcttatattgtacacccgggtagtatcgatgagggttgtttgatcctatgcggcatagtgccgctgttttcatccgacttgacgtttacgtggtattataatcacaaatcacagcccaaatgtgacgataatattatcatgttgctagaaatccttaatgccttgtcctaataagcaaaaacaaagataagtgttcacatttgttttgatgatgtaataaatatctcagactctgcaccgtgagatgcaaacatccataataaaagtgctcacgcaaactgaaaataaccgtaacaaagtaacaccatcatcttctctttgttggaaaattaagaaaatttctagagtttaattagtgcagagtgcagaaggtaacttcatagcagcaatgatttgcatgccaacttggattgttgagaaaaaaaagttgactgtttatttcaccctatag

SEQ ID NO: 9846 - DNA, 1501 bp, Oryza sativa
aaagagaaatggaggtgaaaagagtagacgaagagaattatgtaattctggcgccaaaacagagtaaagatgccatttttccctccacggctccattaccgcggacattttcgcgccataatgtggcaacgctagctcggcctcatttgctggcttgactgcacggactaatgggctggcccattatactctgtatatacatgcatgaatgtgagccacttatttttgctggatggcgaggatggtttgactgcaccaccgtgccttcacccctcgaaggtagaggatccaaatcctaacctgctacataactacctacgtcccataaaaaaccaacatggtatcaaatatgacttatcctgatataacaaatctagacatatgtccaaatactgtccatatttatagtgttaattaggataggtcacatctggtcctagattagttttttatgggatggagggagtaacatccaagccctgccatcattgatcaacacacatgcatacaacatatgctacagtaaaccgaagtaatgtagcaacatacacttatccaattctctaatctccttcgcgaacaccgacgcttgcactcacacctcattcctccctgagtctagacccgataacactatcgaccgaagttttcctccaagaattctgactctagtcaccttctcacatgatatcccgaccgcactggacctctgatcctccctgagcataatctcggtcctcatcattgaccaaggttgacctgaagtcacctgcacacaatcagacaaagcaaccgttcctgagcacatatatcataacctgactcattagtcacacgcacttacaccaacatccacatatcttttcaaatcagttcatcgaataaatcatttgtaaagccaattattcatcacaaaatattaatcatgacaatgatttcacaatttgtgcttcgcgtgcaatctcctgtttgcaatcccctgaattttctttagcgagagctatttaattgctgcagattccttcttgactatttaaggtacttaaatagtgctatatatcctattttactataaagttataacccactaaattttaaaacttaagatgtaaagataccaaattattattcactaataattattacatcttaaatattatgcaagcatgctatattatctatgatttattgaattttaaagcgttaaaatgcaagcatttagttattattctacataattcacatattgttttaatatatctcttcattattttttataatatcttacatacctatatagtttatcctcacttacttaatattatttctctcctctcttattaataagtcatatcatattaattgtttagcccttagataattcatacatggtctaaattatctctcattttcttctctcattaaatcatactccctccgttccaaaatataagcatttttagacccggcacggtctccgagataccactttgatcaacaa

SEQ ID NO: 9847 - DNA, 1501 bp, Oryza sativa
ttattatggtaatcggtgcagtgtccattggtaaattaccatgtttatgtagtgttattccctaaaagtgagttcgagcggtgtactacggctaaaaccacgaaatcatcaaattgtctagcaaaatttgcctagctggaaagaaggggaagaaacacggtggagtccggctttgcctgcgccgcggtacacgtgaagctcccgttttcctcctccgtccactgggcacgggagtgggctgagaagaagacaccataaacgaactgtctccctcgtctcgtctcgtcccgtcgtcccgcgcgtcacctctcctcttccgctacgccgcgccaccgccaccgcctccgccgccctagggcccttcccatccccaccggctgcgcccgccgtccgcagccgcttcgttccctccccccaccccgtcgccactcgccacaccgtggccgggaacggcaagccacaccgcacctgctgctctcctcctcctcatcttcgccgccgcggaccgagccactctccgatcctacggggaggtaagacgaatttctctgtggttccctttgattggttcatcggctggagggaagtactcaccgcaagggcggaattatatccgtgtttccgtgcttaggtttttcacccccgggttctatatacttctatttgatcagtgtcgcttttacattcttctggcccagacattaccaggcacgctgcaattatggttggttcttagattgaagtaatttaggacgtgtactgcgtgcacttgctaatctgtggttatttgccgtttcggctctagtttgacaagttttaagacgcatttggtatttttcgacgggatctcgcctgaattttgggcgaaattctgttcagatagtttagggcgtatacttgtgctaatctgttcaatttggggcgtatatgtatcataatgtatgtagtgacttgaacaattcatgcccccgcagtgcaacttatatatagaagaattagatttgctactagaaaaccatatccgagaaaaagtcatcgttcgacagccaattcacagttacgaactgagctgctgccagtggaatttccatgttgctgtaccaacaccaacatgaaggcatgtgagcatcctgaacataactttgaacattagacaacttgacatcagcacagcaaattacgtgtgcagatgtaggccagagaacaggagaaataaggtacaattctatggtacaatgcaactaattctaagcacaaatagatgtaatggtatatggttctatcaacttgatgtaatcgtctgagattaataaaagcttcctttataaaaaaaatagtagccacattctctcatctggctgaactaggtgcctgcatactagtagtgcgcatgattgtaaaaccagttcttggatcctgaaaccattcaattgcttcgcaataacatgtttagcgtcgtatggagtcagttttcctacattataagctaaaatgtcatttt

SEQ ID NO: 9848 - DNA, 1501 bp, Oryza sativa
gaatggtttcaggatccaagaactggttttacaatcatgcgcactactagtatgcaggcacctagttcagccagatgagagaatgtggctactattttttttataaaggaagcttttattaatctcagacgattacatcaagttgatagaaccatataccattacatctatttgtgcttagaattagttgcattgtaccatagaattgtaccttatttctcctgttctctggcctacatctgcacacgtaatttgctgtgctgatgtcaagttgtctaatgttcaaagttatgttcaggatgctcacatgccttcatgttggtgttggtacagcaacatggaaattccactggcagcagctcagttcgtaactgtgaattggctgtcgaacgatgactttttctcggatatggttttctagtagcaaatctaattcttctatatataagttgcactgcgggggcatgaattgttcaagtcactacatacattatgatacatatacgccccaaattgaacagattagcacaagtatacgccctaaactatctgaacagaatttcgcccaaaattcaggcgagatcccgtcgaaaaataccaaatgcgtcttaaaacttgtcaaactagagccgaaacggcaaataaccacagattagcaagtgcacgcagtacacgtcctaaattacttcaatctaagaaccaaccataattgcagcgtgcctggtaatgtctgggccagaagaatgtaaaagcgacactgatcaaatagaagtatatagaacccgggggtgaaaaacctaagcacggaaacacggatataattccgcccttgcggtgagtacttccctccagccgatgaaccaatcaaagggaaccacagagaaattcgtcttacctccccgtaggatcggagagtggctcggtccgcggcggcgaagatgaggaggaggagagcagcaggtgcggtgtggcttgccgttcccggccacggtgtggcgagtggcgacggggtggggggagggaacgaagcggctgcggacggcgggcgcagccggtggggatgggaagggccctagggcggcggaggcggtggcggtggcgcggcgtagcggaagaggagaggtgacgcgcgggacgacgggacgagacgagacgagggagacagttcgtttatggtgtcttcttctcagcccactcccgtgcccagtggacggaggaggaaaacgggagcttcacgtgtaccgcggcgcaggcaaagccggactccaccgtgtttcttccccttctttccagctaggcaaattttgctagacaatttgatgatttcgtggttttagccgtagtacaccgctcgaactcacttttagggaataacactacataaacatggtaatttaccaatggacactgcaccgattaccataataattttcggttgaagagtaaagagaaatcgcttgaaatataaaaaaaaaatcgttgggcccacgtgtcagctctt

SEQ ID NO: 9849 - DNA, 1289 bp, Oryza sativa
gaaaggtcatggcaaggggccaatcgaattgtggatgttctatatgtgctgcatgcacagtggcacatagtggttgttctttttttttaattttttatcccctatcgaacaattgtggttccacaggtgttgatcgatatgtacgcctatcgaattttggttgttcgatggggtgctaaaggggtgtttagattcaggggtgtaaacttttggtgtgtcacatcgggtattatatagggtgccgcatggggtatttcggatagtaataaaaaaactaattacagaatccgtcaatgaaaccacgagacaaatttattaagcctaattaatccgttattatcaaatgtttactgtagcaccacattgtcaaatcatgaagcaattagatttaaaagattcatctcgcaaattagtcgcaatctgtgcaattagttatttttttagcctatatttaatactccatccgtttcacaatgtaagtcattctaacatttcccacattcatattgatgttaatgaatatagacataatatttatgtcgggaaatgctaaaataacttacattgtgaaacgaaggaagtacttcatgtagttgtttaaatattcgatgtgacaggatgtaaaatttttatgtggaaactaaacagggcctaaacttgcaattttaatttgtcaacctctatttaaaaaagtattatttcttaaaaaaatattcgaaaattcgcatcctaggcaaaatcattcctctgtgttcttgaaaagaaacaaaaatattcctctgtgtttgttatccagttgaataactttagaatatatatggctcgtgcccggttgacacgggggagacgaaccagcgccaacgacggtgtccaaatccggtcaatttgactcggtcgtccgacgagccacgcgaaaccagcgtcggccatctgcaaccatcaacggcgaggcaacgcgacggacacgcgcgcatgcacgagaggcctcctcgattttagcgagctgccaccacggacagtgcatgcctaattataccttcttcctcctcctcctccgctggaacgcctttgcttcccaccactgcccgtcggtcgatcggtcgagcgagccggcgaacgcttgttgcctctcctccgttcgcgcttagctgggcagaggacgggggtgccaatgccgcttcggcggcggtgggcggcgcttttgttaggcgtcgccgtcgtccttgccgtcgccgccgccggcgcgcgtgcgcaggactacaacaatggcggcggcggagacggcgagg

SEQ ID NO: 9850 - DNA, 264 bp, Oryza sativa
cgggcccgcccccccccccccgagggggtcaggccacgtgggtgaccgcggctacccaagcctctagtcacgatacccccggccccatgtcaccgacagtagcccccggcattacgccagggcgatcgcgcccctcgagggaagcactcgggcgtgacgccactccttaggcccggtgacaggtggggccggtccctacaggcgggcagaaacccagcggtcgcaaatcgcgcgcatcggcaagggaaaaccgactgacaataa

SEQ ID NO: 9851 - DNA, 1501 bp, Oryza sativa
aaaattcttattaccgtggactgtcacttgagctgcgtcatttaaactttagatcttgagttatacattgaagcaagagatgggtgaaaaggacagtattcatccgagcttaagcaccaacaatgtattttacccatataattgttgggaattgataggctagtgcgaagtggatgaaggatagtgattctaggtaaatcgagactaagaagggttgaaaggactgatactaaagatacatactaagccaaaataatatgtgagatgttgcattcgaactcaaaatctttcaccttagccctcacgcacattaccatctcacctactacacacatctaacttgaatatagatgtttttcttttaaactaactctgaagatatctttactaccatttggtaacatcaaccggttttagaaatatctttagtacgggttgttgttttcaaccgatacaaaaaatgcatctttaatgctggatagtaattaacatcaaccaaactaaagatcatccaacattagtctcggttggtactaccaaccggtactaaagatatattttttattggttgataacaccaaccgagattagagatgtttatagcgatttggacttttagaaacggtactaccggtacttaatctagttgaaatatttatgttttggggctttggataaaaactcgtttgtcaagtagtgactatagtcttctaaaggggtatacatacaaaacaacgtacatattatagtcaacgcataaccacacgcacctgctgagtacacaccaaactggaatttcatatgtacaaaattaaaagaaaggagagaatatggtacttagagtatcacttctgtcttagtctcgtcataaatgtcatcggttgtaactttctgacgtcggaagaaaaggttagtgtctatactagttactaccatattcgtctcataatataagggtttttagcgttggatacggttattaagaaagttggtagaattaaacgagagaatgttgtgattgaatgggatgtgaaggtagatggaaaaattaaatagtggagggttgtgattggttgggaagagaatactagagaagaaattgttatattttggaaaaattttgaaggctaaaagttattatattttggaagggagggagtacctcggtttcatattataatacactttcatttttccctaaataaaatttctataaatttaatcttttttcacgaacgcgtaaaataattgcacgtcaatatattaaacgaatctataaaattaatcaagtttatagtgaaatctaacaactcttaaaacatcaaattagatccattaaatctaatattaaatatattttgatagcatgtttgtttgctgttgaaaatattatcatgtttttctgtaaacttaatcaaaattatataaatttgacttagaaaaaaagttaaagctcttacgaaatgaagggtgtacatgtttgggctttggacaactacat

SEQ ID NO: 9852 - DNA, 1017 bp, Oryza sativa
tgctagcccgaagaaggcaagagagaagaaaaaaaaaagatgtgcagctgacatgtggaccccacctatttttttattttttttattgactaggatgccacatcagcgaaaccacccatatattgatatatacttgttaacgaccaaatttggtaattcaagtatgggggattgttggcgatatggcatgaggccttcgaccaaatctgctgaaaccagtaaggattcaagcccgaaacgtcaagtttagtcagggcgaagccccccatggcgtagactaagaagcaaggaccgcgagaggcagggaatcgcgcgggtaccttgccaggccagaggcctcctgggcgaaggatgcagggcgaagagtatacgcggaagggggacaacttcgccatagcaaattcgaccccgggaggaccaaagaagccatcctagcccatcaagcctaagggctaattgggtcgataatcgcttgacggcccgctaagggcccatggaccacaattacactatgtacccatgtaaatgtccctttcataagggcaaccatgtaaattcctctgtataaccaaaaccctagtagtaagaacctgtatgctataaatagccccataggaccatgtaatagggggatcctaagaaaaattctcaatttaatacactttacttctttcccaactactgttgagtgaccacgtgtttcgacgtatgcggttgtcgtttcgatcacagggatggagataaaaccgaagcggaatccaaggtagagatcgttccggaaacagagcaagaatcagctaaagtccgaatcggccgcgaccaggatcggcagagttcgagtcggacaagggtagtcgattgagtcgattccgacaatgtgatttggtacacgttgtcagattgggttaatgtgcttcatatggattgccacgcacggactaagtcctgaaaaggcaattgtatctattagttaggatattttatgtaatttccttagagataagtttgggcaaaagt

SEQ ID NO: 9853 - DNA, 1501 bp, Oryza sativa; identical to SEQ ID NO: 7138

SEQ ID NO: 9854 - DNA, 1501 bp, Oryza sativa
ctcctcaatttgacaagattacctgaatgtttgttctgtgttagcataatttaatataggcagactgatgggatatatcaaatgggagattctgccattgtacctcatagattatttgtttactgatactagttcaagttatgaaatgcttgatgtgatcctcatgagccatgatactagtactgaagagtatagcaaagtatgaaatgctagatgactctgcagatttttgaagatttgtagattctcctctgcctgttctttccatttagcagtacaagtcaacatatttgtttcggcatatgtttgcatcttaactgacaccatataccttgtctttttcaaatggtgagttccataatggagtaacagattaccagtattttcacctgtagtttcatagttatttgatccatgtttgcaaagatcaaaatggacaaaaacaagagcagtgttgtagctagtaatttcgagatttttaactatttggacgggttagtgtctttgtttttatcgtttggaagggtttggatttcattcataagcatgaaacttagcatagacttgcacattaaaacatgacatgagaatgccatatccagctgcttggattgtgcagttgttttagctaaagtattatgtgtctgtaacgtaattgtgatatgtgatccctgccgttggaagcatatggactcactcaccctacagcaccactcgcaagagaataaaatgctacacaacctcatgtgttatgcaaatcaaagaaactgaaatgaaaacggaaacccagtaaatgagtataaattggggaagtggatttttgtcccttgaggggacatcccctcgtcttgtgcatggcgtttaaaagttatcattttttttaaaaaataatgtcaagatagatcaatatatggtatatcttttcgcgaacatgcaagttaaaattcgacttgtgcaattgaaagcaaaaagtaacaaatttgatcgtgaattaccgttctatttatagtcaaatttgttattattgtttctacttgtataagttgaattttaatatgtatgtttgtgaagtgacatcacatattgatctatcttactatttttttcaaattttttaatggatttttaagtgacatataaaaataaggggatatcctcttgaagaattaatagagttttccataaattcgtgacaaactgaaacataccacatgattgcaattctgcatgccctcttccccttgcaactcccatcaaacccgtataaccaccacaagttcactgtcatattcaccggcgtattctcacttgccccttttcacttgtttaattgagtataacccctgtgcacctctattcttgtgtgactaagtgcaggattgcagttcctgcattaggggatcacactgtaacatctggattcgagtgaaattccccccaaaatgatgaaaacgttcagcaatgtagcaccctcaaacgctaaaaaaacaatggctatata

SEQ ID NO: 9855 - DNA, 1501 bp, Oryza sativa
catagtcactctcgtgcttttgttatgtcggaacatgccggcccccactacgtactatggcgaaaaggtatgcgtcacaccgaaaggcgtggttctctcaatagttgttggaaaagtaaggcaattgtattgcttagtaaaaaattatttggggatccccctattacatggcctagaagggctatttataaccttattacaggttctctccccctagggtttaggctttacaggagaatttacatggttacccttatgatagggacatgattaggggtacacaatgtcctttacacgtatggccccaattgggctaaatggctcagcccattgatcttggcgaatccccgcaggggcgcaacagcccgttgggcttcctcacggtggggtttggtaccttggcgaaatccataccttcgggccgaggctttttgcctcgccatcttcgcttgcgtggcctcctgacggggccctgtccgacgaagcacgcgtacttcccgagccatggctttcgcccttagggtatccctcttcgaccttcaccgcttgcttccggtttgaacctgtcgccaagttttcggtttcggtaggcccggccgaaggcccttcgcggtatacctccaacgcaaacatgacatcggccgaacttcctccatcgatgaggatgcgccgaacttcaaaactagccatttctaccgaaacgatcaacgggtcttggtgcgggaaaagaactcctttggcatcttctggtccgaaggatattggctgtgaaaagtatcttggaatgctgtcagctgtagagacaatgctgagacaatgcctttgtgcttgaacattgccttgctgccgaatgtttcgactctgctcggtcgtgtgcgaagagcgtccgtgaaaagcgcattataagttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagacagttcctctcaaacaaaaataacattctacgcagcggaaatataaaacgataacaaactacggaacagctatggcgactccactccacaggcatcttaaccaagaacaagcctaatcctccagatcatcaccttcactgagatactcctcttctgatgaatgaatattgcaagaatgagcgtatgacatactcaacaagccacacagcaaatatgcaagtgcacaggataacaaaggatggcataatatagctcatttgcagaaaacagcatttaataaatatataagagaataataaaaacagttgaataattgatcaatattaaataacaccatacaacacacccatgttgcataggcccaaccacatttgaacaactaaccccagttgaacaaattaaacctccaaaccaggaattaaccattccaaaccagg

SEQ ID NO: 9856 - DNA, 1501 bp, Oryza sativa
cgcgcgccctggcggacatcctggcacgttctccattgaggggcaacaccacctcgacgacgacgaccaccaccaccggcggaccgatcacgtcgacgtcgtcgaagtcgccgtcgtcaccggttcaagcggcgatcatcaactacgtgcaggcctcacgttcgccgtctccgacggcgtaccacagcctgaacgagcggtggccgagctcgccgacgccggttgtggttgtgcggtcgaagtcgccgtcgccgtcgtcgccaccgataggtggtctgagtctgcagacgacgacggcggcggcggcgagaggcgtcggcgtggtggaaggggtggatgcaggtgcaaccacgtcggcgtcggcgtcggcgccaacgcaggtggtggcgctgtcaagggaaggtggtggttcgcggtccaagtcgccgtcgccggtgccacattaataacgaggctgcagaagagacgccaggataaggctatagcttgacaggcaatttgattctttcttccttttttttttttgtgtatgtctcttgtatagcttgtgggcttagatttgctccttgatcacattgtcttgacacgaagaatgtgtgtattttgatagaacggaaatgacaaagtcctgccaagcaggggttctcaacattaagggcccctttaaatcaaaagatttatggagaaatttcattggattaacatcgttcatttttatcacttattttaagccggtgagatgcggttttcatttgcaaaaggaaaagataaaccctacccaaaacactaagcaatcattttcagcccttgctacattgtgtccacctctctacctgttcaaactcagcccagcccaatccagctcacagtctaccaggccgggctgatgcccatagcttgggcctgcgttttcagctcgttttttctgaggcccagtccagaacctgacacaatcattagaacgtacgtattatggcaaattaaatgatcgagatgtttgtaactgtccattaattgaccaatttacaattatgcatatgtaactcaacaaatcagcgtgttttgctatttataggtacgactataccaagaccatttcagttggaattttcaggtgaaaaatcaatccaaaattttcaattttgagctttcaattctatgaaaagagacatggaaattaaaaaagaatgaatcagcgtcttcgtttcagattggcatatatggtgaacgtacaactaagcacttgaagaaactctcgaaatatcttcatctaaaacatgggcatctgcaaaaagatgcacataaaaagttgagttagagaacacagagaatagattgcagaaaatgcatgcaacttgtgctgtactctggggcaatttcgttcttaccctgctttgatgttcaatattgattttgcccctgttttttacggttttctttttaccctttgtttttctgaatcgaaaccaaaatttacccctgttttggatgggtatcttaa

SEQ ID NO: 9857 - DNA, 1501 bp, Oryza sativa
gtctagagtctatatagaaatacaatttataaataacggaaattcggaattgaaaaataagaaatattggaaggggagtctagagttcatataggagtataatttagaaataactgaacttttgaatttaaaataagaaatataggaataaaatttgtaaataatagaaattcataattaaaaataaagaattttggaagaggaatctagagtccatatagaaatataatttggaaataactaaaattcggtattaaaaaataattaataactatcacgtttatacaacactatgaatattacacatgattgatagtttggtcaagttagtataaaaattaaattatgttattattttaatatattttaataactagaaaaaaattctcgtgtgttacaatgagtgaaggctattttattgttatattgcttagtgaaggtgaaattcacagtggcaattcgtttggatgcatttttttttaaaaaaatcatgagttgcggttagaagtctgatcatttcaaattagcatgcgagttttttaaagagatttctcatacgacttcttttgtatttccataaacgaacgaacttaaaaactgactcaaatacggacatgtatttccaaaagcgaacgaacttaaaaaccgactcataaacggatgacgtaacaaaataccgacaaaaaaatcttcaatttttataataatagagataaaataagaaaaaatgtgctattatatgagacaaaacataaatatgctagccgcgcaatttgcgcaggccaccatgctagttctacttatagcaataaggatcatttcctacttgtgagaatattaattccttgtattcttaccttttatgttgataatttaggatttatgcataaacaacaaattaaatttgtatagaaaccactgtaaacatggcgaattattttgtgaacatatatttgttcatatataatatgatcataaatttatcctagcttcagaactaggacgaacaatgtcaaaacactaattctctgattcaaacattaatttatcatagattcctctagctacttaaattactttacaggttgtaaattcttgaacatcaagtagtcatcatggtgccatctaaacaaccaagcaccacaaacatagaatctattgtggcataaaatagatgaaagcacaaacttgagctatctagaagaagtgcgtggttgcatgaagactacagtctatattacaaaaccaactgcgtcattccaattaaatgtcccctttttgaagtataaaaaaaaaggtactacgaagaaacttgatgtcgaattaacagaaaacttaaaatatataggatctaagctgggcctaaaaggacatgaacttggatagtggtctccagtttatagggtccaatttttaaagcatggcgggaaacgaccttgcaagcatcattgtaagtatgcactgtcccttcttacttttttggagaggggaccagccctac

SEQ ID NO: 9858 - DNA, 1501 bp, Oryza sativa
aataactccccgtgatcccctctccctttccccccatttttccctctctctctcgcgttcaaacgggcggatttgcccccgcaaatctcgccggcgccattgatggcggccggacctcccgcgccggtttccttcccctccggccgctctctcccccttccaaccctatttaaaccctccccgcacttccttcgcccgtttccaccctttgccgtgccttctcctcgccggaatcgagctcgcgccatcgcctctctctccgccgtcgccgccgagctccggttcaccgccgtcgtcgccccggaccgcctcccacctcggcgccgcctccttcggcttcaccgcatcctcgccgacctcgtccacctctctgtttcggttgccgaccgccggagcgccgctgtccccgtcgacctgagccgcgccaccgcctccctccgctccggccgcctcctccgtcgccgccgtcgccccggggtgagccgtggaccgtcgcctcctttcccccttccctcccctctctcggccgccgctccgccgcgccggtggtcgccggcggcgatcatcggggcacaggcgcgccgtctcccgccgaccgcgccggcgtggccgccctcgggtgcggctgacgtgtggggcccacggcgccggccggtgtgagcccgggtgcacctggtccaccgtggactgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcagaagatctgctcttcgtggaggttgaagccgacgtttgggaaagcgagcaaggcaagtcacatcatccttgaacatattggttcccattttataacattattttgatttaaattattgcattatcgctttatttaaattcccgcgttatcactgttttatttagccatgcctatttacctttgttatgaccttattattattgttattgatattattaccttgttcaccctagattaaacaaaaccccaactagtggacactctactcatggaaccactagtatgaatttaggtagaagcttcgctggttaattaggcaaaattaggtggttttacaactctagactttgggaatattctcatcacctggacactatggaatggatggattattgtggaattggattcacacctccccctctattcaaaatcctcaaaatggttttaggctgggctcggggtgcatggttttgatagtagcacctcggccatataaggaccggt

SEQ ID NO: 9859 - DNA, 1501 bp, Oryza sativa
gtatcgggtaagatctcctaaatatatcaaacagcgatagcatgacaacaagccttttttcaccccaaccactttcttcccatctttatcaggaacaacagaactatcaggaccctcagagaagtagcccaacggaagcccataagtagcccgaattttcagcatcaagtcatgatagaaaccagttgcttctgagaggaaacttctaacagaagatctgatcctcttgatccgatcaggattggcattgttcttcccagcagagacaatatgagctcggaattcctcaattcttttgtagtgcaactgccacagaagatattctatctcacgtttttcagagaagtcatgatcacgcaaggattatcttttcatagttctcacgcatctgaaaccatatgttaggatctgatggcactttggactgtgctgaccttcgcagacgactttcatgttcagcgttctgcagaagtaacatcattatcattactcactcgtatacactatctatttcaacataaggtttcatgtcttgaaataaactatagaagtggaagaaacaccatgtgaaagcaccaggagagaattttagtgaaggaattaaaaggaacagacataagcattcaataaatagtaaaaggaaataggccatatgcatccaataaatagtaaaaggaaataggcactccaaagctagatcaaggacatcaaaattctaaaagctttaacatctcaactcagaagccaaaaaaggtgacctatctatatacatattatgaacaatgagcagtcaactgttccacaaaaccatggacagctttttcatttggtggagatcacatacatttcaaatctgcatctagtttaaagttaactcagttccatgaacaacgtgattatggtcataaacttctctcggacatcgtcagatagcattaacccacagagaggaaaacgaatacacattccagtatgccaactagtagtagattatacagaggtttttcacttcttggcgctttttccacaaggcttcaacaaatatgaattaaaaatacagcattgtttgaaacacagtttaccccatcaacacaggaacccatatatataccacaaaatacatatgttacaaacatgaaatataaaatatatagctaccaccccatttgctctatatctatttaccaatatgactaaataattgccccataattaatccacttcacagctagctgtagctagcaaatgccacatcacaaagcacaggaacataaaactgttagctttaatacaagtgaatgttttaaattcatcacctggaacatttccatttttcaatcaagcaaattgtaatgctgaccatgctaatgtggttcatttggtcaagtgaaactgtttaaaggggatggaaatttgtgggcacaaaagttcagttacaactcaagcacgtgtgtgcaactatcgattaatgtgcaagctaactagcaccgtgggacgaatg

SEQ ID NO: 9860 - DNA, 1501 bp, Oryza sativa
gttctggcttcttcccatttataccgcattcgtcccacggtgctagttagcttgcacattaatcgatagttgcacacacgtgcttgagttgtaactgaacttttgtgcccacaaatttccatcccctttaaacagtttcacttgaccaaatgaaccacattagcatggtcagcattacaatttgcttgattgaaaaatggaaatgttccaggtgatgaatttaaaacattcacttgtattaaagctaacagttttatgttcctgtgctttgtgatgtggcatttgctagctacagctagctgtgaagtggattaattatggggcaattatttagtcatattggtaaatagatatagagcaaatggggtggtagctatatattttatatttcatgtttgtaacatatgtattttgtggtatatatatgggttcctgtgttgatggggtaaactgtgtttcaaacaatgctgtatttttaattcatatttgttgaagccttgtggaaaaagcgccaagaagtgaaaaacctctgtataatctactactagttggcatactggaatgtgtattcgttttcctctctgtgggttaatgctatctgacgatgtccgagagaagtttatgaccataatcacgttgttcatggaactgagttaactttaaactagatgcagatttgaaatgtatgtgatctccaccaaatgaaaaagctgtccatggttttgtggaacagttgactgctcattgttcataatatgtatatagataggtcaccttttttggcttctgagttgagatgttaaagcttttagaattttgatgtccttgatctagctttggagtgcctatttccttttactatttattggatgcatatggcctatttccttttactatttattgaatgcttatgtctgttccttttaattccttcactaaaattctctcctggtgctttcacatggtgtttcttccacttctatagtttatttcaagacatgaaaccttatgttgaaatagatagtgtatacgagtgagtaatgataatgatgttacttctgcagaacgctgaacatgaaagtcgtctgcgaaggtcagcacagtccaaagtgccatcagatcctaacatatggtttcagatgcgtgagaactatgaaaagataatccttgcgtgatcatgacttctctgaaaaacgtgagatagaatatcttctgtggcagttgcactacaaaagaattgaggaattccgagctcatattgtctctgctgggaagaacaatgccaatcctgatcggatcaagaggatcagatcttctgttagaagtttcctctcagaagcaactggtttctatcatgacttgatgctgaaaattcgggctacttatgggcttccgttgggctacttctctgagggtcctgatagttctgttgttcctgataaagatgggaagaaagtggttggggtgaaaaaaggcttgttgtcatgctatcgctgtttga

SEQ ID NO: 9861 - DNA, 1501 bp, Oryza sativa
acgtcatttaaataatattagccgttggatgtgaacaataagatacaatttaccattggatatatacaggtagaaggcaaatgagttttgatgggatgtgatggaatgggaaatgagagaggaactccctccttttcaatatctggtaggaagaggtaattgccttttcaatacctggtaggaagtggtaattgagagagaatttctactttactttacctaaacaaatcttagttattatttttcatatatctgaacttcctgtcaattttcacatctataccaaaaaaaaaataagactaaaaaaatcaaatcctcataataatctcgtcattacaattgtcttatctaaacttccaatcatcttgttctcttctctaagcctgtgttcttcccccattttcccaacccacctctctcgttttccgcgcgcacgcttttcaaactgctaaatggtgttatttataaaaaaaaattatatatgaaagttgtttaaaaaattatattaatccattttttaaaaaaatagttaatatttaattaatcatgcaataatacaaggttcgtttcgcgtgccggggaggaggggttcccaaccccttctcccgaacacagcctacactgcgttcggcagcagcaaatagtgagattgtttcgtttttcacgcacatgcttcccgaactactaaacattatattttttgcaaaaacattctatagggaagttgctttaaaaaatcatattaatccatttttgaaatttaaaaaaattaatactcaattaatcatgtactaatagctcacctcgttttgcgtatctttccaatattctctatccccttctcctcaaactcacccttttacagcctttacaatgctccaccgtggcattctgcctgggcggacatgtcgtcaattcgagagaattaggtgccaccattgcaactgggcccaccaaaaggaagaccgtgcgtccaactcaagcaacgtgttcttgggcggaggcgaagccgcgcgcggctaggagacgtggtcgcgggcgcgctgtggggcaagtgtcattggggaaagccgtgacgacctagagggggatggaacctagaccacgtcctggtgcggcttccttggggaaagtggcggcgctatacgtcgggaagtggcaccatctggataaacctggacgccgtcgccatcttcggtccacatctccaccaacgagtccgagctctccgccggctctctgcctccaaacagcaacaaattgacccgcaccactaggacaatagcccatggccatgtccggtcgtacacgaagccactccggagcttcatgtcggcgacgtcagacagctcatgggaggtgcgtgaggaggagaggaggcgatgcatcgacggaggaggagaagaggcgatgcgttcgtccagccagggcacacaaacgacaattgttgacatacagatccacgtcttacaaaaatataaaagattacaaatgcagcgga

SEQ ID NO: 9862 - DNA, 1242 bp, Oryza sativa
ctgtccatcatggacgtagttcttacagaaaatttaagtagttcttacagaaagtttaaatgcaacttgacgtagtagttcattacagacatagtttagatgcaacctgcaaattaaattgacaaacatttcattcaaacactcattgtctcattggcactttgtcgtcgtcatcatcatcaacatagtccatctcaatattaccatcaccatcttggccgacggcgccgacgaagaggtggctgttggctgacggcctgacgcgacgacgctgacgaacaggcggcggctgttggccgaggcgacgacaccgacgaagaggcggcggctgtggtgatgggacgacgccgacgaagggacgagacgacgaggcggcggcggcgaaggggcgaggcggcggcggcggctgtggcgaaggggcaagatggcggcggcggcagcggcgaaggggcgcggcggcggtgggcggtggcggcggccgccgtcatgcgtggccgcgtggggcggctgttgtgtgagtgtcgcctgttgcttagctagctagggtttgtgttgcctgttgcatgttgggttgggttgggctgatgggctctttgggctgattattctgaatggttgatgacaactccggatatccgggaaaaaatcccggatagtttccgaccgttttccgattccgtcggatatcacccttactgtattcgttttcgtatccgagaaaaaatatccgaattcgtttccgaatccgagagattccgaatagttccgaccgaatttttccgaatccgaaaattagtccggacggacggaaactatccgaaccagtttcatccctatgtatcactgtacctatattagtagcactgcattgtgttggactgcactagtattgcaatggatcgatctgaaccattgacatatatacttcatcaagtttatcctaaaataattgcttgtcctatgcatatatataatcttgcacatatatatactatgtgctgtgcatatgcttctgtagttgcatttatattctctaattttgcaatgttgtgatggcagtgatttttgtacatggacttttccgacgatgacgatgatctccttgctgaatggtgggagcaagaggtgttgtccgatgatgacaactactatattgcagctgctcttcttacggacatagagcataagagaaccaaaagaaagtgttgtggttcagtcccaggtcgtgagataattcatagg

SEQ ID NO: 9863 - DNA, 1501 bp, Oryza sativa
aaaaactagctccacccccatagtacaaatttctgtagcaactctactaacttcgctccaaaaaaaaaggagaatcggtactatttggcacagctccagctcgaagtaagttggagttgggaattggagctgtgccaaacggagccttaatgggcttgggtgatgtaaatggatagtactgtgcatgcccgtcctttccacatcatgatttggtaggtgtaatggacatccagtaatttttacctttgtatatttgggtatggataattcaactaaatggataattagggggtgtggctaatgggcgatcgatcgcttggagagatcgatccccatgccccccctgtacacacctctcctcccttcctcctccccttcttctcttcctactacactacaaatttaaaaaaaaataaaaaacaaagttggaaaaatttatgtatagaaatactatatataaaaaatatttgaattcaaatttaaatttgaagagggtaattaaacttttgacttataaactttgggtctataaactttaggtgtataaactttagatgtatagaaatactatatacaaaaaatatttgaattcaaattcaaatttgaatgggatatataatttttgatttataaactttgggtctgtaaactttagatgtgtaaacttgaggtgtacaaactttaggtgtataaatttactaaaataggaaagtaaagcggtgcctaaaaaggaaaccacgtggaggagaggggggagacccgatcgcccctggcgatcaatccccattagagcaactccagcagagaccctaaactcagcccctaatcagtttttgagggtttagagataaaaactagattcagcagggaccctactagagcccccaaagtgaggaggaccctagattctcctcccaagcccccagtcctgggggttccgagtacggcccccatcgactttttttcctggcgtgaaaaaaaatccgcttcgcgcgatctcgcctcgcccgcgcggcactacgaccagatctcctccgacggccgccatcgactcccccacccacctccgccaagatcgccccaaaaaaggtgaggattttttcctacctttgttgtcgtcgtcgtccacagggcctccgacctccgcttgcacgcctggcctccgcctgcatgccagccgttcaaacgctcggccatcgtccgcctggccacacgctgcttgcctgcacactgtgttagagtccggatattctttgtacatgtgataatgctccatatagctgtcggacagagtttgttgtgttagttagaagcgatagaacttatccatgtaatctaggttctcacaacaaactctgaaccgaagctatatacctcattgtaatcctggcacccattttgtggcaatcatcaacacgtaatctcctcaccgtaggagttcctcgcttccacatggtatcagagcctgttgctagattagattagttcgtctttgtgtttc

SEQ ID NO: 9864 - DNA, 1501 bp, Oryza sativa
gttgtgcatgatttcctctatgatcgtgggaaaaaatagtggattaacgtgaccttataagagtgttacacgtcagctattgcttgttaaataaaatgtactgttctagaactaggaaaaagatccaagataggaatatcgtttgtatttatactatattcaggtggacttatttgtggatttctttggcatcgatattgaaaatgatttagagatgtaatcttgcattttcatgtgatcttttttttttcagaacttcatgtgatcatagtcatacgtatttgtcctcctacacaatgttaatcacttttcattcttaggcgaaatacaaaagacttactccctcgttttctagatagttaacgtttaaaacaagtttcggccaattagtattaagtttataaaatttaattagtctatattatgggcataaaacattgatactaccaagtcttttgtttttaaactaagcatttcaaagactattgatagttaaagtttcaaaagtaagatccaaataggtaaagttaactataggacactcaaaatttgtgtttgttgatagaaatcataaaaacgtgtcacggctgaaagacactcttaaaaaactgataatttgctaaatgacactttcggctcaattgaaaagaaaagttcttaaaaaagacaaggatgcccccacggtcaaaagattttgaactgagactagggtgaagataaaatatcacgtatactagtgatgtacttggggtgatgctaaatttggagttgcataatttctaaattcgtactttaacgttatgtttgaagcatgtgattctaggggcattcttgtctttctcaagaatttatctttttaattgagtcgatattgttctctaacaaattactagtatttttagatgtctttcatttgtgaatgttttttcgatgtctatcagcaaattacacgaaatttagatgttttgtagtaaaatttgccatccaaatattgtccggcctaaccatcaaatattcacgaccaaatggtgtattaaattatctgaatacacttattatgggtgattatgctcttgatgaacttcatcacggtgtagttgaaataacggaactgaaaaatgaattctataaattatcaaaagggccatcaagaattattccagaggcagcccaatataacattgccggcccagataagtcagtggttcatctggaccaaaacccaacgagctagtctaacctcggtatgggccttcaactccaaggctgcagatcacccactggaccataactgggcccagcacacagaaacaaatcgaattcgcaccagtctgggccgcaaggcccggcccataaaccaatcggatcccacaacactgggccgagaagattggcccaacatgagctgcttccaacatatcctcggtccagccgtctcttctcccaagttctgaagtgctctctctctctctctctcggtgtttccccttcggccttctcg

SEQ ID NO: 9865 - DNA, 333 bp, Oryza sativa
ttcccatttgccaaacaccacctataagaatagagattctctaaagattcttcagggcagacagtgtagtgttacgttttctgaatggttgcctgccctgcccggaagaacatcaacacagacaggttgatgtttttccatggaacacaagcttaagacaatttgaaggcgccaatcgtaatattcatattgttgttccctcaaaaaaaatatttatatttttgcagactttccaggccttccatccaccaatcggcgatgttccctgtgttcgctgccgttgaataaaacaactcgtctgcctcgtcgtcatccagccatccacgttctaga

SEQ ID NO: 9866 - DNA, 1501 bp, Oryza sativa
gcggcgcctgcacccgcgcgcccgccaatggcagggcggccactcgtcgcgcggcgttgctacccgctcgccacggcacgcagcacatgccgtgcatgcaaaagggtgggttcttataaaaaaaaagagagagtaagaaacggagctgtagcgtcggtccaaaagtttgtttctcgagcagggagatcgaagagagaagcatttgccctgctgctgctccggctggccggtttaaattcgtgctgctgcattcggccgggtagctagccggcccgtggttgggctccagtaggacacgcgacatgcatgctccacgtgtgacgctttgcctgctgtttcgtgtaccgcagctgcatgtatgcgtaaagtttttctactactagtttattttttattgggcggacaggtcgtcacagtagagcatttaccgtcgagccgcgtactttttggaacagaagagttagatccacagtgttttacatatccagtcgatttatgtttgggtttgggaaatttcaccggtgtaaaaagcttctcacttcatcgggcaccgtcttctgtaaatttttttcgatatgaactttgataaattttgctcctcgtccaggcgaagaaactccggctttggctataggaaacggatggtgcatgcatctagtcccgacgagcgacgtaagcaagcgttcgcccggtcttgatgtgtgccacgtgctggagaccgtcgtcaccagcttttaattcatcggaaagatagcaaagcgtttgtcgtcgtggtttacattgcatcgtctggtttccctccgagattttgtatgtacatgcatgtatagtctcgtagaccatacatgaccagcaaaaccacgtgcggatatatcaacttttaggcggttttgtgctggctgaaacaatatgtacctcagctgagaagtaatctcgaaagcatgagtacaccaccggagtcggagtgtacatgcatgcatgcacggcaaggtatgaccaaaaagcagttttgacgcagattgatcattcgatctggtagtgaaaaacaaaaaaaaaaaaaggtaaagtggtgtgtcccggtgtccgcctatacgctaaacttaccgtggtgctagagtacaagcgagccggttggtggaggcgagcgcaaaagcgccacacggccttctgccaatgaggcctcacgccgtcacgcggggcacgccagccagccagtgaccgcggcggaacgcgccacgggggacgatgcgcccgaggggggcggacgccgcatgcagcgcaacgcgagtacgcgacctcgcctcacctcaccccaccatacgcctcgcgctgctggctggaatccaccggagcgcgcggcccgcgactccgctccgcctacgtgtcggccgcgtccccgcgcggtcgcccacgtaccccgccccgccctcccacgtgcccctcccccctgcgcgcatccgattggccgcccacgccttcttaaccccaccaccccaccact

SEQ ID NO: 9867 - DNA, 1501 bp, Oryza sativa
catggccataataagcgcggggtaggccaacccggtatggttgaactgaggcaggctctctctggctctcaacctctgaccaagacccaagctcttgctgagcattttaaacatttcttcgagacctctccttttttaaactgaaagacctgcgtttccggtcaaatttttaaacctggcttaatccccgaccaacccttgttctggctttggttgtcctcatgggtcacgattagttcccctacggccctactcatcacaaattcacaatcaagcccccaggccacgtcaactgtcctggcaaattcatgaattttgtagatattatctaaaaatgaattttgcataggcggacagctaattaaacagctaccctgtctcccatactattcgtcgtgtcgtgtcagggcgcaatcacaagtactactatatatcaattggtgaccagcctaacttcgtcaatttgtttgacataaataactatcattaatcagcctgcaaacaaacccgcataaattgcccctgtcctcacgtttctttggctgctacagtcctaatcttttctttttctttttatttatttctgtcgtcgcagcctgccccgttggactgggcggttcggccgatcagccaatgactcatcggcaatattaaccagataatagcacatgaccaataaagcatccgttaccattacaattccaaaaataagatttaaaatattttcttaaaagcgaaatgagcatatgtcaattggttaggttattacttgggatgaaaccaagtccagacctttttttttacatgaaaccaactcaaacttgatatgggtacccacccacatttacagataattattcttttagtgataagcgacatactcctcgatagcaagacacatgtgatcaatcttaaaatataccggaccagtatttcgaatatgttaatagggacatggttgtgtttttctaaaagaagttttcttaaaaatttctagttgttagatttaattgggtaattaatccatttaaatcaattaaatcaaataaattccaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccattggtaacttacatcaattactcttaattgattgttggttgatggttgtgtagtagaggatggttcatggctagttgatgacaattagttgctccattcctcttcctattccatgactcttactcttcatcttccattcctcttataaaatgggaatggatttgatctcccgcgagaagaagaagacacactttcatccattttcaaaagctgttgctgctacggtaatcccatcccga

SEQ ID NO: 9868 - DNA, 1501 bp, Oryza sativa
tcttgacctagcacaaccattcactgtgtagttccacccactttcctgatagatctataatcttataaaacttcttataatttaagacatagagaataataagattaaaataggaaaaatatgcagcggaaaatgtgggataacatatgctaatatgtgtatgcaatggaaaatctatgaatatacaaatataacaatcaaaattatgaataagcatggatgaagggagagagagaaaaaaaaagctgaaacacaagtgttcaagctctaaaaaaaatacaagtgttcattatttttttcttgttctctgtttgtcctctctgccactagtgacaggatcgacggggatgtggaacaacatagagcagccatggttgtgatggatgcggtgaaaaagaagactttgttaaatttgattgtaattttcctttttgatatggtattttctgttttctttaatataagttagaaataagatgtcccaggatatctttgttaaaaaaagttctcaaaaaagtgcaagtgttcattattttatagaaaatgagcatttgcatttcttagatactccctccgtcctaaaaaaagacaaaccctgggtttccgtgtccaactttgactatccgtcttatatgaaatttttttataattcgtattttccttgttgttatatgataaaacatgattaatattttatgcgtgacttatctttttaatattttcaaataagacggacattcaaacgttgggcacggaaaccagggtttatctttttttggaacggagagagtagatgtttgatagaatttacgttggaaagaatgacaaactttccaatctttattctttctgggaaaaaaaacttgctcttcaatttgtagcattgggaatcttttgtaggaatggtgattaaattttcttctttccttttaaaaaaccgtgtaaaattcgtacatttcaagatgaacccaacaatctacagacctacacaaacaggagtgtggattgagaaagaaaggtaggagtattccatgatcacagcatataggttattgatgtgctactttcgacatccacatccatcagtatacctgtatacgcagacatgcatccgacaagatcaatatcgcttattgattgtattcaggactcctattaaaaagccttgaaaccatgagcaagatcgatcgacaaatggcatacgaacaacttcagaattggcaccggtgcactttccacgctgtcccacaccgcccttctaggtagtacaatcagatggtgtgggcagctgcctcttccaatcagatggtgatgacaagcatcaaatgcgagtgtttctatgatcccccaagacagatgaacgtactttttagcgtttaatcgacagataaatacgcctcgatgcttttggatggtagtacaaagacgggtgattttaccgtgttccttcttggcgaatttaaccgtttttgatcgaaatatagctgaaaaggaacgaaga

SEQ ID NO: 9869 - DNA, 1501 bp, Oryza sativa
gatcatgctaagaatttaatgttaggttcaccataagcttgtcctagtggcatttgttttattgttgttatctccatgagaggatgaaaaacactcaccatcttctaaacactcactatcttcaatgtcaagaatatatatcattatcagatagagctccattcagctggttcctctaggtccttttgcgataagtctgtcattaactcattatcatcttcaccatagttagtcagtcctattatagtttccagaatatttgtcattaccggagatctatttgtattccatctcgatcgtatatttgacctaactagttctctattgatactgtggatgcatattgtatactcccttcattttaaattaatctacatatagtttttttaggttattcctaaatgatctatatttttgtgttaatttattaagtctattcattatttgtgcattggagtaaatggatattgatgcatgtatccatgcacacaagtatttataacccacatgcaatatcttaatttgctatgatgcatgcatccatgcacacaagtatttataacccacatgcaatatcttaatttgctattggctagcaaatagtggagatgatgcatgcattgagtttgttgctagagtaaatatagtatgagagaattattagcttttttttagtcttagtgtacctataaaatatgtaaatcaacttggaatggagggagtatttcacaatatccaatgaatcttcaagtaaaaaaaaatatatttgagtctatagctagtatgcatataagaagatcaaccatgtggagtcacatgtggggcagcgtttgggcctgagccccacacatggcaacaaatttcattgaaaaacactcaattttacatagtctttgaaaataaaattatatatacttcagcccaacgcttgataagatgctgcctcagtgcctccggcctccaataagagctatcatctatatttgaaatgtggcttactattaactatctatttttacgataacaatctatatacaccaatatttttaaatgatgggtttaagaaccgataagcagctcattaccaatgacgtattggctgtcaatgatagccaacaccatacgattaccgtattttgaactaaaaattagattaagcttgtttgtttgctacaatagtaaatatgggcaagattttggaaatgccaatattttgacaacatattacatatatgtctcatagaaaaaaaatggtagaaattaaaccaaacattaccatccaatattttgattcaaaattaaacaaaccagccctctactctttgcaggtaaccagccctctactctatttcttttcttcatccaattttttttttttgattggggcgtgccttccacatggttcatcaccgaaaattacggtgaaaacagttagtaacggagcttgagcatagaccacgtggcatggtcgactgctcagcatataatatagacatactat

SEQ ID NO: 9870 - DNA, 1501 bp, Oryza sativa
cgaccctgtcgaactgcggcagttcgacagcccagcctatcgaacgggggctgttcgacagccctgcctgtcgaacgggggctgttcgagtcctgtcgaacggcagccttccgatctcctcgccagtcgcgctatggccgttcgataggtgccctatcgaactgcacccgttcgacagagacctattttcgcgattttccccggttgaccactacttttgcgattttccataaaaataatattaattctcaaaaaaattcctccccccactcccactccctcggtttttcaccgcacgcgcacctgaaagaatcaaagaaacgcctccgatgcgctgcgccatgatcaaccaccgactttttgaccacgcgcgcgcgcgcgtgcaaagcgcccacctcctcaccgtgaacaccgtcccgtccccactcctcgccgcgctgccaaatgtacgtcgctgccacctgcccaacggtgaaaaaaaaaccccaccgaaacgctcccgctgcctccacgtctccacctcgcaccgcgccaaggcggcaacacccatgcccattactccgtactactacagcagtggcggtagcaacgcgagaggccgtggtccgtcacggagtggcgcgagagctgctgctgctgctacctggcacggggaggaacaaacaaacggaaagaaaggggattccttgcttccacagccaccaaaagtaaaaccacccggtgcatggtgttggtggccggccgcccatgccatggctccctgacctttccgcggctcaactctcccccatccatctcccacacacacatccactgacagctctgcacgagaaacgcttggccccaactgtcatcgcacgttggcgctgaactggtgcgcctaggtttggtaccaatcgggtaacccatcccagcctcctcgacacctgtatcgtcaaccccgggacgagacgcgagcgcaaaagcgactacaaagatacacaccgcaccaccaccaccacgcacgcaagcacgcctctcgtcgcgttccgtttcgttgcgacgccacgcgagccatgctgccgctgccgcgtcgtgtacgtgtgtatatacgccgcgccgggttgtagcgtagcgcagcgtgggagtactacactgcactgcatcgggcaaccaaccaaccacccaccacaacacaaccctcctctcctcatcatcactcgctcgctcgctctcgcgctttgcggcaactggcggtgtctcctagcccttgcctgccatggtgtcgctagccggctcccagatcccgtcgccggggcagagtccgtgcgcggcggcgcggtcgcagcgccgcggcgcggggtactccatgcggaccatccggtcggcgctgctgcagccggactcctgcccgggctcgccgcatgtggcggccgcgtacgacgcggcgggggcggactcggacatggagaacttgacggactccgtgattgatttccatctcagcgagctggcggccacc

SEQ ID NO: 9871 - DNA, 1501 bp, Oryza sativa
taattagggatacttctctgatacgcatggatacaaggtacgatctaatcctaacttctcacgggataccaatcctcgccgcgtccatcttttcctacccaacggcgtcgtcgttctggagcgaggcaaaggtagagccaccactttgcaatgcgggcctactactgctgccgcacgccgccgaggcgccgcatcgtcgccatgccccgtggagccgccgccgccgccgcatgccgcacccccctagcttagcgcacgcagcacacacctctgctcgcggttagggattgcttcattcaagtgaggtaagtatcgtgtattgacggttcagggcatcctggatctcgatttgttggggccggggaaggagaacatcagtttgtgatattggacaccgtaaagtaagactacaaagccataagtgactttttgaagatccagtactactgcatgaggtctggtcaaagctatacaattctaagctttaatgtatctatgtattgctctattagttatctttcaattattggcaatcaattctcccattttctttgaggagtgcattgtttctttttaatttattatgtatatatagacgtatccacgtatccatgtttttcgaaaatagccgtatcccggtatccccgtatcgcgtatccgtatccgtatccgtatcctcatatcggggtaacatagctgacctctctcgctctaagaaggaataagttcaccggatatctctcaacttaacagcgagattttttgaggttccttacctgtaaaaccagaaatgtttacccctaaacttattcaaatcgttcaaaggaggtcccatggcagtatcgactcaatttttgcccggttttactgacgtggcatcctagttaacaaaaaaataaaaataaataaatatgtgggacccacacgtaagtgaaaaaaatatggggtcgacaatcctaatcagcaatctcctttttctccctttttctcttctgtttcgttttttgggggagcggcagcgggtatactgcctcgggaccttttttaaaggggcaattttgtttctaaccctatttgatgtctaatattgattttacccctactttttaggattttcatttttaccctcacttttttgaactgaatgcttgttttgcccctactttggatggtgaagttaatagtgttaagtaattgacaaaatggcatttataccctctcatgtatgttcattaataatgtttttgtccccattttatacatgtagctttagaacttatttttgggagtatatttaaaattagatgacccgcattgactaatataacaatttggacaaattctgaatttgatggaattttgacaaaatttcagcattttgatagaacttaaacaacattttaacaacattttctaaaatgtaattatctgttcctttagatactagtcaatgtgcttcatttaattttaaatatactcacaaaaataaagttataaagct

SEQ ID NO: 9872 - DNA, 1501 bp, Oryza sativa
agcaattggctgaactcgacaacagacacatcgccgatcatcttgcgggcttcggcttcagtttggtcgagggttagcactataaaagcaagtagggggaatcacgattaaaagccaaacagggtaaaataacaaagcacaggagtgtatagcaaaagaacggccttactgttcatcccctcaggaagaaccaagttcggcaaaccgttagcctcttcgcattgctcgactgtgactttccatgactgggagaggggaaagatgcgaagcatacagaactcctccaccaagtcacggcagctaaggcgggagcaaaccttgcgcagcagaatgaaccgcgcctccatagcgccgtccacagcgatcttgggtttccggttcggcgcaatcgccctacgccggcaccggagggttttcgctgattcagaaccagcctcgaaggggatggtgtgatagaaccacctcgccatccaatggcggtcccacttcgacatggcagcgttcaccggccagagatcggaccgctcggggcgaacgttgaaattcacactcccgaacacggtcatcctcgtcccagctggggtaatcaccgtcttcgagttcacggtggcgaagaatatggcgccaaagagctcggcgctgggctgaaacccggaagtgcagcacgcccagtcaaagatggagatccgaactagcgccgacgggctcaactgcggaagctccacctggaagaggcgaaggatctccggcaacaacacgttgcacggaaaccgcagccccgcctcaaaaaacacggcgaacaccaccgtccgattgtcgacagacttcggcaccacggctttccccggggcgaaagcctgcccctcgaccaccgcccagagctgaccaacttcgccagctcgacgtcgtccacaagagagacccccaaaaaggcggtgctgtcgtcatcgactcggccgggatctggccctttcgccgaagcagggtttggcttgcgaggagccatggcgaatggcgtgtatgcggtggcgaagagagcgaatgggcgaaacacctgaggggtcgagagacgctgtggaataaagaaacggaggaagagggcgcaagcggtaaaaatggcgagtgtaccggtgaaaaggaaagaggggtggaatatatagcttatactacaccatgacatggaattaccaacagacatctgttggcaaaaataaacaatatctgtcggtaaaggtttttggcaaactatatgtcagcaatagtgcataatgagacatgttatatgtcagtaattctaaatatatttttggtcaaaatatctgtcagtaattgtaagagtacgagctaattatatgtcagcaaaacttagagggtgtatattagactattaataataccatattgcaagcccaaaaagcccatctagcctatcatatataaaccaaaccctaatttccccacaaccttatccttttcttccctacccagccgtcacgcactc

SEQ ID NO: 9873 - DNA, 1501 bp, Oryza sativa
cgggccgaacggaacagtgttgggccttcccttcgtgggctttttactgtgccgctcagacggtgggaatttactgtttcgcctacccttgcgacacgtggcgctttattattggtgggtaggcgaacggtcgcccgggtaacactacaccatgccccaagtttgcttactacatatctgtcaggaaaggacctatatgctgtcaaattatttgtcagcataacttttcccgacagatagggtctgtcaggccaagtgctgccggcaaaggtcttttccgacagataaatgtttgctgacatataactcgacagtcctacaaatgaattaccgacagacggaagttaccgacagatggtcctttaccgacagttaacggattactgacagatacgcagtttgcatatatcagtttttctaacatatattctgttagtgtgccctgcattgggttaaaaaaaatatagttcatggaatcaaatcctactgatctagaactgaatataccaccaacagttctcatgcatccacattccactagtactgaatataccaattccatttaattacaaatgccatgtacataggttagttgtacaaaaagagaaattctcctatacaatctacaaaatgagacaaaacgatggcaaatctacaacaggcaaggcatttcccttgtagagaaatgccactccaaaatatcttgtgaccgccatgataagttgagcatctaaaaacttgaatcagattatcagaaagacaaaagtattaagggtcagatatatagattataataatactccatttaatgataagtaatctatgcaacacctactatttcaatacagaattgaagatcagtgtcaaatgtgcaggataagtgtcaataacataactgatgtagttccatttaattcaatctgtagcatagcttcgatattctcacaatccaccaatattaaattaccagttccattttatgagaaatttatgttgaagcagtataattgcaatcgtaacagattcaattacaatttacaagcagcaaggattgcaatttatctcacaaactatgggaacaaactgattttagcttacatgatgtatgagcctttaagttagtgttgatcttctgttccttcaggtacccttctctgacacttcagcaagaagttgattgctcacccacaggtcgcaaatcatagctagtaaataaataaaaagaagataagtgctgaagtacagtttaattggctcccacttgcaaatgttaacttatattagaattgagatgtatgtaggtgacattttcataattaatgtagatggaaaatctgaagcccgaagactgtttcaaatttgtactacgacaactcactgcaaggacagctagccacctaatttgcagagatcaactaagggagttttatttaaaataattatactaggatggtacattctacaagtaaaaactcagtaaacacacaatgtacatgcatat

SEQ ID NO: 9874 - DNA, 1501 bp, Oryza sativa
tcgatttatctcatattttaaaaacaacttatatatataattcaccgttttagctgtttcagaaatgtagatgaattggaggcagtatatactattaaactcgctcttaaactaataaagtgtgtttttttaaaaaaaaaagtttctacacaaaattttctataagagtcatatcaagccatttttaaatttttttaagctaatacttaattaatcatacattaatccgtcgctctctttagcatgtgaaagccaagagcaggtacaatagaaagctataaacaggccctaagagcaagtttaatagtatagctaactactagctccaattcatctatagccaatttaatagcttattcatacaatagttacatactacactattaatacctgatcccacctgtcagacacatactgtgtcttagagtccatgctacaactggctacaaatctgtagcccgctgccattctctttccttatttatcttcttaaaatatgtttatagctagtttatagcacgctattttaacttctcgaagtgtagctccatgaggcagatgcatgggtgtttcgctgcgaatccgtaggaaaggcgtcgatggaccggcgcgttcgtactcgtgaacagtgtctcgtcgctggttcggctttacgtgtactcctattaagtactactcgggtcgctgtgttgtgcccgaaagcgtgctaagcagcgggcagacgtgtcgagctatggttggaagacttggaagactgaatttgttcgtgactttcgtaggcatagtaggattggatcagtgagtgaccgcaaacgagtattacatgtgcgtggagattgattttcgtctttcaaggtctttcgcgttttatagtggagtatataatctaaattagatatcaaaatatgtttaaaagtttagtaagatagattaatatataatataccatttcacaagtatgtaagttcatatccgatctatacaattataaaaaaacaataaatttgactgtagattacgtattctatttgatattaattttatttttgtttatgtatagtataagcttaatttgaatttttcaggtttgtgaagtgatataggagtgtcacattgatatattttatatttttttataactttttaggtgacacgtaaaaatgaggatcatctcctcgagtgacgaatagactttccctttttatccctttgcatgattctcattgttttgtatagagttatatatagggtggtttactcttatacttcttagtcgtaggggcgtatctaggggtagtccctgtgggcttgggactacacctgattttggcccacaaacacctatctcttcccccgccaatagccgctcgtgcccaactctttcccgtcgttgcctcccagctccttccctcgccgcccacgctaactgcaccgccctgccgtgcggttgtgcccagctactcccccagcgccgcacgtggagaagagaggaggggagagg

SEQ ID NO: 9875 - DNA, 1501 bp, Oryza sativa
ctcctcgagtgacgaatagactttccctttttatccctttgcatgattctcattgttttgtatagagttatatatagggtggtttactcttatacttcttagtcgtaggggcgtatctaggggtagtccctgtgggcttgggactacacctgattttggcccacaaacacctatctcttcccccgccaatagccgctcgtgcccaactctttcccgtcgttgcctcccagctccttccctcgccgcccacgctaactgcaccgccctgccgtgcggttgtgcccagctactcccccagcgccgcacgtggagaagagaggaggggagaggagagaggaagagaggtggagaggggaggggaagaagagactgacgtgcggggcccacgtgggccccacactaagtcaactgccacgtcggataaaaccggagacaaaaccgctgagggacctagttcgtactggttttctaagtcgggggatgcgttatatcggtttttttttattcaaggacgattttgtaactcgataacaagttgagggaccttcggtgtactttttccttaaaaaaaccaggcccaaacaatgaaacccaacagcccaagaggcaacttgggttgagtgcaggtggagccaccagggcgccagcgctactcccttcgaggcttcgggcttcgcttgtacaccacgccgccgccgacacccccgacaccgctttgttgtccgcgcaacgccgttgccaagtcttgtgggtctgccattcgtgactccgcgccgcaccgcaccgctcgcattcgtgggacgcctttccttgcgtcgcctcgcagcgagccagcgatggcggctggctattcgttctccagtctgtgcccctccggtactcctcctcttagaataatgtgggtcccatttacatttgtttttattttagtgccacgcaagcgccacttcgatgccatatggaagtaaacccgtcacgtaagtgtcacgtaggacaaaaccacctccgaaaccgacgagggaggtgatttactctggttttcagagaagaaggaggcgttatacccggttttccggttgagggatgttattcacacaagagcaagagatgagggaggtaaaatggacttattcctttgaaatttcagttctcttttcagcatcgagagtgggggagtctatccaaagtccaaacataataggaataagttcatctgaggtcccttaacttgtcaacaaatccgattttcgtctttcaaccgaaaaaccagatacaacgcgtccctcgactatcaaaaccggtgcagatgaggtccctcggcggttttgacggcggttttggctgacgtggcgcctacgtggctggtttgactcggtcttcatttcatgtggcattgacgtggcgcttacgtggcaattcgatccgaaaaaataataaaccccatgggccccacatgtcagcttcagccaaattaataaaaaatggtggggcccacgtgggt

SEQ ID NO: 9876 - DNA, 1501 bp, Oryza sativa
tacagtacaaatgtacaatacacatataaggactactccatccgtcccataatataagagattttgactttttgctacattgtttgatcactcgtcttattaaaaaaattgtgcaaatataaaaaataaaagttgtgtttaaagtactttggataataaagtaagacacaaataaaataaataataattctaaaattttttaaataagacaaattatcaaacagtgtaagaaaaagttaaaacccctttatattataggaagaatggagtaattaacatgacgtacgtatatatacagtacacatacgaagtggaggcctacactacacaccttttgaggcgccggtgctccttgtcggcggggctgcgtccgcggcggcgcccgctgctgctgctgccggcgacgccggcctgcgccgcgggcgacgacgacgacgtcccggccgccgtcgccgccgcgtcacctgcaacccgaacactacctctgcccgacgtcgacgtccccggcagcgccagcccgaactccggcaccctccctactatctcctcgtcgtcgctatccacccctgccaacgagatcgatcgctagatcaaaaaaatctgcataattaattaagatcgagacaacaagcgacagccatggcgatcgaattggtgatcatcgatcgatcaagaacacacacaaaaaaaaaaataaatcgagacatgacgatgagagatcgagcgtgtgcgtgccttccttgccgtcgtcggtgtttggggcggagtccgacgacctctcgctgctggaggcggccgccggcggcgagctcctccggtgatctcgttgcattctcttccctcgctgtccagcttatcccactcgctatcagtctatatgcagacactagctagctcgatcgctcgatcgatcgtctgggagctgagatagcaagcaagctagatagcagggaactagtaattgtgggcacgtttctctgtcccctggtgtgtctcactggattcttgttttgtttgattcgagtaagtaaggggggtatagcacagtgcctgtgcgtccggacatggccactctttttgtcgaaaacaggcatatggaacatgggacatttagcagcccaacccctgtcatttccatgtattacatacaagtgctcactacttttaccttttctttttcaagtgacaaagaagacgcacacacgcacatccacgaattcgcgaccttaacactcgctttaagagagaggtcgttgtcacatacaaattttgtatatatatactggttcaaatctactgctctaaattgcttttttttaatcatcaacgttggtaaaagatccaggggtctttcatgcaatgatgtaaacatatgtttttcttgaactggggatttttttttttgtgttaacaagtaatctactctcttgagtacgtatactacggccggtgtggtgcaaggtctgctctggcaaagctgaatatgcaaataataacatgt

SEQ ID NO: 9877 - DNA, 1041 bp, Oryza sativa
catagccacatgcttgaatgggccttgccaacatgacagaaatggcccatgggctcattcacgcacgcgcgcacggacatctaccacggcgcatcaagacgggctacgccattgatgacgtcagcgagcgatctcccttccgaccctacctaccggaggagaagcagcagcggtactactacggagtactttaatttccgggttttcggacagctcaaaagtagcgaagtacccgttaattaaacatggtccattctccccctaattctacagtattattatatatttgaattaggtgcacagtctggatcatagatgatttttataattataattgtgtttctgtgtgctaaaggaggggcagaaacagattgttttcttttttggatatatggagcggaaagggaggattcctggttatttcctctgtccagtaaaagagggtgcaagcaaatatggttttcttttgatacctagttgcaataatcagttagaaaaagaatcaactataggattccttcaacctaaaatatagatacttgtagcgcttggattttgttccaaaatacgtactcctcacgtcaaccaatcacaaccatctctcacttaaattcttaacatattttctcatcccaattaatcataaatatcgctcatttaatttcgaccatctccgtaagtcagtttgagataactgaaattgatggatggatagattatttgattttttttaatagctatttaagagtataaatgaatgagttaactcctacaaagtaaaaaaaagttattctagaaaagtattccaagaaaaaaaatataaagattttctttatgaaatgcatttagaagcttgggaaatgtacagatgaaaatccaaaatattgacttagaaaagaaagtggccttgatctctgcgaaaaactttagaaatacttgtattttgggatgtaacacaactttagaaagtggttttttctagtagttttggttttcctaggactaaatatccactcgattatgaaaattgtgaaaagtaaa

SEQ ID NO: 9878 - DNA, 1501 bp, Oryza sativa
attttgaatgcctatttaacaaatacctaattaaaagatgaataacataactataaattccttaatatcataccaataatgtcaatattacatttctcgacgatcagtcacatatcaacaaatattctctcagtactttaaaagtataaaaacaaacaaaatgaccacaaaaccccatcggtcaccgacccttctccgaacaggaaaagaaatcggcttgcaacagcaaaaaaaaaccgacagccagccagtcaccgactctcaccggtggcagcatcgccaccaagaaccctatcctccgctggccatccgatctcgatcggacggccagcagctgccgcgctccagcgccgttccgatccgacggccgagatcccacgcgatcccatcccaccctcacatataaccgcggccgcatcacggattaatagcgagtttaatcacaagaagaagaagagagagaaaaaaagagagagaagaaatcacaccgcattagcagcagcaaaagatttcctcgtttcgcttcacgaatttttgttgccctcgcccaatccacagcgcgaggagagggagttctcgcggcgatttctcgtcgcccctctcggccgctgccgggatcgcagctcgcaaggttcgtgaccccttccgattttgtgttcattttcttttctttttttctcttttttggtgttgttcctgtgcgggaattggggaggaaaaggggaggggagaaggggtggagccgcggtgaaattttggggggtggtgattgatatgctctactgtttgctttggtcccgattgaccagttcaaatgttcttgctttggtcggtgctcgggtttgatttgacgcttggtttagatcgtcttggtgcgcgtggtctggtatcgtcgtggcgctgttcttgcgcctcttgtgttgtgattgctgttgtttttctttttggggggaatcgcttggttggagttcgtagtttgttagagttgctgttttgggggtggtgtatttctcttatttttgtttggtttgttcgatttccgggcgggatagttgttctgattttgctgcaatctgccgcaaaatcgctgttgctgaggtgatggatggtccgtgcggttatttcgatcggcctatgtgatccattgcgagttttgttcttgtaatagatcgatagacccgtatgctccggatgtaatgcttccgatttccacaacctaaattgcgttaagtagtgatctatatagggcaatagtcaaaacaatttattgattcacgaatccttgttcatagcatatttcagatttcgcattgcaatctgttgtgattttagcaatgttataaactaggatacgtttttttctgtgtaatctgcattagaccttgtagaagttgaaaaaaaaattgtattgtgattcatcccgtaatccactttgctagattattgattattactgttctttttttttgtttgtgccagttttggaaaggaaacaggttga

SEQ ID NO: 9879 - DNA, 1501 bp, Oryza sativa
gcaagcagacgaccaccaacctgctcacctgggccaccgtgctgctcgccatgcacccggactggcaggaccgcgcccgccgcgaggtcctcgccgtctgcggcgatgccgccggcgagctccccaccaaggaccacctccccaagctcaagacggtacgcacaccaaaccatatccatggcccagtgggggtattcccgtaattccacgccgacaaaagtctcaccttgttggttctcgctgtcatcttcttccagctcgggatgatcctcaacgagacgctgcgcctgtacccgccggcggtggccaccatccgccgcgccaagttcgacgtcaccctcggcggcggtggcgacggcgacgccggaggcatccatatcccgcgcgacacggagctgctcgtcccgatcatggcgatccaccacgacgcccggttgtgggggcccgacgcggcccagttcaacccggcgaggttcgccagcggcgcggcgcgcgcggcgaagcacccgctcgccttcatcccgttcgggctgggctcccgcatgtgcatcggccagagcctcgccatcctcgaggccaagctcaccatggccgtcctcctccagcgcttcgacctcgcgctctcgcccacctacgtgcacgcccccaccgtgctgatgctgctccacccgcagtacggcgcgccgttgatcttccggccgcgccaatctcagccgtccaattagctactattactaggtaggagtactagtattgctagctaggaaaagacaggaaagcccctgtccgttgtgtgcatagtgacacaggaaaaggccaagagacaactaacaaaaggctctgcccgtggcaggggcagggccggattccgaaaatgccctcgctaacagactagtggtacgatcagagcacaacttttagggatttgatgggtcagaaactctcagaagagaagaagagagacagtagtagggtagtagcagtagccccacacatccactgctcggttgcttccatttgttctcttctccttcgcgtggattctggtgtatgtatcgatcaatgcatgtacctgtatgtgtgtgttgtgtacaggggtgtgattattttgattcgggacacccggcacttcacagcaaaggagaattccatttggaaaaaacatacaaaaaagaaaacatagagagagagaggaagggagagatcgagatttgattaattggttgtacacggtattccagccttgtgctcctctcctttctagcgtctggtcggtgtggttgttgtgttgacaatctattcattcatcgatcgagtagaatctgtaaccgaagcctgctggagtagctcctcttcacatggtactggtactagtagcagcagcagctgcagcatatcttattgaccaatgaggttttgatttcatcaatagctagaaagcccaaacatttagggaaatgtttgtgctttagggactctcgttagatttttgactttccga

SEQ ID NO: 9880 - DNA, 1501 bp, Oryza sativa
ttcgatcgggtgttttcaatcaacacacaacttcaaagagttaataattattattagcaggtgaagaatcaatcattgggcatcttgaagaaaccacatcatatcaggacatgtaggtaggaggaagacatcccaaattaagcggcctgctcaaaccgtgttctgacctgcgtaaacaggcagggacaagctgggtcatactaagttttgtggtctggtctgaactaccctaccacattaacatccaaaacaatttccaatatatatatattcaagcactaaacagtggaacgtgtttctcatggttacagtgaaaaccgtattaacaccattcctaattgtagctgattagtctctctttgtatagctctggtgcagtagttttattttttacttactaaggaagcagctgctttttcaatagaaattgagagacgagaggtgctgaccttcatttatttagcagatgatagaagatgtatccgcgggtgtgtgcgaatagcgatgtatgtattctttcacataataaaaaaaaaacctcatccggtttttaatatttgaagatgttgactgttggcattaaaaaatatctatttatcttattaaaaaattatgtaatatgcaaaagtatagatcttattaaaataaatcacaacaaaaataaataataatcacgtaattttttcaatataatgaatagtcaataaacaatgttaaacattaaaaaccagataaaccagtttaaattttagaatataattttttttgcactaaatactataaagctgacataagtacatagtagacacatataataagtactccctccgtcccaaaataagtgcagccatgagttttttatccaactttaatcgttcgtcttatttaaatttttcttttgaaaacactaaaaaatataatcacatataaaatgttatttatattttataatctaatagcaataaaaaatattattataaaaaaattaaataaaacagatgatcaaagttgaaaaaaaaacttatgcctgcgtttatttgggtttatttggggctgagagagtacatcacaaactttcgatcactcaagagtaagcagcacacgcaagcaaaagccttgccttcactcccctcctctcatttttcccaactgcaacgaatgaaaatgttgttctacaaaaaagagaatgaaaatgccacgtcagcacccccaagctcggtcagctgaactgaaggcggttttctcacacttcacctacctcgttgacgcctcccccctttctctctccatcccatctgaatttaccaagcagccaccaccaacagatcatcgtgctgggccggtgggccccacctccgccgccccgcttcgctatataacccccgcctcctcccgccatcctcgccttcccatttcgaatccaaacccccaacccaaccgccgccaccactcaccggcgcaaccaccggcggcgacctgatctctctgcgtttgtgtgctc

SEQ ID NO: 9881 - DNA, 1501 bp, Oryza sativa
tagccaaatggtttgtagtgcgagttgcaaaatacctatttatagctatctcatggaagtgtctgtgaactaaaggagtagtatatcatattatcattagtaaattaagtgcacgaacttaaaaggaaagtatgatgaggaaataaaacatgagttatgcacttatgctgtcatataatgttttggtatctgattaggatggtaccatgaggtttgtggcccatgcagaatgtttgattcctttgtgagctgaatgcgcagcgttgtccttgctgttcacactgcacacaattgtcaggaatgcctccctcggaccaacttacagttgtctcagcaaagttgaggattctttctgccagttgcttgaacgttggaccatcagcggtgactgcaccggatatcggaacaatgcctttagagacagccttgcagtccaatggagtgaataatgtttcataagcatccccaaatatgagaagtggcttgggtcactgaggcaggagattgggcccacgacagcatgatcagcaatattcccatcatagtcattggtcggagacatacttggtgtgagcacttttgaacagcatactattttcccaggctgggcattgtataatgaacagcgactggaatgataatctggttccggtagattgtcgatgatgagcttctgaagcgggtatgaagacaatgagtctacgagcgggatgatctggaaaacagctttcttgtaatctatggcagttaccttgcatggccccagaaatgggtgatgcaggatggtgtctggaccagagcatgctagcctcgcgcatgaagcactgcatgatgatgatgaagatgagttgctggattcaagctggtgagggaaccggatctctggtccactgtcactgcaccaggacggtggacaatttctggcgaagtcttcctcctcccaagctgaacccatggccgggtaggcgccatggctgatgacggagaggaggagtgttgttgcaatgactttactcatctttgtgcactgaaacggccagagatggacagggaattaaggtggaaacatatgcaattaatcaatcaatatactgcaagtgtgtgtatctaataatcaaccctagcttatttataagcttcgttccaaaaaaaaaagcttatttacaagggggctggttaaagtatctcatcgttaatgaagggggtccagggtgatatatatagcaggccaccacgtaaaagtccaaatttgactaggcttagtctaactaggtgttgctacgtaagtgcaacatccttctgtgttgttaccctgtccctttatatgaatcttatgctgatatgcagtccatgtcaacataacaatttaaggttttctttgacgaactgacttcggtcccttactatgaatcttatgcataggaccaaactgtatcagccaaaaaaaaactattcttatatatgtaggtgcagcaagctgctagtctactataaccagcct

SEQ ID NO: 9882 - DNA, 1501 bp, Oryza sativa
ctttccagatcaactgaagaagacttcttgctgatcttcctgaactgtttttgtgccttcttgataaggcagatataagactggatcttcacttgcacagctgcattatctcctctcttcataatcagctgcatgtcttgaatgctttgcttaaggttggaaaagctctcctgcatggcattgcagaaatcgagcaagatgagagagcgctcaagctcttgctccactgctttcctctgcagtggctggcaaattgcaacatggctgcttggcaggcacatgatctcattgatgcagctgtagatattcccgatcctcttcaagccattactcattgtctcaatggtcgaagacgatgaagaaacaattgccttcaggttctggagctgcccttcgatatcgatttcgttggagcgagggctcgatggcacacttgcagatctcaggtggaatgccatgtcttcagaggaagctgtaatactttttttttcctcctctctctgaagttggaagaggagaaggtatgctacaatggtgtcgacacggttagctttatctctatatataacggaagaagaagaagaagaagcagaggcaatggcatctctactctgtagacagcattggaatctcaattacatttaagtaatgtgctgctgcaacggatgccacccatctcctcgacaagctgatgaattttatgtttgttaatcaagtgtgtgtaacagtgcaagtggcatgtctagctcatcttgtgtctatcatgtcctggctattggcagcaaactcattgcacgagcatgtagtttaaatttagatccagatccagatcatgggattgatgagcttgccacgaaagagaacaagagctgttcctttgctcggccaagcaacagttgacttcacctccatgatgtgttcttatctggtacgttcttcgtgcagcatcacatcgctggcctgccttctgcactcacagcattcagcatctgctgcaatctcaagatgattccacgtgctgtccaaatttctgatgcattaggcctaactgagtcacattgtcatgttccagttattggcagcaggaatcagcatggcagcttattctattactgagccttgtcatacgtgtatgctccagcacccatttaatggagattgctaatcaactagtattggtgccatgtgtgctattgcatctgattgctgagcaatttatcaacaactatttagttatatggggagcaaaggatcttgtgcctgttcctgtctcatgtgaatactggtgacatgaccatcccatggctttacgaaggcaaggtgggaactgtgtacttattactaattgcatatattatgacagccaaaaatggtatgtgtcttctgactaatttattatttttttgcttgaacatgcttcaggtgaagcgctccaaatgtccggtgattgtttgagagcagtatgcgtcaagtgaagggggaaattagaggcaaaagagtg

SEQ ID NO: 9883 - DNA, 1501 bp, Oryza sativa
atggggagaggcgggcgccggccactgctcccgccgtcgcgggcggtcgcgccgtccacctcctctccccatctcccgcttcttccccgccgctctgccgtcggccgccatctgcccgcatgcgcgtgagaactgacggtctgtttggttttgaggcagtttttaggagggaccgggagtttagagggatgaggctattaactgttttgtttggttgagggacatgagaaatttggtaggatggagatgggggattgaggaatgaactccctccttttcaatacctgggtaggggtaggtaattgggagggaattcctcctttacttcgcctaaacaaatctcagccatccgttttcattaatgatttaatctccaactaaactccttatcaatttccaccacctctaccaaacaagagactgggatgaaaaatcaaattcacatcttaatctcaccatcaattccctcgtgtaaactcccaatccccttccctcaagttgccaaacaagccatgagaagagaagagaaaggaaaagaaaaaagagatgtggggctcacatcattttctccccctgacatgtgggcccccacatatttattttattatttttgctgactaggatgccacgtcatcaaaaccagccatctatactgtcttgggacccaaattagacggttttgtatagtttaggggtgaagatttctggttttccggttaagggacctcaaaaaatctcgctgttaagttgagggatctccagtgaacttatttctaacgagattgtgaggagcctgttgggctcggaagatcatgaaggatgcggcccaggaagctcgtcttcatgggccacgggaattagacggacgggcccaacctgtgataaagcacactagttctccctacgccttccgccgccgcccagccccacccatccggccgccgtcctccggccatcccacattcccacgccccgcgcgccgagtttcggttaatcttgctgcggcagtctgccattttgcgagtcgcctccgctcattccgcagatggaaattgcttcggttattcctcaatggcgccgcaggcggcagctagcgaccggtggaatctctaacaagcccgataccacgtttaatcatattctctaatcccctcccgcattctacactctccgagacctcctgcggatgctcgtgccttgctaaatggtaaccccttttccctttgtcgtgctgctttttttttttctttttctgttctaaattatgcaataccaggagtgaacatgagatgagataatcagttgcctgcgctgcaggatcctttgtggggatgggatgggtaagaacaaggacagttagtagattggcagtgtggggatgagatgggtacgaaaaatgtgtgctcagcgaggaggattagtgcactggtagcaatgacagaataaggtaatcaagttatcatcttttaactatcacactgcaaatcaaatccacgggata

SEQ ID NO: 9884 - DNA, 1501 bp, Oryza sativa
ggactattcatacaacaaataaattttgtttataggtttattttttaaaatgtaccataggcccttccaaatgatattcatgtaatggaactgtgcgaaactcgttgcaaaataaaaattttttgtttgcatttatattatattgtattattgtaaagtaattaacaacgcaatgtcttcattttagacaaattttactacatgacatcattactttgtgaaattagctatataacatcatagaagtcagatttcgaggtagacactcttaaaagtttgatatttatagtgctatatattttcaccgatattaactttattcaattttacccatttaattttagtttatttttccaaaatcaacgaaagagtataaaactgacaccgctacaaagatagaaaaatgctcgagagataatggttttattttttttcaccaatgccaactttattcagtttttactttttgtttcctgcaaaaatcacatttttttccatttcgatacacttactcaattaaaatgaaagaaaacaaaagcgcctaacaacgccgaggaagtcaaacccaaatgctgatacacggccaaaaaaaaccggtggggagctcccaagcagagacaatcaagtgcgacacggccgaaacgacacccatcatcagcctcgccccctgacttggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacacggactaaagttaagtctctggatctaaacaccaccaatcgcgagtcgcccaccccaccccgtctcccccctccccgaatgctcctccaccaaaccaccacctcctccaccgacggcacggcaggcgacccagcaacaacaacgacaccaccgcattcccccagcgaaaagaccacaccacccctcctccccagcccgcgcccaggaagaacctcgggggtagattcgtcattgcacgaaaaccccacaatccaaacccacagcgccaagtcccccaaccggttagtcgcgctcgcacccgctcccccgaactcatccatcctcttcctccttccgcccgaagtctccacgctcccgtgtcccatttaaaaccttcttcttcttcttcgcttccttcgtctcgactccagttggggaggcattcttttctttttctttttttttcactctcgcgtccaatccctgaatccgctggcccgcgtcgaaacctaggggcgcggtggcggtatagccgacgttcagatccaaa

SEQ ID NO: 9885 - DNA, 1501 bp, Oryza sativa
tcaatttcaagacttagctcttgccaattatcagtctttgcattttcaataatgaatttgagaaatatggatgatatatatgcagcattgatagccttcctatacgccgcgtgagaagactctgccatgcactcttgcaagcaccaaaccaaatggatcaaaatctttgcgagatgctttgtgtggtagttgttctgggctgcataaacacatagcacaggctagtaagcacgagacgattacaaatcaaaacatgatactacaagtaacaatttaccacctatgtcttgatattacagtaagctgaacttaaaaaagaattttactaacacgacagttcatattgttgactacagccatgtcagcaaagtcatatatcacaggtgagcaaccacaaatgcagctcgcaatccacataaatcaattatccaaatcctcccgactacaccaacacaggaaaaatgccgtgaaaaccatgtgaatctagccatatcgcctcgaagcaccgcattaaagtcttaaacccacacccgcgcgcgcacagaaaccacgtgattcacattgcccctcggatcaaagcccgcagagagggggcaaaaaaaaaaaccgccactaaccaagagccaaaaaaaaagaaaagaaaaaaaagaaagagaagaagaaaccgacgcgcgatcagagcaaccgcttagggcagcgcggatctcgagccggggcggaggggggcaacaactcaccgaacgcgtgacacgcctgcaggacgcggtcccgcggccactgctgcgtgaggggcagctcgagcagctgcctccagaactcggaggagatcgggtacgccttcccgccgaccagcgccgcgaacatctgctccgccgccccaggcgacgccgcggcccccgccaccgcgcccagcctcggcgtcgacggcgccgcccccatttggatctgaacgtcggctataccgccaccgcgcccctaggtttcgacgcgggccagcggattcagggattggacgcgagagtgaaaaaaaaagaaaaagaaaagaatgcctccccaactggagtcgagacgaaggaagcgaagaagaagaagaaggttttaaatgggacacgggagcgtggagacttcgggcggaaggaggaagaggatggatgagttcgggggagcgggtgcgagcgcgactaaccggttgggggacttggcgctgtgggtttggattgtggggttttcgtgcaatgacgaatctacccccgaggttcttcctgggcgcgggctggggaggaggggtggtgtggtcttttcgctgggggaatgcggtggtgtcgttgttgttgctgggtcgcctgccgtgccgtcggtggaggaggtggtggtttggtggaggagcattcggggaggggggagacggggtggggtgggcgactcgcgattggtggtgtttagatccagagacttaactttagtccgtgtctttagacactaatttagagtattaaatata

SEQ ID NO: 9886 - DNA, 1501 bp, Oryza sativa
ttcgggcggaaggaggaagaggatggatgagttcgggggagcgggtgcgagcgcgactaaccggttgggggacttggcgctgtgggtttggattgtggggttttcgtgcaatgacgaatctacccccgaggttcttcctgggcgcgggctggggaggaggggtggtgtggtcttttcgctgggggaatgcggtggtgtcgttgttgttgctgggtcgcctgccgtgccgtcggtggaggaggtggtggtttggtggaggagcattcggggaggggggagacggggtggggtgggcgactcgcgattggtggtgtttagatccagagacttaactttagtccgtgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggccaagtcagggggcgaggctgatgatgggtgtcgtttcggccgtgtcgcacttgattgtctctgcttgggagctccccaccggttttttttggccgtgtatcagcatttgggtttgacttcctcggcgttgttaggcgcttttgttttctttcattttaattgagtaagtgtatcgaaatggaaaaaaatgtgatttttgcaggaaacaaaaagtaaaaactgaataaagttggcattggtgaaaaaaaataaaaccattatctctcgagcatttttctatctttgtagcggtgtcagttttatactctttcgttgattttggaaaaataaactaaaattaaatgggtaaaattgaataaagttaatatcggtgaaaatatatagcactataaatatcaaacttttaagagtgtctacctcgaaatctgacttctatgatgttatatagctaatttcacaaagtaatgatgtcatgtagtaaaatttgtctaaaatgaagacattgcgttgttaattactttacaataatacaatataatataaatgcaaacaaaaaatttttattttgcaacgagtttcgcacagttccattacatgaatatcatttggaagggcctatggtacattttaaaaaataaacctataaacaaaatttatttgttgtatgaatagtccacttcaacaactatgaacttttgttcaccatccgtcctatgtgacatctatatcattttcatattcgatctttcatgttgatggtggcatgaaatatgttttgtccttttttggctctatgcagtcatctgttgacaaattggcttttttttaaaggtatatatattctatatccgcccttattttg

SEQ ID NO: 9887 - DNA, 443 bp, Oryza sativa
gtcgcgctcgcctcgccttcccgcgctcgcttcctccgccattgctgagaggagagagagtgagagagagagataggagagagagtgtgtgtgacatgtgggtcccacttttttttataaataaaatgctgaccggactgccatgtgtacgccacatagtctaaaaccaccgtggattgggtcgaggggggtaatttgtccggtttgcatagttgggggtgaagaatgtctggttttgtggttcagggggtaattcggacgaccgcgatagttcggggggaggtaattcgtactttttcctttcggaaatgctggctaccgggcgaccggcgggggtggagcagatcgggcactcccctgcgcgccccgccccccacgcgcgtgatgcaggcacctggccccaccacattctctgccccccataccatgtgtctccaccaagg

SEQ ID NO: 9888 - DNA, 1501 bp, Oryza sativa
aatcaaaccgctacatctcgccccaaccattgaactaccctaaaaattgaagcagcataatagaagggggaaacgaaaccaccctccacgtgcacgaataaatcgaccgagcgcacggaacaggagcgaacagcgtgggccgggaggagagacggatcaacggcttgcctggagctgctgatcttcggagcggagcgggtcgagggagacgatgaccttggcgacgacggggttagggttcgcgttggagttggagttggcgccagcggcggcgtccgaggaggaggaggaggaggcggcggcggtggcggcctcctgccaggcgcgggagacgacggtcgggcacttcatgagccacacggagcggtcggcccgggccgtctccagattcttcgcctcctccgccatcgccgtggggatggaggcaggaaactcagctgagtgaaatccttccggttcgctggttgtgtgggtcgatgggggtggttcggcgaggaggacgagaaggcggagaaattgtgagattggagcaaattgatcggctaaaacctggatcctggatcattaataagggtgatggggaattggggattgagacggagacggtagcgcaagcgcaagcatctgcttgggccgcgatatgtcggttaaccgaaagtctattgtaggccgtaactaatatgtgggctggtctcttcgaacatgttggcaccaccgcggtaccggacccaaaactcctcctctattatttcggaaaggaaaaggtacgtgccggtgacatgggaccggggatatcttgactagaggtttggggcagccgcggtcacccacgtggcctgaccccctcgggggggtcgggcccgagggtgatgaggccgccccaccctctatctccccgaggggtcgggccgctcccgtttcgaccccccgagggctggggcgccccgaccccctgagggtttggcgccacgtgtgtgggttaggtgagcacagcggcgctcacctaaccgcgtttattgtgggttggacgagcgcctcacgccgcatttaatgcagcatagcgcatgcttatccggtccgtgatcggtcgcagtgtgtgaccggtcacagaccggtcagatcgcgggttaggtggcaacaggcggcctgacacacgcctcgccccgtcccgtcggaatgatgagagcctccagacactcgtccctagccggagccggcgtgggaactcctggagttggcacgtcagccccggccagatacattccaggcttcatcgcaaccattgcaaggaggtcattgtatgaagaagggcatacgtgtagcatgctaaactgacgcgtggtggacaagaatgaccggtctgtgactggtctgacgccggtcgcgtcatcagcaaacaaccgtgcttccacgttgcacctgcttccggcggagtggaggttggtatgacccatcccatcggagggtcattcggacagcagccattgtaaatctccgccca

SEQ ID NO: 9889 - DNA, 1501 bp, Oryza sativa
ccgtcctggagtctcagctcttcaacctgcgggtggccttggcgagcgcgcaccccgacacgccgccgcagcacttcgtcgtgctgcagccggcgcactccgcggcgtccacgctgaaccaggtggtggtgaactacgacgacctcccgcacgccgtggatttcatggacgcggagcccgccgcgctgaggggactagagtctctccagctctcgcagccactgcagcgggaggaagacgagggccaccgagacatgaacctcttctcggacagtgtaggacaacggcagctgtaaaattacctgtgcaattgcatgattaggtgtctctgtggctagtacattcactcttgagttggaccacattgtgtgatttgagaattgcgtgggatcatcaatcatgaatatccgtattctaatttgatcaattccttcacgcgaatttcatgttcgtgaaaattatacattttatatgcgcctttttaccctgtgaattatgaaaaaactatgaatggtagcgatccaaactaggagccaaaaatgaaataatccagtgttcacaaaaaccgatccgttctcatcaaaaccgcactgtgttttgtgaaagtgaaactattggttgttgatttctaaaaaccaatcaatttttgctggttttcgcacgatgttgacttaaagtcagtccttttaactgattttcggtatgtttagcataaactcgtgggaaatatcagaagatgaagatagagaggatgactttcatggagagaagcatcaaatgtctatcctatgatcctatcctatcctatctacacaaatcttctcatttacacaccaattaacaaattttattaaaaaaatatagaaaaaaattgtacaaacacttctaatagtattatacttatgtgtaaagtcataatctcaaattcattatattttagccaaaaaaggataaaaaaattataacagttttgagagtataaatatgtgagattctgtcttttttgttgctccctgtatataatggatttcaagatgagacttcacacataaatacaatactactaaaagtatatatataattttttttctagattttctagtgaaatttagtagttgatgtgcataatatgggggtgtttgggagagacacacaaaaccataaatccctagaagagggacttatatttttatatttttgagagaacacctcctatgtatacgagaaaacttatgtgcataatataggttcctctgcagaagctacaactaaatgcagaggattcggctcccacactatcaaagtactggaagttttaatagatgagatctcgtgggctcagtccaagtccagtgcaggggaccaaagaaaggcactactccgtcgtgaaggctaaaaagggagggggatcgaggcgagaggaacgccaccgaacccaaaccccatccaatcaaaaattcgtacgggagagctctcgatttgatcgccgcgaccgcgagga

SEQ ID NO: 9890 - DNA, 1501 bp, Oryza sativa
  unsure (1)..(1501): unsure at all n locations
agccgagaagggaggaggccggcgagggggcggtgaggccgggagagtcgtcggagtcatccccccccgcccccccctcntggtgtggcgtcttactacccggnggagtagcaccagcccaaccatcgtcgtttctgcgacgaccacctctggcccgacgacgaccgctgtgccctgctactcttccccgacacctgctcgctgggatctggctggaggcagcggccgcgggggagtccggcctcctcatctctcagcctccctacgcccctcgcgttcgagctcgttcggggagaggagcgccgcgcggcgcggcgcgacggcgggggagaggagagaagcaccgcccgcctcctcctctcggcgcgctcgccgcatcccctccgcgggcgctcgccggcatcccagcctgtctcgctagcctcccctccactgtcccctcctctcgccacccccaagctccgtcctacgccgtcccctccgccccctcgagctccgccgtccccttcgtcgccccgtgctctacccgccgtcgtcctcgaggtgagggagggagaagagagagaattttggagagagatagagaggtgtggtgtaaaagagagggtgagagactgacatgtggggcccactaatttaaaaagaaaataattgctgactggactgccacgtagaccaaaacagcttgcgaagctgctcggggggggggggggtttcgtccggtatcgatagttgagggtgaaaaatgactggtttccaggtttagggggtaattcgtactcacccaatactttcggggggtaattcgtactttttccttaaaaaatcatattgttctatttttgaaaaaaaattagctaatacttaattaatcacgtgctaatggattgctccgttttccgtgtggaggagtttggttcccaaccatcccaaacaaacgcagccttagtcttaaaacaaaactattttaaactcgtgtgagaatattctctcgttatttgaatatcattcaaatggatatgaaattttttaaaaaaatattaacaagatatattaatatgtgataaattattccacaaatatgcaaggtcaaatttaaattttacaagttgcaacaaaaaaaacattaagtttttacgtgaatttgtatagttgtttgtttggattcgtgtagaaaaaaatataatattccaaggacggatattctccgtagtaattaataatccccgtcctagaataaaccaacatgatatgacatatactagtagattcgttgtgtttacacagtacgacgtttgcttactttggaacagaggaagtatgtctcaccttctatctcagtgtaacatctgcttagggggtgtttcgatcccaccccaaaattttacaccatgtcacatcgaatatttaacacatgcatgaaatattaaatataggctaaaaaaaactaattgcacagattacgactaatttacgagacggatcttttaagcctaattac

SEQ ID NO: 9891 - DNA, 1501 bp, Oryza sativa
ggaggcgccatcgctccgcctcatggcaggtcgctgcggctccgctcgaggccggttcgccaccatgcatcggggttgcccaaccgcggctcctcctaggcaatcttttcgtggcgcccggctcacacctctctctttcccatcttgctcccttccggccgcggccactgcccacctcaccgttgccgctgcggccatggcctgcagtgccacccatgacacggagcggggacgaggagcggtggctctccccatctcctccgacgcctcctgttgagccatctccatctctaccaccggaattgtcccacctgctagcgccccactgtgcaatgtgcaggaggtgggcaccatcgcagcgcccggctcgctcctcccctgccgccaccgcccacctccccaactgctgtactgtggagaaaacatggggtagagagaagggaaggatggtaagatatgtaggccccatatgtcagtaggtcccacaatattttttcgtgaatgacaaatgtgttccacatattttttttattctaataccacgtaagcaccacgttggacgaataccaggtcaacaccaccacgtatgagccacgtcagtgaaaccgccgaaagagttaaaattacaccgattttaatagttagggtcgagataaccggtattacagtttaaggatacgaatcagattcggccactggttaggggagtcaaaagtggacttactgcagtagaaaaggagaggcccagttaaccgggccgaaattgccacctaaagtttgggcctaactcagcccactcaatacggagtaacttaccgactacgaatcaaatttttttcatttttagattttttaaaaaatatttacagaaataatctatcagccaaaaaaaattataaaaatagaccctgccgcccaccacttgggcggcaagctgacgtggcaaatgggggagggacgggcgatgacggagggagggttttttttgcaggaaaacccttgccgccctctgttggagcggcaaggggccccaatgcaaaaaagctagccggggccggccattttgcaggcggccccttgccgccctctggccgggcggcaggcctcgctgcctataaaaggcatgccgcccagcccccagccctcattcctccccccacaaatccagtaaaaaaaagaagaaaggggaagagaagagaagaaggggcgaagccctgccggattcacacgctgatttcaggtaatattcatagatcgtatatgtgactattgagttaaatactgtatattttttaaaactttgtttgaataaatgcattatatttttagggttttagttgtactaatctagaagtgcgtattgtagatatcggtaactacgtagatctgctagtttggaatcagtactttaccgttgcattggcatatacaagaagatattacgttgtaggtgtttattgcatgaaagaataatatgatctaattattttgttgacagata

SEQ ID NO: 9892 - DNA, 1501 bp, Oryza sativa
tacatatagcttgatctccatgcatttcatccttgtgaccaacactccactttcatatccacatgagactaggcaaagaaatgcttataaaaacattagtctcacataattggatttgtcattaatcatcaaaaccaaatcaatggcacttgaactttcaatctttccctttttggtgattgatgacaaatccattagtaataatcacatttggatatgaaaggtgaaattaatgatataaatcaacatgatatgagaaattgacaattgatttatatccatgcatgtgatgcttgtgcatatggtgcatgttggatgctatggtagatgatggtatgcttcttttcaagacatgcaccaaatgaatgtgggatcctagaatattttccccctttatatcaacgatcatatcaaatgtgggatcctcaaatattctcccccttttggcattaatcacaaaaagatttgcatggaatcagaagaccaaaacaagaacacacattcacaagaccaaataaaataaaaaaatttagatgaaagtacaaagcaaaaatttgcgaaaaggtccatttaagaaatgcttcgcacctcgcaccatcgctgttgtcactgcttcgcaggagtcgagtataggcacgtggagggtgattgtggcggtcggggtcctgcaaaaggggcgggggcggaagtgaaagaaggacgccggcgaaggggactcgacgtcgttggcggtggaggggacctcaaatcctgtcagccggtttgtcgcgcgaagccctcgatgccaggccatacatacagcctcctcggcagcctcagcggggccatcgcgggcgcgccgtctcccctgttagtggggtccctgcagaggggcggggccaaaaatgggaggaggacgccggtgaagatgggcttggtgttggtggcggcagaggaagcctcaaatcccgcggcaagcggcgggcgagcgcagcagctctcctctcccccatctcacgccgacgtggctggtcgcctccctctcgccggatcgcctcgcccctatctgccgccgaccgacggcctcctaggagagaagagctgaagagaagaaaaacaaaagagataagagagaagagaagtggtctcctactttttttaattttttttgctgactatgatgccacgtcaaagaaaccacccatatatactgccgtaggaccttgtgtgcacggtttagatgagtttagggtatacatttctggttttgtggttaaggggtcttaaaaaaatctcgctattaagttgagcgacctctggtgaacttattcctaaaaatataataataattccaacccatacacatagatgggctagaacttaggcccatgagaaaaccctaacccagcccagcccaacccaagcccatactagtccaacctcatccccagttcgctcccctcctcactcctcagtcctcgcctcggctcggctccctcccacgctccagctccgcctccaa

SEQ ID NO: 9893 - DNA, 850 bp, Oryza sativa
cgccgccgccggtgcaggtgagcagcctactagggttttcacgtgcttgtccgactctgtttttttcacagtagagatatcgtgagctcgcggtggaaaggtggcggatggccgttggattagatgcgactttttcctttattgctgcgttagtacataataccacaccgattgattggttgctattattggttggactggtcagcgaaatgggccaaatttactcctcttgttttacagttttactactacctgatcaaaatcttgtgagtttgtgtgacctaccctaccctgatgctttcagcgagataggaactgatttgtttggttgttcatctttttgttggtgtggcttgtactctactccgtttgcaaatcagttagcagatcaattcaattgtggtgcttagttagttactttatattttttttgtgtctgtctgaatcgataggaacaccttggtgctactaccattttcctatgatcttatctgaatgaaagcatatatagtaggtggtggttattgcctgtactgcatagttcctcttaattactgtcctactcataagttattttgtttagcctgctgctcaaatggccaaaagagaagtatttttgctgctcgcattatctaattaagcattggattatctgcctgtcagggctggaggagggtaagctgagcagcacaaatggcaacgcctctgacccaccagcagctgtaagcacctttccttatgaactcgagtaatttatcctgcgcagcaacagcgcaggttgttgcgtttggtttccaaatggaagaaggctgtgaagtctcaacttgtgtttgtgcaggatgcggcggcg

SEQ ID NO: 9894 - DNA, 1501 bp, Oryza sativa
cacaagtccaagcgcccgagggatcgctcttccactccatcttctcatgatgattcagacagtgattggtccggtggagaggatgcggttcctcaggttgcgcgggtggctcggcggtctactcatgctcatgatggtggtggtgatggtgagggctcttctcgtcaaccgcaaacgccgccgcaccaacccaatgtccccattgggcctctccgcattcatacccccgagagggatccggcggtgattcaccaagtgtatgattggcggcgcaagtctgaggttgttgctcgtcgtcgggacgaggatctgtaacatcctggcctagggtttaataggattaatagaatactcatatcaacaagttacaacttctttttcggaagccaatctccgaagaactccagggttaagcgtgcttggcctggagcaatttaggatgggtgaccgaccgggaaattcttctcaggtgcacacgagtgaggacaaagtgtgcagaaaagacatgtgttggcttgtgagggcagtctatgacctatgaaagctatcagatgtaagcgggcccggcctgggagaggcgggacgttacaaaacccgcgtggtcccaggtgggacccgcttgtcggcgacccggcccaccggctctctctctcccctccccgcccccgcgcgcgccttgggccgccttcttgggccggccggcccattaagctcggccgagccgccccattctcttgggccgcgccctagccgcccgagggaagtctaatttccctccctccttcttttcttttcttttctttttcaaaaaggatttaaataaatccttttcctttagaccaaaaatccaataatcttagaaattcaatatcttcccaaccgtaagtccgtttgactccgtacaacttccaaaatttcctcaaatctcgagatctatctgatggcacgcttagaggtcattaatagggctttattttcgccgtttgttgagttgtcccgtttcgcgtgtagtttcggagcccgaagacccgcagtgcgaggatttcgaggatcaagctcaagatctcgagcaaggcaagccacctttgaacatcttgagcctatatttgaactaagttatatttcttgcaaaatattatgcattgctaggattgcacttaatatgtttgccccatctacgaggcagatcggtgagcatacctaacttgttgcatttgatccttccattgttaattgttatatcatgtttccttgtaaccacctggtcacgcctcgatattcgtgcactctgtgcgagtatcgacggtcgccttcaaacttaaaatatgataaacatcttgggtaaaacttggtttacaaaacgattggaaaacccgacgcctgggtcggtgtcttgtgaaagaaaatgagttttaaaaataaaactcgcgacacaaggccattcctgggcggaatgcttgtgcggtcgcatttaaggaccgattccttcggaattacatcc

SEQ ID NO: 9895 - DNA, 1501 bp, Oryza sativa
tcatgcataatttattaataaatatactagagtggctatctatagcgtactatcgtggatttatcaacgcgcggctccatcttttaagttaggcagcgaaatgagaataactcaactggttaggttaatggtggtgtaacatgtctactaaaaatttaagtcatagacttgacacagttacacatatttatgactaattattttttcagtaatagacggcgtccatcaccaacaacgtgcttacggttgttttataaatatcaagatatgttgatctagttttcaaaggtgcttatagcaaataaggtgtgtacacgttcatatatatcatatatgggtgagtgtgtggacgtgtttatttgaacgcctacgtgccccactcaggacgattgagggagatttggaaagggttaattgtgcaccgtacctgttatggtgtagaatcccttaaatctacttcaatcattttttatggggttaaacgaggcctaaagaggaatatttcaagaaaagatagcgtaccaccaatgacatgctgaatttatttatttgtcggctgatttgcatgcatggcctgcaaacattcacgcagccgcgtaagcccaacatggaggagaagagaaaggagagacattgggccgagagtgggtatggcctgtggaccaatactctttttcttgagaggagaagccgtgggagattctgtctggcgggtagtcttagagctgaaaacggacggtagcatcttttcaaaaacaacgctggatcggtccgtaattgatcatatttatcatttaaattactcagtgtcgatgttaatatagtgtataaaaaatctaatgtgttcagttcgatgcaattctcaagataatatgggcctgttcggcatggctacggctgcgtcgtgtgcgcacggcactgttggtgtcggctacgacgcagccgcagaacaggcccaatggccgcgagggccggacactttcacccacgttaatgtttctggctgctgtccttccggcgacccaccaccggcgatgtccattgacgatcgatccgtccgtccatctcctgctcctgcaatgctagcttctgctgcacctagcctaagctattttacgcacttgttccatttcccctgtttgtttgccgtgcgggctccgctgctgaatatgactcaaacaattttacttgcttttcgtaccaattactactacttcagtttctaaccaaagctgtataaaattcatgtgttccaacaaaagactaattgtctagtcatacattaaagtaacaagtaaccgattgattaatcagaacaggtgctgattaattaggaaaaagtagggttagcagttagtaaaaagtgaagaagagtaaaatagtcagatttggaagggaggcaggcatgatactaggtgagatctggcaagcagctagagatcacaaaagcagggtgccatggagacatgtgaccacacctgcttgcattgtttggctttcc

SEQ ID NO: 9896 - DNA, 1501 bp, Oryza sativa
ccattgggcctgttctgcggctgcgtcgtagccgacaccaacagtgccgtgcgcacacgacgcagccgtagccatgccgaacaggcccatattatcttgagaattgcatcgaactgaacacattagattttttatacactatattaacatcgacactgagtaatttaaatgataaatatgatcaattacggaccgatccagcgttgtttttgaaaagatgctaccgtccgttttcagctctaagactacccgccagacagaatctcccacggcttctcctctcaagaaaaagagtattggtccacaggccatacccactctcggcccaatgtctctcctttctcttctcctccatgttgggcttacgcggctgcgtgaatgtttgcaggccatgcatgcaaatcagccgacaaataaataaattcagcatgtcattggtggtacgctatcttttcttgaaatattcctctttaggcctcgtttaaccccataaaaaatgattgaagtagatttaagggattctacaccataacaggtacggtgcacaattaaccctttccaaatctccctcaatcgtcctgagtggggcacgtaggcgttcaaataaacacgtccacacactcacccatatatgatatatatgaacgtgtacacaccttatttgctataagcacctttgaaaactagatcaacatatcttgatatttataaaacaaccgtaagcacgttgttggtgatggacgccgtctattactgaaaaaataattagtcataaatatgtgtaactgtgtcaagtctatgacttaaatttttagtagacatgttacaccaccattaacctaaccagttgagttattctcatttcgctgcctaacttaaaagatggagccgcgcgttgataaatccacgatagtacgctatagatagccactctagtatatttattaataaattatgcatgaagtaagctacccctaataatttaaaagagatatataattaaaataaattgagatgaaatatgtggctttgttgggttggatgcaccaaaaaataagtaagaaaaaggaagaaaggagtacaacctagtgttggtagactccattacgcgtccaaagcatgcatgtgtctgccatgttatcaacaaagacacacatgacacttggcagagttaacacggcatgatgggatatgtcacatatggcatccgattccagaagagaaaaaaaagatggtagtgttaggtgacaaagatggggaaagaacgaattaataattaggaaaaactgtagatgccttgcagatcgaggatacagtacacatgatcatcgacttggactgatgagcagcagcagctggtgtgcatttctctcgtgcctctcgtctgtgtttgagagcgagcgaccaacagttaaaaatggattaagttagactgtactgtctcaattaattcaaaacgcgcgtttgatcagtatgggagaacctttatctgctttcccgg

SEQ ID NO: 9897 - DNA, 1501 bp, Oryza sativa
caccctcagtacgtttagtacgtgctactcagataaggccaatgagagccgcacatagcgtgacatatgtgcgatatacatccgccaaccggatacgtataaagtctgaagttgatcgatggaaatatggaatcgacgtagggataagatagaggggtacagctagtgctgcaggcagaaaatcacaaccagagaaagggaagggaaagggttcatccaaaattttgtatttcatatgtttagtcatattcagttattcagttaggtactactgtttcatttattgtattacgactctctcgagctagcctaatatatatctcgacgacggttcgcattatataagaaattaaagacgattgaaaaaaaaaaggaattgagagctatgacaactagccaaatcttaagtgaaaacaaaacacaggaatccatgtagagataagtaagagtacaaatgcagtgagaaagttacaataagagagagatggttcagccaaaatttttgtctcgaattgcatatgtttagtcatattcaatcacacaatgttttattatatcacgactctctctagatagccaaaattggtggaggatagttgtgatcggttataagagatgagaaagttggagaaattaataagagatggctgagataaggggtatatatatagaagtggttatatattgggacataattataattaatgctaaatgtagttatattatgaaagggaggtgataagaaattaattaatggctcctttcaaacacaagattgcaaaaattacagaaataggaacaataaaggaattaagcatcatatatatatagctagccgaatctcacataaaaaaaacatgtatgagaatttggtaaagaggattttggttgctccagagaaaaatgtaaaagatgggctttcatcaaatgttttgggatcgatggaaaacaaatcatgtagtgattttggaacacattcctacaatacaaatgactttacagggaatattctcataggacttcaatccttcaaaattcatgaaaaaaattctcaagtggtgtttgataaattatatatattatatgcttacaacagagcatgtatatatgtaattactactagtttgccttgctttcgtttattgtgctccaaattatttaatttgtcatgcaatgcctagattacaagtggcacacattaatttccaccaagtcttgggaaacatatcatgtagattatcgtcattatatgtgttgctgatgtcggtgtatgggtggtggttattttttcttttttgccagaatttttttccctgttccctatgtattatggatttgaggttgaaattgtacccaacttaccaagttgatatactagaaggctcatttatcaagttcttgcaccagaactattaattttaaataataagtagtatttaaatgtatgttaagttggtacatagaccacattatgatttttttttaaaaaaaagaacatagt

SEQ ID NO: 9898 - DNA, 1501 bp, Oryza sativa
gttcatattgctcagcgctgaatcatatagtaattgcattgccacttgacaacgctgcaggcctatatgtcaaatactataacatatatcctacgttcctattaccttcgtttcagcaatatcttcatatagatacatggatacatgtttaaattcataatgacacgttctatattactatatattaggacggatgaagtattttctatatttgttgattggggatatatagacatcgtatcctgtgtacccactcaccttggtgcattcgtgcactcacgcgacatgggaccttcaatctccatcggacggatgtaatgcaaagggacgttttttcataaaaccacccgcacatacacgggtaaatttgtaaatagacccttgattccttttgtcttcccgtgttgggtccttaccaagatgtattccccaaaatctctatctgacgtcaatggcggctcaaattaagccatgtttggcgacagagatatcacatccagagcgcggcggcgcggccagtggcatgtcacgcctcaaggtgcgtgtggttgtccagcttgttggagagggacgatgcgcgggcgagcgtgtccagggcgacggccatggtgttcggccgatggagcagctgcggcgcagtgtacctgactctgtagagagaagagttcttgcccatgggatggaatggatgagtctttgcccgggggttgcagatgtgtgcatcgatggcatatccgatcggaatttcttgtttgattcgaaattttggcatgccatatatatcatgcaaaagatcctgaggttgagatcatacatatcgttgagcaaggatttgacggctgcatgctggaatcttgattaatcttaatttctagcggccatctccgtcgagcattgttttatttttcagagattcaaagctgccatggacgcctcacagaggggatagatttggggaaaggggttgaacgggagacaagaagatgaatcgaagggttattttgtaaaaagaagactctctcatcttatatccgtccgatggagatcgaaggtcccatgtcgcgtgagtgcatgagtgcaccaaggtgagcatgtgcacaggatacgctaccggatatatatatctatagaaacccctctgttatttcttttagtgtaattgcattgattccattcatgtaatcttgtcctggaagctaaataggagtatttaattggagatggccagcacgattgttctttttgagctctgactcaaatcaaatcctcttcctgtttcctagctctatatataaaccctaccattctcctgtctctcttcatctcgttcttcccacacacgcgcgcacacacacatcttgtgtgagacttgtatgatcgattgctagagctatttcgattcgtcacgttatacgcatacgcgttattagcttagttcattagctcaaggttaattaattaacgacatggctgctcggtcgtcgtcgtcgccggcgaagac

SEQ ID NO: 9899 - DNA, 874 bp, Oryza sativa
tgattcaggctctgcctttgattcgggtttagactccgagtaagttgccggcttggactccggttgcgacgcagacattgcctctggttccggcttgggctcatcttttggcccaggctttgcctgcgagtaagaatccgacttcggttcttgctgcgacgcaggttttgcctctggttccgacgacttctcatacgcagcacggcctcgcttgctgaggaaacgggcgccatgccctagtccccaaccgctcgccgcttcttcatcagcaaaggctccaatcgccgccaccaccactccaaggaggagcacagcgacggcgaggcaaggagagctcctcgccatggctagcaaagctagctaagttgctttgctacccccctctctctctctctctcgctctctcttcccttatcttcttctccctcactcctgtgtttcttgtgtgcgtgtttctctgagcgatgtggcaatggatggaagggtggctgggatttatagcctgggaactggatggaaggatggctgggggattcattgctggcgaaaggcaagcaggtgttgtcacgtggctccactccatgacacccggccacccaatcgatatggtcggtctctagcaagccgcctctgccaacctctcatcgagtgttccgcatgcatgcttcctttctcgaatttgtctttacactaactggtaaccataattactttctgctaatcagtcagcacctctcctcattaatcaattcattagttacgtgttattttaactagaagaggtagcccacgcgttcgcgcgggcattcatgaatcattgcttaaatatttcttttaagatatttgttagtttataatatgaaatatttaatta

SEQ ID NO: 9900 - DNA, 1501 bp, Oryza sativa
  unsure (1)..(1501): unsure at all n locations
ggttgatagcccataaaactagctttccataaatattatagaaattatttaaatcacggaagcattcacaatacattacattccagaaacaattttgcatgtacagttctatttaattacccatcaaatcttattcacaatgggcgtagagcctcgcgaaacgtttccaaatgaattatctatcacataatggaaatatactgtagtatacacgcccataaatttaccgtagccttatgtcccataaaatccatttattaataaacattgagaatatataccaatcttacttccttatagataaaattttattttaaaaaaattgacacatagggtgtaatgtagtcattatttatcatatcataaatttgaactaaaaataatatttgtatgaaataaaaaaaagaaaaatgtcaatagagtgtaaacgaacaaattgtagaaaatcttataatttattagaatcactgtggttcttaattttcccttaaattgaggcaaccatacataaccattgcatcatttttaagtgaccacatattaatagacttccctctattctatgccatagcagttgattgatggttttaaatattatattccttactattaaatttgagtttaaaaactcaggtcgactaaatgtatttaaaaaatatatatcacacatattataggaagtgaggtctagaatatatctactctatttttgttgattcatatgtaagtacatacaactaattgtgtcaaatgtgaactantaaaaaaaaggaataaaacacatttattgagcataaccttttgagatttgtaaaataagagcccacacattcaattaaaaagaaaacaacaccttactttgtaatttagactganaagacctatgtcttcttaaatgatgaagaagaaataatgtatagataggtgcttatatagattaattaaatatttcatattataaactaacaaatatcttaaaagaaatatttaagcaatgattcatgaatgcccgcgcgaacgcgtgggctacctcttctagttaaaataacacgtaactaatgaattgattaatgaggagaggtgctgactgattagcagaaagtaattatggttaccagttagtgtaaagacaaattcgagaaaggaagcatgcatgcggaacactcgatgagaggttggcagaggcggcttgctagagaccgaccatatcgattgggtggccgggtgtcatggagtggagccacgtgacaacacctgcttgcctttcgccagcaatgaatcccccagccatccttccatccagttcccaggctataaatcccagccacccttccatccattgccacatcgctcagagaaacacgcacacaagaaacacaggagtgagggagaagaagataagggaagagagagcgagagagagagagagaggggggtagcaaagcaacttagctagctttgctagccatggcgaggagctctccttgcctcgccgtcgctg

SEQ ID NO: 9901 - DNA, 1289 bp, Oryza sativa
cattagctattttgtgtcaagtctcctgaatgtgtaacacatctgatcaccgccatcgagtggtttgacaggcacatctcgggctgaagttaactggcaggctaaaggcccagcaattaccaaatttggttgttaacaggtctcatatatctttctctcgcagcgtcgaatgccttattatgtttgatggaagaattgatttattctattcatccttcaaatataataaggggttcggagtacttccgacacgaaccaattgtagaaaatcttataatttattagaatcattgtggttcttaattttccctcaaattgacacaaccatacataaccattgcatcatttttaagtgaccacatatcaatagacttccctctattctatgccatagcagtacatagatggttttaaatattatattccttactattaaatttgagttttaacactcgggtcgacaaaatgtatttaaaaaatatatatcacacatattataggatgcgaggtctagaatatatctactctatttttattgattgatatgtaagtacatacaacaaattgtgtcaaatgtgaactaattaaaaaaaggaataaaacacatttattagcaataacctttttgagatttgttaaaataagagcccaacacattcaattaaaaagaaaaacaacaccttactttttaatttagacttaaaagacctatgtcttcttaaatgatgaagaagattaactttatagataggtgcttatatagattaattaaatatttcatattataaactaacaaaatatcttaaaagaaatatttaagcaatgattcatgaatgcccgcgcgaatgtgcgggctaccttcctagttaaaataacatgtaactaatgaattgattaatgaggagaggtgctgattgattagcggaaagtaattacggttaccagttagtgtaaaggcagatttgagaaaggaagcatgcatgcaggatactcgatgagaggttggcagaggcggcttgctagagaccgaccatatcgattggctggcccggtgtcatggagtggagccacgtgacaacacctgcttgcatttcgccagcaatgaatcccccagccatccttcgctccagttcctaggctataaatcccagccacccttccatccattggcacatcgctcagagaaacacacacacaaggcacacaggattgagggagaagaagataaggagagagagagagagagggggagggagggaggggtagcaaagcaacttagctagctttgc

SEQ ID NO: 9902 - DNA, 1501 bp, Oryza sativa
atatatgaaccagtggtggacacaactttaaaataaagatgtgacggagaacgaagatgttcactcgataagaacaatcaaacacaacgcatatcgtatttatagtttaatcgcataactgcctcgatcattgcttgcggcatgattgcgttgtgaagagacgaactaatctgttaggcgttacctaattttgatgatccatgactactataagggggtagggtaatcttggaggtgtggagcgacacgggtcgtagctggatcaatcgacccaccctgtataatgggtacgtagatccgccctgtatatatcattggcaaatgaaatctctcaacttcattttaggatgatggcattttgcgaaattcatctcttcggtgagatggcacgatcaatcatatgtactttttcagaactaaaaggtcaggtgtagttcactttaggtagctactcctacctagtatatgtaagttacacagaaagcagaaaaggttctatcctgaaacgcgtgtttgaaattaatttgagacactacagttcgatctaacccccatccaatttaactcttgttcgttcgctatcaaacacagacgaggcacgagagaattgaaatacacacctgctgctgctcattagtccaagtcgatgatcatatatgtctctaacgtctaaagtgcatcctcgatctgcacacggcatctacaaattttttttttcttagggcctgtttggcacagctccagctatacctcttctggagttgctccaccaaaaatagaagtagagctggatggagctctcttacaaaataaactagagaggtggagctgagtttagccagctccacaacctactccaaacccaactcctaaaggtaaatttaggagttggagctcaaccaaacatgtcttaattaatttgtcgatccttctcatctttttcacctaacaagaccgaccgccttaatttttctcgtctagaatcagatgcgatatttgacatatcccgtcatgctagctaaataacctggaggaccccatgattgttgggacgcgtacataatggcgtgtaacatcacttagcctattcggtttggaggagcttcacaggaattctgaagaaattgaactgtattatatgaaaatcctataaaatttctattttctgaaggagcccttatgttatatatactctttttagcttgtcgatcggacatccaacttcatacaacagtttcgaatgcatcgatctgttttatctttaccttttgtaattatgtatttatacaaaataatatactgaattaaatttcaattatcagaataataataaatttttatagtggttattgaaaaataaagttatatattttttcagtaatataagatttatttactgaagttattgaaaaaaaatatttttataatggttgttcaaacaagaggaagaaactatatttttcaatgattggccaaaacccaaaagtaaaggaagatgaga

SEQ ID NO: 9903 - DNA, 615 bp, Oryza sativa
ctgcgggaaattcggatttgttttgttttggaaacattccgaaaaatccggtgcgtgaaaacggcgtggagttcagataagtttgcgacttatctggttcggttacgcggagtggagatcgtgcgggcgccctgatcaagcgacctatctctatataaaccgagccgccgccttcacgcaacacacgcgaaatcaatctagggtttgcctcctactctgtgctgctccgtcgctcgtagactacttcgaaacctctgccttcgacgtcctgcaccgggagaaggtagcaataaggtttttgggacctctccctgttcgtcgcgacggcttgccttcctctccgctcgcgtgctgcgtgccttcgtcaacgcccgcaactgcgagtagttcctgccgagcaaccggtctttccgccacctcggtacgtgttcgacatattgcgaatatttgatatgttcatgttttactgcttagtttacatgtgtagatctaatgatgcgttcatgctagtttacatttacaatgtcatgatttatttatggaataaattaaatcattatgtgcttataacttcaacaattcaaaaaccttactataggcgctgtgattttacta

SEQ ID NO: 9904 - DNA, 1501 bp, Oryza sativa
cgataacctgaaggccctccttgttatccaacttgggaaaggcacctcttcgtccggcgacccccacccgctttttggcatcatcagcgggccaagagatccggtaagccaagaacttcctcagcaccagctccgtgccgagccgtgcgaactcagcttcgatcgctccaggctcctgaaatcaatcgatcggtcaagctatctgcgatttatggaaagatcgcaaggtgtttgttgtattgtgtacctggatccggcagatgtagtagtcgtcgccgtagagcgccctcaggccgtcgacgggcctcctcgcggggctccgtggggtgaacgcgacactgagggagacgagcgccctcaccctgtcggggcggaacaggcacaggttccacgccgtgagcgcgccccagtcgtgcgccaccacgaacaccggcttccccgcgccgaccacggcgtcgaggagcgccaccaggtcgcccacgacgtgcatcgccgtgtactgcagctcggcggcgggcgcgtcggagtcgccgtacccgcgcaggtcgggcgccacggcgcggtaccctgcgtcggcgagcgcgcgcatctggtggcgccaggcgtaccacacctgcgggaacccgtggaggagcagcaccgggggcgcgccgggcgggccggcctccgcgacgtgcatccgcaggccgttggcgtcgacggtgcggtgggtgatgacggccacctcgttatcggcggcggcggccatcgcgtcgtctttcttggcgtcggagtcggcggggggatgaggaggggacgacggcgcgccgaggcagcaggtgggggagcagagctcgtggagccaggatatcacgggcatgaatggtgtgacagagcaggtgcagtcagtgaggaagaggttaattatggttactggtgtggtgggtcgctcgctcaggggtttgtgggatgaggacgaatggacacgaggacgaggtgggttttattgggcgatagcatgtgggaactcgacaacacgcaaagccaacgtgccgcgaccgaacgcatccggtacagttggcgaggaagccgcgtcacccgcgtccatggaagcgtcgtgtttagcaagccaatattcagcacatatgcagcgtggcaagattttttttttacattttagacatttttgaaaatttgtttaacaaatagaacttaccgcaagtctggatctctaggttgatgccgaactagttcaaatccatcgggatacagtggtacacaactatattaattttaattgtatctagttttcaggcttctaaaagtaccaataagttttattcactttggatggtctaggtctcgccaaaattcatgatgtcatgtgacttttctcagcaattttcttgcgcgcctctgctccttgtgttgtgccacggtgcagtggcggatgcagaattaaaataaagatggggcgaagatgctcgtctcaataagaacaactaaacgtaaaaaataccat

SEQ ID NO: 9905 - DNA, 1501 bp, Oryza sativa
tggcgactggcggtctgacgcacgccttgccccatcccgtcaagacgaaagcctctaggcactcgtctcaagccggagctagcgtgttatctcttagagatggcacgttagccctggtcagatttataccaggcttcatcctaaccattacaggcaaggtgttacacgaagaagggcaaacatgcacgttgttaagctgacgcgtggtggacaagaatgaccggtctggcaccggtcgcgtcatcgacagacagccacggtcccgcgtcatctctgtcttcgggggaggtgggggtaggtgtgggctgtcccatcagaagggctcccggatggaaaccgtaccgatctccgcccattaaagagaaaaagaacagtccagtttggaaagagaaaggtgcatgtggtatccccttgagatataaaaggaggaccttgcccatttagaagggactttttccctagaacaagggaggggaaaggaagtgaatcctttgtaacttgtccatacacaaatccacaaaaacacaggagtagggtattacgcttcgcagcggcctgaacctgtatacatcgccgtgtctcgtgtgtcttgcgggcgggtgatctttccacatacagagagagagagagcttgggattgcaccctaagcccctggtcgaaccggcaaaggggggcttgcgcagtctcccggtgaggggccacgagctccgtcaaacataaatatggtattttttacgtttagttgttcttattgagacgagcatcttcgccccatctttattttaattctgcatccgccactgcaccgtggcacaacacaaggagcagaggcgcgcaagaaaattgctgagaaaagtcacatgacatcatgaattttggcgagacctagaccatccaaagtgaataaaacttattggtacttttagaagcctgaaaactagatacaattaaaattaatatagttgtgtaccactgtatcccgatggatttgaactagttcggcatcaacctagagatccagacttgcggtaagttctatttgttaaacaaattttcaaaaatgtctaaaatgtaaaaaaaaaatcttgccacgctgcatatgtgctgaatattggcttgctaaacacgacgcttccatggacgcgggtgacgcggcttcctcgccaactgtaccggatgcgttcggtcgcggcacgttggctttgcgtgttgtcgagttcccacatgctatcgcccaataaaacccacctcgtcctcgtgtccattcgtcctcatcccacaaacccctgagcgagcgacccaccacaccagtaaccataattaacctcttcctcactgactgcacctgctctgtcacaccattcatgcccgtgatatcctggctccacgagctctgctcccccacctgctgcctcggcgcgccgtcgtcccctcctcatccccccgccgactccgacgccaagaaagacgacgcgatggccgccgccgccgataacgagg

SEQ ID NO: 9906 - DNA, 390 bp, Oryza sativa
ctagaagaaaaaactgatcgtgcggggctgcaccggagcgttgcgcagttgatcggccatgagcccatcgccccaaaaggaccggaccgtggaacacaggctcactgctgccgggctgccggccaatctgtcgaccgcctcggctcccgcaccgcacgcaccccatcaccaccccatcagtcgctcaccctccaaaacccccccaatcttctcctttttgccgcgaaatacccacctgggcgcgcgccatcctctccactgccccctaaaacactaacccttttcccgccccaccccgcccgcgcgtacctacgcatttcgtcgaacacatcgcctgcgtcccccatcgccaccacctcgcccgatccagcccggcgatctgcggcggga

SEQ ID NO: 9907 - DNA, 1501 bp, Oryza sativa
ccgccgccgaatcttggtgctgaagctgcacgtgcaacacgtacttaattctccatctaccttttcattccgatcgaggcacccaaggtaacacaatgtgttcatcccttagccaaacccaaacgaaatttcaccggattctcactaccggtgttcattcaccgacaaccaaacactcgaaatttaacgtttgtactacctccatcgaaaaacattatatatttttctatcatttaaattttttccctaaaaagactgtgtttctaattaatttgagaatgctaaagctgatcaccgatgtcatatataggcctggtcgtgccccaccactgcgtccgcagcggcaaagttgtgacggttgcaaacgaggaaggcggtggtggcaggagcagaatgatcttggaggatatcattcccacaccacttccccggctatgctcgagatctagatcctgatgttaacagtgaaatttagtaacactgtactactacaagaattcgttttttcatacggccggcaacgattttcgcatgcggctgggccagccacatgcgccaaattgtctgcaaagatcgtcatctttgcatgcggccagggcacccgcatgcgaaaaatctgattttcgtatgcagatggttaagccgaccacatgcaaagagaaaaatcaccaaaaaaaattcaaaaaaaattcaaaaaaacaagaaaccctagccgccacccgagctcgctggccgctccagccgccgcccgtccccactcccaccgccgccacccggccccgctcccaccgccacccaccccggtgccgctgccgctcccaccgctggccgctcccgcctcccgaggtcatcgcgacactcttcgcccaaggccgccgccggatccggatgggacgagtcctaccgcctccgtatccgagtgggacgaggaccggcgccgccgaatatggcccgtcgcttcctccacgtcgtcggcggcggcggtgaggaggagatggtggtggcgccgccgcccgaggtcgccgtggcactctgcgcccgaggccgccgccggatccgggcaagacgaggcacgccgctgccggatccgggcgggacgagtgtaacgctccacttttcgcgagacgttaaaaactaattcggcaaaatcctatatgcgaaagttttcgttctttgtgtgcgagtctaagttgtgccaagatctcaattcaaattcccgtcgttccctctcatcgatatcaaaatcccccgcctcaagattctaattccaatttaattattccaaaggtcaatcgcctctcttgaatcctcgccaaatacttctcccgaatccagaaataactgagtccaccttgaatccattccttggctcctccgtattttgctgagttcaaatgttgaatttgaattcaaatccccattcgattttaaatacaaaaatccctcaatatcgacttccctgaaaaagtctaatcttcctccgttgatctttgggccgttt

SEQ ID NO: 9908 - DNA, 1501 bp, Oryza sativa
attttaactagagaaaacgaagatagtactgtttatggaacgacaaagagcaaaacaacaagaaaagcgtccaaaggaagcgccaaaagtatccagcacccgacacatcctttcctagctgatcgactccaccaaagatatacggagtataaacttctccatcatcccactcctatttttagactttttgggtaagagttttctcatgtaagtatttggtctgtagtactccatccgttttataagtcgttttgactttggtgaaaatcaaactaatttaagtttgattaagttgtagataaatatagtaatatgtgcaacactaaattaattagttttattaaattgataattaaatttattttcataatatatttgtattgggttgaaaatattactattttattcataaacttagttaaacttgaagcaaatgacttataatctgaaacagaggcactaacaagttttgccacattatccactttgtttcccatgagtgctttgttcatgactttcaggtcttctctcacctcttctcccatctctttctcttaataattagggaccagtccgccgtatcggcgtttaccgtttcttctttgccatgtgcttaattaattaagtccatggctcgatcgagagccagtccgtctataaatactgctgaaattgcatgtattaatcatcacctctgctagctagctatagctctagttgtactctaattgcgcagtcgatcggaattgtttcactacgttgattgaaaatggtccaatcgtttaaaaagcttaaatacaaccaaatcacctcataaaacattttgctacagcgcatgaaacaacggtttttgaagctatttcaccgcatataaaaataatgtttcagcaaatagcgaaaggatgtttcaattctctgcaacatttgatctatacatagtgtaacaatacgaatatacttgttgaaacattattggtgaaaaaaaaatgaaacggattcctgttaatagagtgtttccgtaatatgtggcagatttattgcaacagtgcgtgtggtggggcgcgtggtggacggaggcgcggtgccccatttttttcggcgcggaggcgcgggcacccgatttgaagaattttcagacattctgggtaagagaatttggtctgtagtaacaagttttgccacgcatattatccactttcccatgagtgctttgttcatgactttctggtcttatcacctcttcagctcttctcccatttctttctcttaataattagggaccagtccgccgtatcaacgtttaccgtttcttctttgccatgtgcttaattaagtccatggctcgatcgagagccagcccgtctataaatactgccgaaattgcatgtattaatcatcacctctactagctagctatagctctagttctactctaattgcgcagtcgatcgaacgtacactgccaatcaaatcaactgcgagcttgcaatggagagaggag

SEQ ID NO: 9909 - DNA, 1501 bp, Oryza sativa
cggggattgagatcatgagatggcacgggcactagacaacaatcaaagaaacaactttcgcaattagggtttttaggagataattttcccgctaggcgccacgacggaacgggcgctacccggcatctttgtggtaaaaagaatagatgccagttcatagtcaagaaccggcacctaaaaatcaaaccgagccggtcctcaggcagatagttggccggccccacaacccacgaggtgataaggccaacacctcctcttcctcgatcttatctcctcgtctctcacaccgctctctcagctctccctcccccccccccctctctctcagcggtttggcggaggtgctagaggtaggaggcggcggctcggtcgcatggcgcggcctggccgtggtgccctccctttgccagatctagagggagagcaagctagcaatattatgaagatttatttgtctctagcatagctagctatcccctgcgttttatattacaagtcgttttgattctagtcaaatttcttttaattttgactacgtttatataaaaatatagaaaaaaattcaatacataacagacaaattatcaaaatagattaaagtttagttttaacgaaactagtttggtgtatatgcaaaactagtttcactaaaacttggtatatatatgacagaagttttttaaaaaaagatatatatgacagagaataattaaacaagttggttcacctgtcccagctgctaaggaaagtatatccaggtaacgtgggagataatattaaactagtgtggatccatgcatatggccagtttgctacaattaattgaccacatacaattggtggaaggaaaaactactagaagcaacgtgacactgcaagaccaagtctaaagtcttttcaacctccctagctcgctcgcatgctgcgcgtacgttgtaaaacgtacggacaggattatactactataatatgatcaagtttaacataagcataatctagatatatactcccttcgtcccataatatataggattttgagtttttcttgcaccgtttcaccactcgtcttattcaaaaaatttgtgcaaatataaaaaacgaaaagttatgtttaaagtactttggataataaagtaagtaaaaaaataattctaaatttttttaaataagacgagtagtcaaacagtgtaaacaaaaactcaaaatctcttatattatgggacggatggagtaattagtagcatcgaatatcgtacgtacgtgctacttgaaaaagatgtggaaattaattggaaagttcatttgggccacgtgccaaatacaaacagtgcaattaattagccatggtattgcatgcaatcttcgagctaatagatgagctacttgtgatataacgactataaatacctgatcagcgagcaacacatatcgatcagctagcacagcacaatcgctttagctaccttgagaaactcttctgcattggatcgatctgcaataa

SEQ ID NO: 9910 - DNA, 1501 bp, Oryza sativa
ccgcgcgccgcgcgcgcgtgcgcgagggtcgtgccgagcgcccctccccctccgctctgcctgcgcgcgtgagccgcccgcgccgagccgagtcttccctctctgctccctcgctgccgcttcccgcgcgccgtgttcacgtgcgcgcgcccgcgtggtttcccgcccgagccgcgtcgtctgcgccgtccgcgtcgcccggtcccgctgcccagccgcgccgcccgttgcttcccgcgcgcgcgtgccgagtggccgaccgcctggtcgccgccgccgtcaccctctgccgcgccagcccgcgcctgtcgcccgtgtcgtcgcgccgctccaaaccatcccaccgtcatcgccgtcgtcaccgcccggcccccgccactccgcgcgcaagccgccaaggaaaggaggccgcgcccctcctctctctgccgcgtcgcccccgctcccctccccctttttcccgaatcggcaaaggggcaagccccctttctccccctccttttcctcttttcctcctctttttcccctctcgccggcgtcacctcctgtcgccgctttggacgctagccggagcgccagctcgccggcttgaccgcccatgtcggttcccctctctcaaaccgacattgccgcccatttaaacccgtcttccccctcccttcctttcctctcccattcgcctcctcaccgttgccgccgctcccgtgctctgcctcgcctccgccgtccatcgccaagcgccgggagagccggtgcgttcgtggacgcggaaggggactccgggcgcgccctcttcttcctcttcctcggtccgaggccggagagatcactcccgcgccgtcggcctctcgtcactgcgccccgtcccgcacggtagtgtctctctccgttcttcctcctcgctccatctccttcccctagctttcggtagtagcttgagtagactccccgtagttagccggtgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcctctcgtgacctcgttgccgttttcctcctctcccgccgccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcgccgccgccacccgccgtccattcgcggccgggtcgtcgtctacctcccgccagcccacgtggccgccacgtaggcgccacgtcggcgccagctcagcctagaccggatcgagccgaccccggtcagtccctccccgtgcgcgcgttccaccgcgagccgtgaggctgcgcgtgggcccgccgcacctgcgtccaccg

SEQ ID NO: 9911 - DNA, 1501 bp, Oryza sativa
aacacgtagtagtagaaccgtacgtacgtcttcgtgagttaggtaattaatatgcggctacacgagaggaaaaggccaaggaaaatcattggaaagttcattgcaacgtgccaaatattaatattgcctctgtgcatgctcaacgttatatcttgtgcctccagctgggcatatattatggtatgatccttaattttaatcttgaaagaaactacctttttaccatttctttaattctttagataagaaaaagaaaaatattctctagaaaccatatctgtcacggtatccaccttgtcatcggctatgtcagtgttactcgaagctttatttctaattaagggtatctttactctatgtgtgtgtgtatattgatatttctcaaccaggttatgaatagggcccactattgttgttgtaactttaagtattgcattagagttagaaaagggatgaacctagctttgggttaagccctcaaccggttcgtggagtgttgtggaaaaaaatggtgacggttacctctgacgaacgtcctccgtcaaatgtgagtaaagtcatcagcgaccactaatctctgactaggaccaaaacacgtcaaaggtgacggtttgaataccgtcagagatgacctgattcggcgtagtgtgcatagctttatatgagcctgtacttaggccttgagctatggccgaggtagcccggttatgatccatcattggttgggagccatcacaactttgaaagacacattttcggataatgtgatatggatacatatgcacacacactagaatactagatgataccccgtgcagtgcagacggaatattggtgtgtgcaatgcagttgtaaaatttcaatacgtacatacgagaaagattatatatacacgctgatatgaactatagaagtgtcatccaatgtgttgtcaagtgatggtgtaacttctttacagtaataacgttctacgctagctaagtaaatcactgaatgctaagttatttactaattagtgatgaatagtagctacaaaatggattaagcataggaatgatccaatatatggctctctttttttaaaattatgtggtttaatgcatgttgagctattggctataggatatataaataagccagaaaaataaacatcaagttgcattcactacctgcccagatgaagaaagtatgcagctgagctgtgtgccaaagactattaaagtacagtgtgaatacatgcatggaaagtttgcgacaattgaccacttaattatatttagtggaagtaattaacatctactagaagcaacgtgacagtgcaggaccaagtctaaagtgtctttccaacctcgatctctcgtaatcgagcttagctatagctctcatgatttaactgctataaatacctcagcaagcaacaagtctcagcacaagacattaattaattagcttgagaaactcatctgctggatcgagcttctctgttaattaatggcgtcga

SEQ ID NO: 9912 - DNA, 976 bp, Oryza sativa
caatatgaatgtgggaaatgttagaatgacttacattgtgaaacggagggagtatcatcttaataactttctcggatttaatgcgtgattctctattctttcacacaagattatctatatgggcatcgagaaatgtaaatattaatgaatcgcttgtttacgaggaatgactagtagcatatttaaatagatgataagtagaatatgactattaaaagtagatggagggagtatttcacaaatctttctcgatatgtccaatatacaaaaccagctcaaactaactaaaagctttgataaaataggatcaaatgagcaagggtaaacaaggcattttgtgctatatatagttaacaccgttacctcaccttaacataatagggtcaggctatatcttcgatttttgaaaagaatggttaaataagcaaagttagtaatagagggttaaattggtagttagccttcaaaatagggtcagatgcacaattaccccttacttaaatcgtcaagtttttgtttaaaaaagagttcatttgtaacttgttaggtaccctcgaaagttttatctcttgactactattgtgacatcctagcccaattaagataatgcatgtgtggcatatgtgagctatgtgcacatatttagtactccctccgttttaggttttaagaagttttgactttagacaataaaatcaaattgcttcaactttgaccaagtttatagacaaatatagtaataattacattatcaaattagttttattaaattaataattaaatatatttttataataaatttatcttgggtaaaaaatattactatttttttctataaacttggtcaaacttaaaacagcttgactttgactaaagtcaaagcatcttataacctgaaacagagggagtaccgtcttgctagtttagcatcagtggaaccaacttataagacctattccaaccatatcactctagg

SEQ ID NO: 9913 - DNA, 1501 bp, Oryza sativa
ggtcaggccgtgggcccgttaccactgtctgaactgcagcactgcactgaaagagtgaaaggagcaagttcatttgaatctctcaaatataagttcaatctgatttgtatctctcaactctaatactgaatatttgatctcctaaccgttaatgtaatttgattttcagaacactatttacagcaatatttgttgacatgactcattgatctggtcgaaccgattaactcaacagttagcatatagggctcacatatcagcgtccccacctctctatctcccccttatctctggtccaaatggcatgtccaagctgaaagcctgaaacagctagtgaactagcttccttgaacaagtatggagaactatctcccggcgaaagtaaggagaagaactatcctaacaaagttaaagtgtattgcttgcaaacaaattttctccactaccgatgcaggggtggcatcgccggctagaaagctatgtgatctagctggatcttctctccacatgaagcacagtggagtggagtcctttctctagcttgttccatccagccctagtgcttggtgttcattcctttgacccattgcataccaaaagagaaggcatgtatggtaataagaacaaggacagcaaaaggaaaggcggcgttccagcaaaaagccaccggtatgatccaatcatagcatgcaagctggcgaccttgcaacaagcttatactggagaggtgacaataatgtacggtgaaacttaaacagatacggcattcagcgggatagtagtagtactgattaacttaatccaaagtagtagctaacaggcctagtaactagtgaaagggctggcagcttaacctcctaaagcttacaaaaagcaaaccacactacgctgctcgcaatgtgagggataccagcgatatccctccatttcaatgctaatcaagcgaaaagctgaatcatttgaatcccctttgagatattctactaaaacttcatagtgatcacaacgataaagcaagtccatgtcaaaagtttcctatcaagaaaagctcagagcaaagataaaggcgaggagaattaaagcacttttggtcttcttgccagtagcatgcctttgagcactgcattatcagttcagacaccagacgatcagaccaggtattcagggtctatgtggaggagggtatgctgcagtgttctaattggtgtacagcacgttcgaattgttagatactggtgattagtcgattaaacaactgaaggtatgatatctgagctggccagtgaaatttcaacaagactagacttagcgcggtagagttatggttttgtcatttgtggacacgctcagacagagagggagatgctgcatgtcaatttgtgagtttctgtttgtgcacgaggtggaactttaacagcaccaccgaattaaaggaactctactgcaaatgcagatcaacatgattgatcattttagaacgaggagctacacatactgcaat

SEQ ID NO: 9914 - DNA, 1501 bp, Oryza sativa
cgtaagaacaacgtggttatggccttttctggcttcctcacacgaacaacctggctcatttgtatttaagccgttgttgttttctcgctgtcacggagcccaatcagtaattgttactctcctcaaacagccagtcaaaatagtaaacctttttccaaccatttaatttcgcgtagccagtcatgcacactatacaaattttacaggtttcctattcagcgagaaaaacccagtcatctgatagacaggttcatcaattgaaacataacaatctgacgagaaatctgtgacagatacagaatgacagcgattctcgccaattgattccattcctaagattaatggatagatgaatggctagattggtgggaggctaccgtaaacatacaagagacacctaagaaggcactccgcactttgatgttgttggtcgcctgggagatatggaacgaaaggaatcgcagaaccttccaacagaatgagctttcagctacctcccttttagccaagaacaagaaagaggccaaaacttgggccttaacaggagcgagaagttttaatagctggctttcttttagttagctcggaccaaaggtcctagctcctttctttttttcttttactttataaagttccccttctctattcaataaaattggcgctcgtccattcgttcaagaaaaaaaattgagcactgtctcgagagtacacggcacgcagcaatgttgtttaagagtgtgggcattatcctcttccaaatcgtggttaaggcctggtgtcaaaaaaaaatcgaggttaaggcagtgtttagttccttcaaactacaaaaaattccgtcaaatcaaatgtttggacatatacatgaagcattaaatgtgaacgaataaaaaactaattgcacagtttgcatgtaaattacgagacgaatcttttaaagcctaattacgtcatgatttgacaatgtaatgctacggtaaatatttactaataatagattaattaggcttaataaattcgtctcgtggtttatagacgaaatctataatttattttgttattagtctacgtttaatacttcaaatatacgtcgatatatatattttggtacacgaagtaaacccggcctaagctggcgagttagggacctgacatatctatcatgttgctcgctatatatagcgcggatatctggacacagaggccacacgccgtcgagactcgagagattcaggaacagaaaccgccgagagagttcgtagcagtcaacgcgcgaggcagggccgagaagaaaccgccggcgacgcacgcgcgatggacgctcggcggaggcggttgtccccggcggtggccgtggcggcggctcttcttttcttccccatgttcttcggtgaggctgcgatttccgtctctttttttttgtttcgttttttcagttttgttttgttgcggcgctgtttgattttgctcgctcgcttctgaatcctgaaagggagccatacgc

SEQ ID NO: 9915 - DNA, 1501 bp, Oryza sativa
gaccattgacagcgacaggaacggcggcggggacgggacgccgaacttgtcagctgcatcaaccgaaatactgaatcaggtcgaatgcgcgtgtggatcatcagctagttatctagcaagttgaattggttttgcatttacccatgtagtctccgatggttcttccattggtgaacctcccggtggcgacgccgttggggtagtcgatgccgtaccaggggtagttggacttggcgagggagagcgggaagtagttgttgttccccacgtccgacatcgagtcgccgaacacgtatgtcaccgggcctttggccggtggcggcgccgcggcggcggcggctgattgggcgagcacggcaatggccacgacggcggcgagagcttgagctgccattgttgcttcggcttatcagtatctgcgcctctgtgaatgtgttgtgcacttgtgctgatgctgtgcttgtgttgcatgacgaggtggcacgcacggatttttatagcgcgcggatgtacgcggtggcgtggttaagtcgtgccattctctacaagtttgggttaatctaagcgcaccgtttcaagtttcccagcttgtcagcttgagtgcagtgatgaaccgtgcaacatatatctattcgtgtggccatctgaagaacgaattcagagaggaattggcatgtgtggtagctgaggtggttgaagaacttggctctctttgctctatagagcagctttgacggtttaaatcggtagtgggaagggtatcagcgacctttgcaatcaaatagaccatatgactgaacaagaggtttccctttttctctgaataaatttccccaaactatagaatttttaagagttctcattttttaattaaactattacagaacactatatattcaaaatgaaacttaccgatttaatatcaaacttaatactacaaactatataattaagctggagtgtcgcaaaattacaaatttagtaatcaaatcaacacataactatatgtctaggtgtcagtttaataacaaattttagatgtttataactctaacataacattagtgatggtgaattaaattctaaaacatatagtttgtgataacattattattaaatctatagttttgcaaaccttaaacatttatggtaaatttggtattaaagctgtacttaataatttgatcgaagtaatagatttcaaatttaggcactgttcttttctccaacaaaagttgaattaaattttggatactcgtggcacgcttttcaaactgctaaacggtgtgtttcgtgcgaaaactttctatatgaaaattattctaaattataagattaatctattttttaagtttgtaataattaaaactcaattaatctcacgttattatcatctcgttttgtgtgaaacacttcatcttcatcttcaggagattgcgtgaaactcctttactagtagaagctagcatctcatacccagcgtgagcctgacctgggctgg

SEQ ID NO: 9916 - DNA, 510 bp, Oryza sativa
tcctgcagccctgacaagtgggtatatatattaatagtatagtaagcaactattgtataaattgctattagattggctatatatgaattagagttattagtgggctatactattaaacttgctctaatccaacgagtctgattagaaggtgtcttaattaatataatcggcaggagctcactgtttgttaacagttcagtcaaacaccgccttgaaagtcgcttattgtagggaacctacgctcttcgcctgattgcctctaccccacattcagtcagactgtcagaggctcaaagctcaagctggagtattcattcatttcccttgaccgttgttgccttgcgccactgcgacccccgcgtctgcggctcgcagtcgcagcccgcatagaaaacaccactaccgcggccatatacttccctcgattcgacgggagaagcagataagtttttctagagcacatcacgatcacacttcacccattgagccgccggccggaaggagaggata

SEQ ID NO: 9917 - DNA, 1501 bp, Oryza sativa
cgcgaagtggacgggaactcgtctctttacttctctagccgttggatcgatcgatcagccggtcagatatacgcggacacttgccatcgcccgtccgtcaatgcctgcaaaattccaagaaaacgggttttgcaagggcaggccggcaggcattctccttccttcgtcatcttcttctccaggtctgctttaacggctctccgtccttcgcctcagcaacctagtaactgcactctcactgtgccgggggatccatgctacggtgccctttgcatgccccggcccaacggtcacatttaacaaaaaccgccggatctcatgacggcgatggccgaaatgccgtgggaccgggtcgtcagctcctctgtctctgccgtgattgatggtgtcgtagattgcaatgcacggatcgatctaaaggtctactgtgcttatggatgtttggcacgcgattaaagcctagaactacgcttgttataaggacagtatgcatgttccagattatgggcagaaatagcggcattagcgtagaacaaaaaaatagtggcattagagtaacaaactttcaacggagacgctgagcagattttatctcagtgggtaaaaatactgaaggacgagcaaggtgaaaagtgaaaacacgattgatcacggggaggagcaatgacccggcattgaaaaacaacacaccacgcagagctgtataactaatggaatgaaatgtaaaagtcgaaactctagctgtcgcttgtagtactactcgtttcaaagagcctgtttgctggagtatactactgatcagtgatcactggctgcccgtacgcccaaatctggcaattacaacttcggatagaacaatccaaggtttccaaaaggtcagacttcgtaggagtaaaatacattcccaggtactaagggggtgtttgggagagaggggctaaaccccctaaaccgcaccattatactccagctgcagtctttccagaggtccaacggccgaaacgaaccaaactaaccaaccaacctttcacagcacagtacgcctcctccgccgcaacgttcgccgcatccacgcgtcggcgcctcactggcccttgccccagcatcctaggctgttttttctccccatggtccaacggtcccacccgtcattccgtccgaacatgtctgcggccgtcacgtgcagtatttatccgccgacccgttcggctccggctcactggcatccacctcactcgcctccctggcattattaaaccccgcctcgttgccaagccgatcactctgtgcaacaccgtgcggtagcagagcaagagcagcaaaaaaaaaaaccaccacgcctcgttcagtcactcgcacgctcgctcgatcacccggccgccgcgaagcgtcgaccgaagtgtatcgcacatttcgaaagttcttcgcgggcaacagaaagcagtttgtggtgtgcattgccgatttgccattgcgttgggttcatttcttccatcggcaa

SEQ ID NO: 9918 - DNA, 1501 bp, Oryza sativa
gagatcttcccgcgctggatctggagaaacgggagttgtgaaccccgccgctgccgtcctcgcgagccgctggctttgccggcacctcgttcgggcggcggcgaggtagggggcgacggcgctgggttgcgacggcgtctcgggttgtcgccgcccgtgccgccctcacgaggaggcgacgcgggggccttgtcgggaaaatacaaattatccttacactttagacgtagaacggcggggtgaggaggggatcgaatagggcggaggagtgccgttgttggaaattgaactactctagcgagaaatggatgaccccaccccaccccctctcgtcgcagctaagttcagcccaagaaacaggagttcatgattaggagtaatcatggtgtaaatgcaagcgagagcaaagaaattatattggtttaggtaactgagaagcataaataacaccctagtgtggtgttccttttttggatttgtggtagtagtcaagagttaagagttgcttttccttattcttttttttcttggtttagatctggggtcccctttctacgtggtcatgcctctcttcttagggcatccacaatgtgccataataatgagccataagatcttatgactagccatatacattatgagcattagccatgagacattaaatgctaaaaatagccataagtttatggctcaaccttaaaaaataaaataatgagataaatcacatatgcacactaaagaggatgagaatagattatggtatggtgggacccaccttaatgtaaaatttgtttacataaacgcgggacccatcttaacatctattcttaccttaaacattgtcgtcataaacatagggtatggtgggacctaacttatttcctctaagaccttaaacattgctattaccctcacagttcatggagataccacattggccatctccttacaaatgaattcttatgcacaagggttaggtatgattattcttgtaccttattgacaagtgaacccaattcttgagtccacataggccccttttcaagccagctgagttggaggcgtgttgcacgtcctccgcgcacgtatgggatatggaaaaggcaaccggtgtacttgcggatgtttgtggtgtccactttgtcggcctcaagtaaaaggacgtgcaagggagtcattggcttggtcgggctgcatggcaaccaactattccacctaacactccacacctcttcctagaagcagtcatgatagtgcgagtggcgaccacgccagcaccatcgcatcacccgtctccctggtcgtacatcgggtggatatatgttacttcacattttttttaaaaaaaaaagctcttcacatttaatgtaaagctctattcgttgatggcaacaatagcataccacatatgaaactaagagagccttaagagttattaagatcggtggtatagttaatacgtaccaaatgtaataattaacatattttgtcaatcttatag

SEQ ID NO: 9919 - DNA, 1313 bp, Oryza sativa
ttccacaggccaattccgaattaatattcgcattgatttaaaagggtttactcttgctttgcaccggtattttcttagggtcatttataaattaaatttaggcttgggaggagaacttcggggtgtgacaccgccgccggcgaccacctggccgtgcgccgccgccccgctcgcctgggccgcccggaccccccttgtcgcgccgcgtcgatctcgtgcgccgccgccgcccatgcgtgccgcctctcccgcgccgcccgtcggtcgccgtcgccggagaccgcgctaccgccgcgccatggctcagctaggccggctttgtgccgtgctgtgccccagccgcgccgcccctggccgcccgatcggcttgggccgatccggaccgtcggttcccgtggaccggtggtggaccggcgcccttgtgccgctgaccggtggggcccgcttgccggcgccgcccctccccctttgatgacgtcagcaaccgtcttttcctttggaaaaataaataataattgcgtcataattcgttaataattctagaaatccatttaaatggctcaaaacttctaaaattcatatctaattcattcgaactccgaattgagccgttcaacttgcaaaattcatctaaaattgagctctacatgtttgtttagtttttatgtactgtttccttggtttttattagagtttttcctcgttttgcgtgccagcgtgtagttcccgtcgtttcggaagatcgcgttcgcaaggataagagttcagaagatccaagtgaagaagcaaggcaagtcacacattccctttgagcatgttgatcccaatttataaatgttttaccgtttacaaataaatatgcatgttttgctaattacatgggatccgggtattacctatctgctcgcttgtgccatgtttacttgatatctgttctttgtcaaccttagataatgaatcgactagctcatgttacttatgtgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtggctgcatggttttgctggtcgcacccatggcagttaaggaccggttcgcgggatgccttggaagaacttatcgtacttaccacaagccagcgtgggcaacggctgggcttgtagtgtagctttcctctagtcgacgcatccaggcaagggtgggcgtga

SEQ ID NO: 9920 - DNA, 1501 bp, Oryza sativa
gtgttggtgtatatttgtatgcaggtgataaacactgaggttgggaggaaatctagactaaagtgaggacaaatatgtatccatacaaggatgggttgtgaacttcatcaaaatactagaaaatcagcctaaaacactgaggattggataggggaggaccaggataggagccaggccaaaggccaggctaggggggcccagcccaggttcggccgaacccccactgttgatcccaggttttggcgtggacgctccagatcactccttgatggcggttgcggggtagttcggacatttcctcttcgctaaccgtcatacctacctctatataaagacctcactttactcacttcaatgcacacttccaagcttgagatgaattataagaggctctgttgtactatattgtatactagaataggaagagagtagagtagaagaagtcggaagaattctggagttgtcgttaatcttctctcatttctgttattctgtttattactctgaattcaatataatattcttccttagtaatttagatttgtctagtgagagttatctcttggttagttcctaaatagcatacgggatcattgttcactatagtccatttatttatagtggttgctttagtgtggttgccagtgcctgaagtatcgtgttaggatgaaccggagaaagatctgaccaaacttggaatactctataggggaagtgctacagcggtatatctatgcgcttgtggatttcatctgtgatcgtaagaaataccaacacaaccgaggcgaacctgatctccaaatttagcccctcgcacatctctctgaattcattagagttgaactacttgccattgtcggtgatgaactctttcagcacactaaaccgacagacaatggtttttcgcaagaatttctggactgctgccgaagtgatagtatggagtggttcagcttctaaccaccgagagaagtactcaatagcaacaatggcgaaccggtagccatttcgcgccatagggaacgggccaatgatgtcatgcccccaccttgcaaacgactagacaggtgcaatgggccataattcatactgaggggctgactggcttcagccatgtcgctgacagctttcgcaccttttgatctggtcaatgcatactttgagtacggttgaccaatatacacttgccgaaactcttcggatgctacggtccttgctgcctgatgggctccacacaatccttggtggatttccttcaccacttcttcgcctccggctattgatatgcaccgaagcaaatgttcactgctaaaaaaaggagacaacactatatataggtgttagaatagctaaaactgacatttataatgcttttctcacccacacgggctcccgcgggggtgccagcggcaaaagctaggacattgctattcaaataggtgtcgattcctattaaaaaatggcactttcatacgaggtagaagtgtcggttttcaataca

SEQ ID NO: 9921 - DNA, 353 bp, Oryza sativa
gcccagtgtcgccgatccccttccgaaatccggccacctcgttgctcctttttccaaattagttgcgggagtggagtcctctcaatctcctcttccttttccccaagaaatccccaaaagtttctatggaaatcctttccaatttcgtggttcaatctttcctttttccggcgaaatcctaaactttcccgagtttttcccgtcgtcgtgggctcgatccctgggctcccatggctatatatagagccccctccttctcctctttcggccgccacctctccctctctccgccgttgccggaagcactctccccgcgagctccctctctctccacctccggccgccgctccagc

SEQ ID NO: 9922 - DNA, 1501 bp, Oryza sativa
taacatgaacataatgtaaagaacgtattcatatactcggaaagtatttcaataccataaatggatatagaaaaattattctaaaataaaatacaaagcttaccaaaaagaaaaggaagccacctaaacccatacttaatttctactatattcctattccactagcttaagaatactaaactaacttgagagaatatgagagagctcttgcttgaggtgtgtgttgaagtgaatagagtgaactccttggggatggtcggtggcagttggaatggtcagaattgctctccaaccgtcattggggagtgatccacgccatccaaaataaaccctgcatccaacggtgctagggggttcggccgaattctgtatgtggcctcctccattacttcacttcttagacttgggaattttggcccaatgcattatgtcaattctgagttcttggcccattcatgcataagttggattctcgacatcgtgcgatagatttatgaaatgtgctgatatcaattcttctccactttatggttattctctgcaaaaggttagtacacccaatactagtggaatattattattctaacttgtatatgtattgcaagcataactagttctcctctattttggtaatattgacggtcgcaactgatcgataatgaccgtcaacacttgcccttgtagaaagcatgcttaagtggaccttctagtttgtttcttactatatcacttaagtttctatccttgtgttaaccagattgtcctggagcaattggacaatcgggtcacttatcatttttcctatcgttgcactaatcggattgtcctacagcagtcgaactatccaactcatctatagttggactaccggaagttgtgtcggtttgtctagttagttctaatctcgctgcaagttttgaaatatcacaaagcacccgttcacccctcctctaggcaaaattaacgattctcaagaccctttcaatatggccatctatttatataaaataccctaaatctaagagataaactaacccattccaatggaaaaatcctcttaagatagagacatgccaaccataacataactcttgttcactttaggacagagcggctcatcaccaactttgtcaaataggaaacccggaaactctaggagaagaggggaaagaagaagggcatacccaagatctaaggagagagggatagagcggtaggggtagaccgaataaggaggaccggtgagagcatctcgctggaggaggctcggtggcatcgtctgctcgcaatcgcgagatggagaagcggtggcgcaatgtatcgagctagaggaaattttcttgacctcacgattctgtgcggattgggccataaaattcccaccttgtaggcttccaaatggacaagaagatttggcccgttgaattttctcccgctggccttcctcccggggattgggctacaaaaggagccataagcgatctcgctagcccaaaatatg

SEQ ID NO: 9923 - DNA, 322 bp, Oryza sativa
taggttctatggctgtcaagtcgtatactgtaattgttcactcacttatttgatttatttatcctggaatagttaaagtacggggtttgatcatatcataaagttagcaaatcatttagccaccaatcagcttcaatgtagaagctgcagtgctgttctgaagaacttgaataataaagagctactttagcttgcaagatactattcagctatagttgcttgctaccttttctttcttgtgtggggtaacaaatattttctcttcttgctggtctgtacattttttaagcatatctgcgtgcattcctaattaattgtgatt

SEQ ID NO: 9924 - DNA, 1501 bp, Oryza sativa
tccttgccgacctttcatcgagcaccttgcactcatgtatcacacgctagtggaaaacaaagaataccggaaggcagaaacaagtgggaaggtaaaagtgaaggagactagagcttaatcagacctgcaatgcagagggcgagaagaaggttaccgtccattcaggttcagtcaacaatgaagatgggtgcaagaggagaacagtagcaaccttgagcaacggttgcgactgttgtgtcgtcagtcatgtccgtcctcgatgtatccatgaggaatggactttggtgccgcggaggtaccgttggccggacgacgatgccggtgggttgcccgaggcggagaccttcgcgccaacgatgccgacgaagaggagtcggtcttcgtggcggggacgacccatggcaacacgcaacatgaagattcgctgggaaggaggggcggtcttcgtggcgggttgaacgcacggtgtagagggcggcggcatggtattgatgcgcgatattcccgggaagaaggtgggagaaatgggagccactggatttgagagagatgattttcgtccgttggatctgatgatgatgaatgaagtatgaaggatgtaagaggtagttgatgaattatagggtagaagatagatatttttctaaattcattggtttagatgactctgttagtaccgcaaatctaaggtggatttgtattacccggaaaagagtagtcgtcaacatcatctgcttagttatgatggattactacttgtttcgtgggaatggttacattacatgccccaacaggaagaggaaaaaaaaaacagagagagagatgtgggcgggtagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacgccggcggcccgtcaggcgcggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcagttggaaagatgtaagtaatattcaaatttgtgtattatttgtattgtgtttgtgaattcaataaatattcgaaaatttgtttatgtcggtttaaattttcagaa

SEQ ID NO: 9925 - DNA, 1501 bp, Oryza sativa
cgggtggaagcggtggtcttctttttgcttccgcgcttcgccattttcgatggatcgatcgatcgatcttttgtgtcgtggatcttgttcagtttgtgttggatcctggtgtgatcgctagctagctagacctaggcgtacgtgccaactccctatataagctacagctactacgctatatatacatttcattatcaaaaccacctcttctcaactagctagctactgccgtttaacggctacttcccttctcttctttgttgcaacttcgcatgcatttgttcgcttcttttcgttcggtgttgtactaattaattaatgggcctctttcgatccatcatttccaggcccatattagctagtcgttcccttcttctttcggaaaaaagtacaccgaaggtccctcaatttgtcatcgagttacaaaatcgtcccctaaccatgaaaccagatatatggcacccctcaatttacaaaaccgttccctttagatccttaggtggtttttaccctggttttgtccgacatggcagctgaggcagcatgggacccacacaggccccacatgtcagggtgtccacgccaataccttctttctttcccctcttctctcccatcctcctctctctcacctctctgcgcaggctggctggcgagtggggaggaggccagtgggtcgggagaaggtcggtggtgcaaggagggagaggagaaggtccggcggcagcggcgacgatgacgcgggagcaggccaccacgccgagtagggagccagctggtcgatctcctctccgttgttccttccctgtcagccgcgccgaccctcttccatgcatgatgcacctggacaagaacataaaattgttatgaccagagttattagttatatacaaaaatatctgctacttctgttccaaaatgtcacaaccatttttatggagcagcacaacggtgaggtttctccagtccgcaccaccggcgccacctttctcattgctcgcggcggcctccccttcctgggcgccatggctcgactccacaactgctcacctaaatcccggtgagccctttcacctcaatcgcctcctccatccctagtccccaaatccttagtcatttgatcgattccacctaggtgaaccgccatcgcttgaacccatcttcttcctaactggccgccattggcagctcgtcgatctcgggcctttaatttgccatggctgcccaaccacatgtagcacccgcttccccctacatccccgagatacgtaggactccccatactcgccgctcggctatcgatactgtcccaacaacctcttcttctgtgtctacttctccattctaatttctgactagttcgcgcttgcttttgtattggttataacctctgtactgtgggcctgtttggtatagctccaactcctaaatttagcttcaggagttgggtctggagtggagttgtggagctgcctaaacccagctccacaactctagttca

SEQ ID NO: 9926 - DNA, 1501 bp, Oryza sativa
tctgtaggcatttagtccatgcaaagaaaattaaaagaaatagtgtttggatagatattaattggaataatttatggtaaaaaatataaagttatgtttcttctttaaagaaatcttaatagtaaatcattaatttccctaattaaaacgttagttaaggatggtgcttaattacgattatggagagtagtatcgaggcttgcaatagatgagtcccgcggggacacgtgatgcgtggaaccagcggaatagtggcgtatggcgaagtcaagcgaccgcttttgattgttgtttctcgttcgcgctacgcgaacactcgcgcatcagacgcgcccctagtagaaaccaaaaaacccacatagatattttactatactccctccccctctcttttccccctctctcaattactcccgcgtggaggagaccgccagcgccgcctcgacacctccgccggctcgacgcctctcaccctctctctcccgtgagactcggtggcggcgctggcggtggcgggcgcggcggcggcggaggaggcggggagaacggcccggcgctccctccgcccgttgctgtcgcggggtcgtcgccgagtcatctccgtcgccggtcgtcggcggggtcgtcgccagatctggtgctctgccccgccgccgactccgacctccccgccgtgccgccatcgccgacctgtccgccccgccgccgtcgccgaccttccagccgtcccagatctggtatgcaggcgccgtcgaccccgcctctctctccgactctcccgccgcacctccctctccctctcgccgccacctctcgcctctccctctcctcgccgccgccgccgccggaatctcatcactctgggggtcgagactgagaggggtggaagaggaaatcttcactctgggggtcgtcgcctcaagcacccatacccacacaacgggtttcttccaccggcgcccgggcgaaaaggagcgggggacgcgcggtccagcgaggggacggcttgcgaacggaacgagacggcgtcgaccggggggacgacccagagacacgcattagtagtctgcttgctaataaatttgttaccaaggatgagatgaactataattcaatgactgccatttaattttaatgctttctcctaatcgccttgatacagcacagaaacaaatcgtccattatgcattttagcaaggaagcttactgtcctcaagttcatacaacttgattgtgcttctacagtccgcagttccgcaatagattagttcactctttcttgactggactgtgcactaagcatgcacgaaggcttacacataggattgatagcacaccctattacgggctacattgttgattaaagttcgcttctttcgatttacgggaagatgattcctgcctgtggtacttatccacatgctacgatgattccatggttgattttcttacatgttatgtttggcctgcttctattgtatcacattttaaaaacatggcc

SEQ ID NO: 9927 - DNA, 708 bp, Oryza sativa
atttcttgtttagtttgcaaaaagcaaatttttaggtgtcacattgaacgtttgaccagatatcggaaggggtttttggacacgaatgaaaaaaactaatttcataactcgcctggaaaccgcgagacgaatttattaagcctaattaatccgccattagcacatgttgggtactgtagcacatatgactaatcatggattaattagtctcaaaagatccgtatcgcgatttccatgtaagctgtgcaattagttttttattttatctatatttaatgctccatgtatatattcaaagattcgatgtgatatttttgaggaaaaaaaaaaggaacgaaacaaggcctaattgaggatgcaagagaatcctaaaaggtaaggcagcatgcatacataggctaagcgtgtggtgtggtgatgaaatgggaagaaaggagcagagcaaaggaggcctataaatagatagcaaagcaacgcaaagggggcagaaggcaacacaggaggaggaggagcttggtttctgggttgggttgggtttggttgcgttgcggcccatccatcgcattcgcgttcgcaggcacaaaccaaacacctcccctcaaatttctctttcttgtctcttctccctttccgcctcgcctcgcctcgctgcctgcgcttcacaaatcacaaatcggaatcagatccaccacgacacggcggcggcaa

SEQ ID NO: 9928 - DNA, 1501 bp, Oryza sativa
acaaagggagcaatagatgtgctggtttatagttggatcagaaattgggtcaaatgatatacattaattcatatagcactatcacataggcactacaatgagaacaaggactatttgtagtatgcagtagtggtttaaatggtttaaatggcgtgatggtggtctaaaagtatatgggcattgggcaagactgttgtcaccatcatttccaaagttttgaaaaaaaaagataaacttttgcttagatagatttcaaaatagaaaaaaaaaacagaacatgatgtgcagctgtcgaataaaagaaaaaaggtacacggaatatagctttagcgaaaatagcagctccattgtttggtcttcagtcatagccaaaatttgagtcttaaaacttagttttaaagttacttttggtgtttttttattgtagtctatttttcagtattagtttataagccgctaaaaacacaagtataaaaagttttatttataattattaatattatttgttaataagcgttatgatttataattagatgtctatcccatgacaaagttaaaatctcgctgaccttttttttactgaggatctttcatgagaaaagaacaatgatgcatgcattcatccaggggaaaggaagaacacaagcagcatagcaacagtagattgactatagttgagcacaacagtaagctgttgataaccaagagaagaatctacactgcactccacttgtcttgtgctatgttgccaatgtgtgcactgtgaagaagaagcactcaccaaacttgtccactcctccactcccagcaatagtatttatggtggcccctcaccagcacaggggcgcggatcaggaaagattaacaggagggtctgaataaaatatataaaattatagccacctcttctaatagatgtatgacagaaaattttagtgaggtcttcgtgaggtcttccatgattacaacataggtagtggggtcgtagtgaggtctcgagaccctagagatcccacggtggatccgccactgccagcacatcacctgatttgcactgcactgctcttgctttccccctcctgttgaagttgcagagtacagcagcagcagcagcatatctatctacctattccttcttactcctcactttatactccacttatttgtcaaatctttatttttctactatactatttctcttttcaagggaaaagaaaagaaagaagaatatatgttgagcagtgagagagatttggaggtataaagagacagacaccaacctcctccatcttcaatcccttccttccttccattttattttcttttattttcccaacaaagagaaaagagggtgaggagcctccatccgcgaaaagcaactccacccgacaacctgccccatgcactttccgttattctcatttcacccctcgcaattttacactccgccccccatgccctctcaaaactaattacaatccagtccttcaccggtcagcga

SEQ ID NO: 9929 - DNA, 1501 bp, Oryza sativa
ggggccaatgtgcttggatcaacctgtcaaaagcctgaccacactttaaaatactatctttgtgtgcctatatcaagtagccctttgaatcgcacgaatgaaaaacggaaaaatacagcattctgataggaacgtaggtgtaaatcagatgattgcaaaacgcggaaaaacacaggaatggtcgtttgattggaccccaaaaaaaacacatgaatcggatgagaaagataaactcaaggaaaatttttcaagagattgaagctcttgccagtggcggaccctctcttgtggcatgctgtggcactggccatagctatgccatgcaaggattgaagagtatttatgcatttggccattagcatgttgatttatgtgctgattaattggttatttgatttgataaaagtttgtttaattcaggatgtagggatttcgtagaactgccttatgtctgaaaagaagactaacacaacccgtaaaaaataagtatgctgctttagtaaatttccactagtttattgcttttttccttgagcagaattattgattggactgaccatccaaaggtctggccataaacagagcacatatgtaaaatggacgcacactcttgtgaaaattatttcactcgtgaaatttacattacaaatttaggactattgtcgttaacgttttatttagtgtgtcgtatattcaatgagtgcaatttgcagtatagttcgtgtaaaaaaaattataaacaaacgtagtcctatcatattgatccgccatagctaaaatttggtgttggttccgccactggctcttgctatgttttctctaaaatctccattggattgcctatgttatagatatcgtaaaacatatgataggatttaatcatttgttttgaaagccttcatagaaaatttttctatagaattgaaatccttcgaaaccgctatgttttttctacaaatcaaaagcgaagatacgttttcacaggggaggttatgttggcgtttttctcccttcaattgtagaaacttcaaacaaagttagggcgttaattaaccgtgccaatgccggtcagcgactgctcctactagcagttgcaccaacgtatatactgggtccaggtatatttgagctaagctggcggtataataataacaaacatagttagagaaagctatcgtataaacttacagatatctccacatgggagccgtgcagccagctaggtaattaatctgcagaaagcactaattaatcctagcatatcatctcgcatgatcatcgatgcatgcatagagatatctcaaggcacacgtactccactaatccactctataaatagcgaagcacgtaccacgaatccctcagctcgtaccagtcgtcgtcctaagcaagaagaagctaagctagctagctgtgatcggagaggtatacagtgatcagtttgattgtgaatttgtgatcgccatggctgcagcttcgtctactacgactcgtttttgcc

SEQ ID NO: 9930 - DNA, 1501 bp, Oryza sativa
ctaagctgtgtttggaggtgggtgttgggaacccatatcccatacacggaaaacggagcggtccattaacgggtgattgattaaatgttatcttttttttttgaaaatggatcaatatgatttttttaaacaacttttgtatagaaacttttttaaaaaacaaaccgtttagcaatttgaaaagcgtacacacggaaaacgagagaggagggttgggaacttgctcttgcaaacacacccctaatctcttgggaaatatgaaaggtgtgaaaccagagaatcttttgaaacaagaagctatcccccgtggatcttgttgtgaaaattaaggaatcaagatatcttggacactggcgggaaccaaacgtctaactgagatgatgccatagaaggccgctttatccgtaaatatctccttgtttttattttacctataaataacactcctatactcaatgaatggacacgttgtctttcgttaaaaaaaatctggtgtgcaactgggaattaggaattagcctgtcatttccagccaaatcggtagcatcgtttaatgacaaaaattgacctgaccgtcagaatcagtaactatgtgctaatttattaaatcacgtacagcttttcacagaccaaagccctcctgaacttttctaacgaggaaaagtaatagacctaattaactactagtggtgtaatttaattatactgtgctgtagttaagttttcctttccatcatgtcatgacgtgtgtgatttttactctggtttactggctactgctgtcatattatatcactatcgtattgtcataccttgatgcggtgtatcttccagaaaagaagaaattagatgatcacttcgacgacaagcttcgtcttgatcttttctttttggaggaaaaaagagagcaagttttgtcttgctgatccaatcaacatcggaatcacgaaagttatttctactccaatccatagtacaagataccgcagcaagtccggggaaaaaaaaacaacggtggcagagatgtagggatgaaagcaatgattcattacaaggttaacaccataaataaaaggcagtagcaaaaaaaaaaaaaaaccaccatcacacaccaacaacatctatacaaaactcagaaaaatactagcatcggaccgatcaccgctaaatgcgaccggctgccactagaccaacaaaaaaaagccacaaaccgaaccggccaaaaccaaaatctgacagcaagcactgcactcaactctaggtgagagagaagatggaaccgctctcccccacaaggcctgccaacatcaccaatttgcattaggtagggcgttgccgtaagaagacaaacatttagagagagcacacacaagctgcctaagagaggtttttgaggggggacctcctgacgacgtcttcaagtagaaaaacgacgatgatcaccaactcctcccgctaccgccgccgccgccacccttgccagccccagattcgggcgcac

SEQ ID NO: 9931 - DNA, 1501 bp, Oryza sativa
cttgtagtcttttgtcgacatgggtagaaaaattccaagctcgtggattgagcctgctgacccctagctagtactgtcagagctagcaagtgaaaaaaatgtgtaactaaactcagggaaaggttaaggacctaatatgttttatgtgtgtggcccacatagttaaaaaaaaaaatctgaaaaatacttaataacataaattatatggccccttattcacttaaaaagaacatgtgagactataagaattcaatctacggagaaaaagaatctggttgtgtcttatgagcaactctatatatacaatggcgaatcatctctttattttctgcagaaaaagtatttttccctccgtctcaaaatagttttcttgttagattgtttagtatagattaagatttgagaaaaagagatagcaatgtcccttactaaatgatttatagttgggagtgagaccgcgagaggatggttgggggagtatgtcaaatttgagtagaatgttagtaattctcttatttaaattcaaaatttgaaacttcctgccctcgctcctagctcaccatacaacaagaccaaatttctcccaattttgtgttactacaaaatttgtctttttgtgaactgcaacacatggtatagatttaacctaccactccacaggagtcatacctccttcaaaacgtgggaattttcttgagaatgattcctgtaaatgtcttataaaacagatctactccatgccatttagtttcattagtttaatgatttaccatcgactttgtttctttctataatatgcttcaagtttatcattcatttctataatatgccattaagtcgtagcgttggcacatgcatattactagtatatataagagttgacaattgattgaccccactacatgattcaaaaagttttgaaaacttttgtctagcctcttagcacgtcatagaagtttgtataagtttcacaatttttgcgttactatttattttataaaacattatttgtttgttatatgttaatacttttgctgttgttcctttttaatgtaaatcatctttaatatgctacacaaaatagttttgtgctattatatatctttaatttgttgtaagcgattcctttctcatatgccacaaaagatatcttgtagaaaacatgaatgacatcatgaaacataaaaacttcaatgttgtgtaaggaggttaagaaaaccataagtttttgaaacttctaatagaataaattaattctcaatcttatagatctataaggatgttttgggtattatggaaaactatccatctcaatggcatattaaaattgttgaaaattcagtggcattatagaaagagatagtatgaatggcacaccattgagccggtacaaacttactagaaaaaaatcattttactccccaaaactttcaaaatattttcagttttttccatgactttgcttgaaaacctcaatgtttaaatcagtctcatcgcttcg

SEQ ID NO: 9932 - DNA, 1501 bp, Oryza sativa
gcagcaacatacaccatacaatagcagccacatacaccaccaagttcaactacactaacaccagccatcaaattccaagctcatccacctcattcctgccatcaaaaggtgcatgttttcagttgctggtgaataaaaagtccattttgtttggacttggaggcaaacaaatgaataaacagtgtttaaagagtaataatccagcaagtaaattgagtaataagtatcttgatatgcctcttttccggcaagtccaaacaaatggatcttttctactcacaactaaatccaaacaaatggctcttttgcagctaataatccagaaaaaatagagtatctagatcaattaatcaaatgactcttttccagtcacactaaacaatatctaatttcacagtaacaacaactataaacaatccagcaagtaaattgaaataggcagagtaataggcaattttgatacacaccatgaacaaaaaattcagccaccaatgaaacagtacctgaggatacaagtgcacaagagacaagttaaagctttgtacctgagcatacaactagcttagggaggactgatctgaccctgtccaaatgctatcatttgtcgaaggaggctctgagtatctgctgccatcttcctcaggctctcaatctcctcagcttgtttttccactttcgcatcagattcttgtgcctgcgccttcaatctttcaagctcctcctgaaagtactgcagactctagcttctttgcatctagttcagcttgtatctctttcatcacattggttgtcttggcagcgggctgctgaattccgacgttgcgcaaaaatgtgtttgacttcggcaacactttggaaacagcttcaatagaagtcttagcttgctgcccatcttctactgatggtgaagtgagggcttcccaggtatgcatatcctcctagcaatcaaagtagtttcagttttgcattattatataaataaaggttcattgcataaggtatttaataaaagaaggaaagaagaggtaatagcttagtacttactatagctttcttcacaggttcactaaaacctttagttttgctacaatgcaactccttaaagagatcaattgcagtgggctcactgtctttgtatttttcttgcttctgcaatgttgagagatggcatgagtaatggttatgttaaagtacatagataacacaaaaacatgtcctccagaacaagcattccagttgacattgagtctttttgttaaacattgacagtggttgccatgtataaacttaattgatgtcaccccaaataagtataagcatgacaagagcaatcaaaccaaattgatacagatttatggataaaacatgagcatatttttacgtggtcaaagtgtgagataatatgctactctccctactaaagctttaaatcatatagcattatgcagagccactatcaatatgcagatatatatctccactggatctgaacacctccatc

SEQ ID NO: 9933 - DNA, 1501 bp, Oryza sativa
ctcttccagcataagtctgttcttcctccctcgcgttgtcagcttcctgtagctcacccagcaacgtcaggttcctgacacgttgcaatcccgtagattcttctgttgatttcaatcaaaagttcttctatccccatcgttctcacgttgggaatttggaaaatgtcccgttacaggctcggtcagacactcggactgggctcctcttctctctgcgttcatcgcacatatgtgactaacgaaggatgacagatggaagaatatggtagaaacattttctgaatccccatttcaacacaaaggtactgtttttaataactatttaaattatatgtattgaacgggtggacatccacgtgattaaaataactctccgcacttggggctctccccgattttggcctacgtgacgactgagtcagtgtgggactcatgtgggccccacatgtcagcatgccacgtcatcaccatctctctttcctttcgtcctctttctctctgtctcacttttcctctctctgggctggcgataggcgacgcggcggcggcggcggcgacgcaggagcagggaaagaggaggccagcagggcgacctccccatcccgacagccaacgcctcgctcttcttcacctacgacgaggccacgcacccgctcacgctgccggcctcctctgtttgtgtttggtgaatggtgtttgatcggcgttggtgtttggtggatgtcgtgcaggtcgagcagatgcgcgcagggctggagaaagcgcaacagcgacacgtccgggcgctggcggcggccatggcgcgccggtgcgccacgacgggtagggtgcgtgcggcggaggccaagctggatcgcgagtgctgctacaacgcggagctggaggagaagctccgccggatgagcgcggaggagcatgcgtggatgggtgtcgccgccggcctccgcgccacgctcaactagctcctccagtccccttgtgccgtcgccgccgccgcgggggagggcaacgccgaggacgcgcagtcgtgatgcttcgagaccccaggcggcgccgccgccgccgctgccgccgacgccgacgcgatgtccggggcgacatcgtggaaggcctgccgtgtcgcggaggcgtccgtgctgctgctcccgtgccgccacctgtgcctgtgtggcgcctgcgaggctaccgccgacgcttgccccgtctgtgccgccaccaagaacgcctccgtccatgtcctctcctgaagtcactcacacgtgccacaccagccactgcatggagtatgagatttcgatagcgtaacagctatggccagaccgaaaccaggcaccgtcagccaactccagcgtcaagcaagctaacaacaatcatcctgtcccaagttacatggaaattcacactagggaagccacggttcagtgcatcagtgatctccaggccatgcgagttttgtcggtggaaacaatagtgttcggtgcggtgaatttatagatggcca

SEQ ID NO: 9934 - DNA, 1501 bp, Oryza sativa
gaggtttctcgtaagtgcccgtggttgacgtctcgttctagatctcgctaacccagttgagggagccgaagcttttgcggaattagtcaccgaagcaacaattcccacctcttccgggaaaaaattttgcagcaaaatccaggaaatgagagaacggcaaggctctgataccagattgttagaaccctaactcaactgctcaagaactagtaagaacaagcaagaaacgagatagtttcaccgaatccagcaggattggtatcgccgccgccttcgcctccagttcttacttcatcgatacgaaagaaagtcagggtgctctgttcttattacaattcaactctctctctctctctccctctcttactccagacttactcgtgggctcggttggtactcatttggtccaatccggcccacacacacgcgtgttacacttacgaactcttgctcctcttccagcataagtctgttcttcctccctcgcgttgtcagcttcctgtagctcacccagcaacgtcaggttcctgacacgttgcaatcccgtagattcttctgttgatttcaatcaaaagttcttctatccccatcgttctcacgttgggaatttggaaaatgtcccgttacaggctcggtcagacactcggactgggctcctcttctctctgcgttcatcgcacatatgtgactaacgaaggatgacagatggaagaatatggtagaaacattttctgaatccccatttcaacacaaaggtactgtttttaataactatttaaattatatgtattgaacgggtggacatccacgtgattaaaataactctccgcacttggggctctccccgattttggcctacgtgacgactgagtcagtgtgggactcatgtgggccccacatgtcagcatgccacgtcatcaccatctctctttcctttcgtcctctttctctctgtctcacttttcctctctctgggctggcgataggcgacgcggcggcggcggcggcgacgcaggagcagggaaagaggaggccagcagggcgacctccccatcccgacagccaacgcctcgctcttcttcacctacgacgaggccacgcacccgctcacgctgccggcctcctctgtttgtgtttggtgaatggtgtttgatcggcgttggtgtttggtggatgtcgtgcaggtcgagcagatgcgcgcagggctggagaaagcgcaacagcgacacgtccgggcgctggcggcggccatggcgcgccggtgcgccacgacgggtagggtgcgtgcggcggaggccaagctggatcgcgagtgctgctacaacgcggagctggaggagaagctccgccggatgagcgcggaggagcatgcgtggatgggtgtcgccgccggcctccgcgccacgctcaactagctcctccagtccccttgtgccgtcgccgccgccgcgggggagggcaacgccgaggacgcgcagtcgtgatgcttcgagaccccagg

SEQ ID NO: 9935 - DNA, 1501 bp, Oryza sativa
ggcggcgtgctagcatgcggaggccggcgaagcggagcggcggtggcggcaagcgggcgagcgtgcggcgaccgacagatggggaacgcgccgggatgtcgtcgacagtggcaaccggcggggagaagaggcgccgggacgggtggtggccgatggggagaacgaccgacgagcgggcggggagacgaggcggcgtgcgtgccgacccgggctgccaaatcttgctatcaaatatttgaagcaacagtacctgtggcatatgagatcgacaatcaaccattcaatccacctataaatggccatatggcccaaggcccacggcctggcccaaagctcgcaaatttggcccggcccaagcacggcatgacccgactggggtcgtgcccatgccggcccggcccgacaaccgggccatgcctgggttgcacccttggcatggtgggccagcccagcactgctcgatcaaataaaaaaaatatagggatgcaaaatagacttaaataatcgtataaggcaaggcccaagacaagaggtacacaaaatagacttatgttccagccatttaaacatagccgacagagttgagggaccaaaaatagactttttctgtgaggaagcacgatgggccacgtaacttcggcacggcccgagtagtattgggccatgcctgggccttgtatgccacccatgggctggcacggcacggcccggtgtatcggtcgggccgtgccggctcgacaagcctcggcccaggcacggccaggcttgggccgtgccgtgccgggcggcccagatggccatctataaattcaccgcaccgaacactattgtttccaccgacaaaactcgcatggcctggagatcactgatgcactgaaccgtggcttccctagtgtgaatttccatgtaacttgggacaggatgattgttgttagcttgcttgacgctggagttggctgacggtgcctggtttcggtctggccatagctgttacgctatcgaaatctcatactccatgcagtggctggtgtggcacgtgtgagtgacttcaggagaggacatggacggaggcgttcttggtggcggcacagacggggcaagcgtcggcggtagcctcgcaggcgccacacaggcacaggtggcggcacgggagcagcagcacggacgcctccgcgacacggcaggccttccacgatgtcgccccggacatcgcgtcggcgtcggcggcagcggcggcggcggcgccgcctggggtctcgaagcatcacgactgcgcgtcctcggcgttgccctcccccgcggcggcggcgacggcacaaggggactggaggagctagttgagcgtggcgcggaggccggcggcgacacccatccacgcatgctcctccgcgctcatccggcggagcttctcctccagctccgcgttgtagcagcactcgcgatccagcttggcctccgccgcacgcaccctacccgtcgtggcgcaccggcgcgccatggc

SEQ ID NO: 9936 - DNA, 1501 bp, Oryza sativa
gcagcaaatatgcaagtgcacgggataacaaaggatggcataatatagtctcatttgcataaatagcatttaataaacatttcagaatttcataaaacagtaaagtatttcattaaacagtattaatccaacgctatacaacaaaccctgttgcataggcccaaccattgtgaacaaccaatcccggctgcacagttctatctccaaaccaggaatatatcattccaaaccaggagctaaacaaattattaacatcatcatttattatggtgtgaaatatgagactaatcacgaaagacattgttagacccgcccattaccgcgggcacagctattcgaatagtttaaactctggccagaggtgtaccactgtacccacaagacacaacctcaacatcatgtcaaccatgcgtcgcgatacttaacaagtacccgaatagagattgtgacaataccctctatataacacaattcaaagcagtgcaccattcccggatcataatcacccccttgcaaacaaggcatggactccccagcgacccccgtgggcttatcttcgccacttcacagtctggtgctctacaatgaaccatactatacagaaagtaaagccgttgcccacgctggcttgtggttggcacggtaaatgtttcacaaccgaaaatcgtgaaccggtccttaattgtcatgagcacgaccatcaataccatgtgctcacatcccaccattatcaggttttagttggcaaattaattaattaaccaatcatgattaaccatcatgagctatcattaagccatcattcaataatagtgaatcataagttatcccatttatatgagctagtgtctctaagcatggctaagcatcctattcactttagctaaaaccatataatgttctagctaatcaaattattaacaaagtgacaaagaatagggaaccaatagcaaaagggctataacaaggcaataggttctttccacccaatgacatttaaaaataaatgcagtagttgaatagaaacaatagctttaaacgggatcaacatgctcaaaggattgttttgggatctgtgtgacttgccttgctggccttggaactcttcaaaatcttctcctgcaaacacagactctccgggaacgtcggaatctaaacagaaaagagcaaaatcaccaaaacagcacataaacaagcatgaacagtacatgtggatatttttaacatgtagatctcaattttagaaaaatttagagacttgaaccaactaaatccgaactaagatgacttagttatgaattttcaaagattaaatcggattaaatcctttatatagattttaattgaattatgacgcaataaagaattatttttgaaaaggaaaagaggattattgcatcagcgggctcggctcacggaacgaacggccgagatctatcctatccacaacggacggccgggatctatcggcccacgaccggtccacgggacacagcgacga

SEQ ID NO: 9937 - DNA, 1370 bp, Oryza sativa
agtccatgcgttgtttgcaagggggtgattatgatccaggaacggtgcactgctttgaattgtgttattagaaggtattgtcacaatctctatttcggtacttgttaagtatcgcgacgcatggttgacatgatgttgaggttgtgtcttgtgggtacagtggtacacctttggccagagttaaactattcgaataccgtgcccgcggtaatgggcgggtctaacaatgtctttcgtgattagtctcatatttcacaccataataaatgatgatgttaataatttgtttagctcctggtttggaatgatatattcctggtttggagatagaactgtgcagccgggattggttgttcacaatggttgggcctatgcaacagggtctgttgtatagcgttggattaatactgtttaattaaatactttactgttttatgaaattctgaaatgtttattaaatgctatttatgcaaatgagactatattatgccatcctttgttatcccgtgcacttgcatatttgctgcgtggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacatctgtaatgacattttattcgcttattaattagagtaataattgtactctattatcaatttgttattgtgtgcctcggctgattcctggacgagggttcacacatgtaagcgtttggaattttggatagaaattccgggcgtgacaagttggtatcagagcctccttgaccctaggttatgccaaatggttacccatacaagccctctaaaaatattggaaaagtagaactgttctcctccctttctcttttaattaaaccaaactaatggcacatgcagtttataattcctttaattgttctcatttaaaatttatttattattcctgtgttatcagtaccgtacatctattactgtactaatggcccatttaccagcaaagcgttttacaacattgttttatttaatcttgctgcaatgaaataaatttagcatgttgattttataaccctctttttttttttttgaaacctgttgttcaaaagtgcaaaatttgtgatcctgtttccaactgtttcaacttatcttgcaagcttggtttactttatttatttaccttttactttgattttctaactttattcaaattaacccaaaaacttgtgctattaacgggataaatgacttaattccctcctttcacttgtcttaga

SEQ ID NO: 9938 - DNA, 1501 bp, Oryza sativa
cactctaccttatattatatttaacccctacttaggctctgacaattataagtaatatatgtataaagtgcattagtaaagttcactcttattgtcttcccttgggattaaaaatacgataccttgaaatacttccgagtgaaatgctacaatggtatatccgtgcgcttgcggattaattctgtaaccataaatatatcaggcccatttctaacgacattgctggaatgaatatttctagcaatgttgttaagaaataccaacaccccctccccccctcctctaacactatagttacttctgaaagtgcatctaggcccctagtgtgttagtctattttggatgattcataacccgaccaaataagggcctaacatgaatgtatgacgacccctacaaatgcaaacaaggctaaatgactaaagaagtttaaatttattttttatttcaaattgagtcataggaaaagctgcatattatgagggtttcaagtcaatatcaacatttgtgtctccatacgctcaatattccttcagtctttagagagaaggtgacattgcgcaacgcccgcatgggaaaataggcttagtatagcttccagatccaaagttccatcaattgcaatcaggacctccaatcaaagctctctatatgttgaggaagggcgatcagaagttcctcgatggacatcatacaaagtctggattggtgctcctcatcaagacagagagggttgatcgaacgattcaatggatgccacggattagaagttctaatatgcctgattagaccctttgacattcaaatttattgtcagtaacgactaattttagtgtaggtcaagtatttaatagttaccacccctctttggatggcttgttgtttgacctatcagacctacttccttagcctccattaggattaacacgaaatccaccttctatcttgagcatctcttgtgagtttggagtgggatttggggatttgagctactcagagctaggtattgcatcttgagcacttctggatcgccatttgaccttcatctgtcagcttgttactcttcaaggttctcctcctcactgactaggcgtcaccctcaagctatttctcttttgcatagcccacaaaagtttgtgagtaagttactccacatttaaaaggaaatggaatacctggtgaatggatatgagttggttgctaggaggttgatttggtagagcaagctgcaccggagattggtacctagccctagctccatcttccttcgccttgtaaatgaacctccctgccccgccgcccccttcagccacctcaaagtgtcgctgccccgttcggccatttctcctgagtctcctcccgtaagagcatgactgaatgcaccggcgaagcaaccaaatccaccatcgcaaccaccggtatacattgctaatagttgctattatgtgatgtatgctccatctagtttgagataatgtgattgaaagagtcttgaggattg

SEQ ID NO: 9939 - DNA, 642 bp, Oryza sativa
aaatttgcacgttgtaatcatgcaaattaatacagaatattttggtactatgtatatacctaccatcctactatttcataaatatcagcaccaacttaatctacatcggtagaatatacatagcacacgaggcttatatacctacatctataaatagataggcatatacccaactagatttatatacttacatctacatgtatctaattacatctagccaagctacctagctagtgtataaaaaaacttaactaaaaggcctagctagcttcaaattcagttcaagaaaaaaaaagctacttgaaaattaaacttttttgacgcgcatttggaagggaacggcgtcggtattctctacagtccaactgtcggggccaacctcgtctccgagtcttttgcattcgcttatttatggcaattgtatttattaattaggattttaatgtcggtttaaattaaagacatggtatgagtcctccatgtggacttgtttgttgtttttatctttaggaaagtttgagtcatatccataatagacaagttttgtactctaggtataaatataaacccaagatcattataaaacaggacaaacttccaataaatacaactttcggcgcatcgccacctttttctttaagt

SEQ ID NO: 9940 - DNA, 1027 bp, Oryza sativa
ccacccgtcgacagggtggtaactattaaatatttgacctacactaaaattagtccttactgacaataaatttaaatgtcaaagggtctaatcaggcatattagaacttctaatccatggcctccattgttcgatcaaccctctctgtcttgacgaggagcaccaatcgagactttgtatgatgtccatcgaggaacttctgatcgccctccctcaatatatacagaactttgattggaggtcctgattgcaattgatggaactttggatctggaagctatactaagcctattttcccatgcaggtgttgtgcaatgtcgccttctatctaaaaaccaaaggaatattgagcgtgtggagacacaaatgttgatattgacttcaaaccctcataatatgcagcttttcctatgactcaatttgaaataaaaaataaatttaaacttcttgagtcttttagccttgcttgcatttgtaggggtcatcatacattcacgttagtcccttatttggtcgtcttatgaatcaaacaaaatatacttacacactaggggcctagatgcactttcagaagtaactatagtattaggggaggggggagggggtgttggtatttcttaacaacattactagaaaatattcattccaccaatggcgtcatagatggtcatggtatatttatggttacagaattaatccgcaagcgcacggatataccattgtagtatttcacccggaagtattcccagatatcgtatttttaatcccaagggaagataataagagtgaactttactaatgcactttatacatatattaactataattgtcagagcctaagcaggggttaaatctaatacaagggtagagtgacacgaagcaaagctattcaatcctcataacaaaataattctaactaagtggacgaagaaatagaaagcactcaattcctatacttctagtatacactcaaatcctaacttacatctgctaatgtacaattgtgtggccaataacccctaacagt

SEQ ID NO: 9941 - DNA, 1501 bp, Oryza sativa
caatttggaaaagtaaatataagataactaccgattcacctattggcaaaggactcaccattttaagtccggtgagcagggcttttctccatcatgttcaatttcccatcgcggcatccgactccagagatgatgagatggatgactgttgttctttcaatcgccacaccttcttggtcttcttttgttttaccgatgtggtcgattcaacggacttcagggactgtgacttgggtcgtgcctgttggtatttgttacggtcacagataataaatccacaagcgcacgaataccgatgtagcactttaagtcagagtattctaagggtatcgaatcataaggaacgtgtgtgtataatttaagaacaggattcatccaagcacaacaactaaatggtagggttaggatagagaggattcctatgggttaattaacttatttaagttaaggtaaaactttatcaattgcttcggtcaccggctctcccctggtccgccaagttgagtccgatttgtagctttatgatatacccgaacatggaagaacacgaaggatgtacagggctatcaccatctgccacctacctctactttgcgtggagcacacaataaacaaaggtaacctctaacctagacatcacgtctatattattgattactactctagcctcggccaagaacttccttctttatctagagtcttagtaccagagcactcaatataaatactaaccgacgaacccgcaacaatgagaatctatcttacttaaacaagaaaactaaatacccaaaagaaatcacaaatacttatataaaagaagcatctgtcgaggtataagatcggagagagggccgacaactccggtgctcctctaggactccttaggaaataggccaacatctctggaacatctcaaagagaactccgatatttggggcactaattctggaacttcccctatctctcttcctatattctaactctactatcgagtagcctagatatgaaagtgagttgcactccacttgttgtgttgtgctttgagagtgaagtgagaactcattttaaaggcagcaatgatggttactatggcggttatgaggtcggttcacccacaaccaccacagggaaccaatccccatcctccacgtgaaaggtagggatgagtggctgcaaaggtggttcggccgaccccctggcaccgccatttcccctctccttcggctggatcaccgtccaatgggcctttatgactgtgcacagtggttagcctattttgaggtgatttggtcagcttgtgggccctccaatacgtgtactcgcgtctgattggccggatgtgtgtttcttcgcatggctggtggttttcatataaaatccctgcatacacatatttcaccaatacctgtggaaatgattagtaataaccattaccacaaagtttgatgtattatttcaattgcttgtatgcaggaattaatggtcggatttggtatttagg

SEQ ID NO: 9942 - DNA, 1171 bp, Oryza sativa
tcgtgtaatcttcctttgatgcacggatttcctagatttttgcaattcacaccattgacagctttcttttcagaaggagagagagagagagagagagaatgatccacgtgaatgttccatgaaacttcagccgttgcacagcagtacctcactactgagtcaatgtggagcagggaagcattaggtgcgtttgattccctgtatttcaacctggcctaaatggaccgtttattggaggagatcaacctccaagccgcctaccgcgtccgcgtggagattggagagaagatcgacacggttttggctttggaaaattgaagcggaaccgtctctagatgcttcttttttttttttttgacaactgatacttttcagatgaagctttcgtttcaatttcccgagaaaacacctaagtatatatcccaatggaatttagcatgaagccccatattcgtaatatttttctattgattttagtgggttcaaacaaaatgggcaaataaaaaacgaaactgttggggatgtgcgagacttaccacatatgtgccgactgttgattgacaactgtagattcgatggagaccgcatctgcatctctacgaacacgatctctcccggtgcggcatttcgccgaacacctctgcgtcgctccctgtcatgggcctgggcctgtcaagtgagctatgttgattgggctggcttgaggctgaggggaggcaaaggatacactataaaaggaaagaagcaacaggcatgaaggggatcgatgaatagaacttgtggctgctgcctcttcttcctcctcctcctccggatttctttcccactcctgctgttcttccaatctcaaactctgcttctctaataccagtcccttgcttccctttctagtcttcactcctatattccttgcaattgtatcccaattacttgagtgatttctactgtggatcgttggttccttcctgtgttgatattgatctgtgaatgagttgacggatcgtgacaatatggtatcaaagcagtcgattcgtggggtttcttgtgtggagatgaagtgggagagcgctggtggtcagaggaacagccaacaacttggtggtggtgtctttggaggagatgcccaccacctgttcgatgaaatgtcgagctgtccaagagctgactcagc

SEQ ID NO: 9943 - DNA, 1501 bp, Oryza sativa
ccagtggtgtattttggctagttggatggcttagggtgtgtttgggtgtattttggctagttggatggcttagggtgtgtttggatgggaggatttgggtggataggacatggcagcccgtttttttaggtgtttggttggtgggcggagacgggatatggcggcccggaggagaatattctcctcacatgccggatggctggctctagccaaatcacccggatgcagccgcccgagcgaccggacgagtggggcgagcggtcgcgtcacctccatggagagagagggggcgacgacgatgacgatgcgagccggctgatgacgacaatgccgatgagtgcctagtgatggcgacgatgatgcgctgcggccggtgtgggtggcgagcgccccgtcggcgggaggagggagtggcggtgagctcggagatccggcgcgggagatgagcaccgcggcgacgacgatgacgatgtgagcccggccggtgaacggtgacgatgcgaacccggtgacaacaacgacgatgcgggcggcgagtgccacatcggcgggaggaagcgagcaacagcagctagtgggaggaggagtaggcggcggcgctgagcccctagatccaccctgcttttttcttttctttttttccttttttctttttcttttttcttttttctatgtgtatttataatggaggtagtggtgtaaaattgttggagaatttatgatttgtgttatgtattaatttgatgggggtatattcaccgtctcaagtgagaggtgactacacctgcaaatccaccctacttcctccaaccaaacaaaaaattgcatcaccagatctaccttcatccctataaccaaataaaaaaaactggatcgtcatattcacttaaaaaaaaaaagatcgccatatccaataaaatatgaactgtgatatcccatccaaccttccatgaaccaaacgcatacttatagagccagttggagagtattttttctcacatttgctcaattttggcttggagtggtttggcaattctgacgaagatgctctcacgaaactgcagggaagcagctagccaaactaatcaccgcgtcgtgaaagctcacccgcggagtggacagaggaatattccgttacagtatagtaccacgctctccttgaacatgaatcatatccgttcaattgtgatccaagaacacgggtttagacctagggtataaagttttgacgtatcacatcagatattatataggatgtcgcatagggtgttggggcactaataaaaaattaattacagtacccatcagtaaatcgcgagacgaatttattaagactaattaatctgtcattagcacatgtttactgtagcaccacattatcaaatcatggagcaattagacttaaaagattcgtctcgcaaagtagtcgcaatctgtgtaattagttatttttttagtctatatttaatactttatgtaggtgttcaaatgttcaatgtga

SEQ ID NO: 9944 - DNA, 1501 bp, Oryza sativa
tattgctgtatttatatttgttactatcttttgtttttcagataataaaattcagccagctttgcttgcttcgtcgtacgtgtatgctcatcatatcctcatccatcagctgctcatagctagctgggccgtgttatatgtgtgtagtgaccagtcacaaccatgtatttcatcccatgtatgttagtttgtttttcatttttgaaagaaaacatgcatatatgttataactcaaagttttgagatgaatttgatcatctaatttatttctgttttgaattattctgctctgttgttgcaaacttttttttttatgttgggacactttctcctcggtttgattgttatattgaattcgtcgattccagctagtatatatttgctagtttcactcagacaatcatgcctatttgctgatcaggaacaattgaaaacaaccattacagagccagacgaaattaattaatttacactcaccaattattcatcatcacatctctaaacatcgaattctgggattccatcgttcgtccccttcccgcagccgtcggatcgcggatcgacggtgacagatcgcttcgttgaacgtttttgtaatataccatttcttgaggggggtttatgcaaaatatctctatcccttacctcctcctacctcgccggcgtgacgctctcctccctcactcccatccgccgccggcgaggccctcttcgccgccgtgtcctcctcgtcgtcgctgtatggggcgaggccgcggccagcgaggggctcggtggcggcgcggggggatgggggagcagctcggcgtacgtcggcgacgagattcgagtcaacgacgccgcgccgcctctcccctcaaatctcggtagacgagtatatatgaggattgagaggttccgatcacggcgacggaacgaacccctcccttgttcgccatcgatggcttcctcgacgacagacagggcctccggcctcccactctcccaggtttgcattattcccatccctctgccgtccgtacagaccgtgtgagttcgggttgaagctaagcttcctccaattctgcgtgctcttgcacgaatcctacgaattccagaacctctttgctcaaatccaaggcttaaggcctttttttgttagaattaaacctgtatttccttataatattagttctgtttattcctgtacagaggcaagaaagctcaccagagaagcaagcagacaagctaccaattctgaggtgagtacttactcatctgcgtgttcttaattgaactgaaaagtgcatctagatgtgggttttttttttctgaattcagttaatttaacaaggtttccatatctgacatgatgcaaattttgctcaatgctttccaggtataatttgtagattaatgacctgttggatccatttcagcataacctttaggtatattctaatcctgtatttggtgtttgctaatggattgcagtaaacttttccaactccattattataga

SEQ ID NO: 9945 - DNA, 1147 bp, Oryza sativa
caatgggtaagatcatctcccatattttgcatgcgatccgccgatccccagccctgcagaacggcagaaccttcctggtattcaatcctgctgaccccccacctttgtcctggatttcttgagacagttaattaattctaacaggggctttagcagtttgcaacttgatctcgtctgcatccggcctgcaagttctaattcatatgaattcatgcaattagatttgtttaaaataaaagttcatctcttctagcaaattaaatgatcaaaatagttgcatggtcttactggtatatatatagatagtttcacgcacttccaggaactctgtaaaagatattattgtttttgtttatttcacaactatttaaagaaacctgatagattttcttatgtatttctaggtgaaatgagaattttaacctagctgattgaatatatatcttttcactgcttatgagtcgaaaaaatggcattacagttcaaccatttggcaaaaaatagatgataacataaatattgctgctcaggattactagaatgtcatattgtgataataatgctgaaatttcttacattaatgaagtaagtagtgcgcctattggttggctgcttttgcctgactttcctgaaaaatactgatacgaacttctggataattctgatattgatatcatgatatgtctgcactaccaaagtacctacttcaattcctgatgagagtgcacactaattttgaggaaacgattgcaggtccaactataactatctgattatttgttaaatgcattatcataactggttagtcttttgaatatttttttgacagttcaattcagatatccagatcaacttgattcagggttgggcatgcaatgatggtcctaggattacccgaaggtatttattgttagcaagttttgattgctcttggagaaatggataattttgattagtcatgaatctttactgatttgtattaaaaaaaaactttacaactgtatgacatacattacaatgtttttgtaccgatataatttagcaatcacattacatctcattttttttgttcaaattaaaatttagctatgtttggagttgtgttggatccagttttttttaactaaattatattgttgtaccaaca

SEQ ID NO: 9946 - DNA, 887 bp, Oryza sativa
tatccctttgcacgtctgcatcgttggtgtggcttgctgagtacggtggttgtactcagtcttgctattatgccccccccccttttttcagaagtgtagtgcttctgagctgaagatggagttagaggaccaaggctcagaccccagttgagttttgactgtggagtggagctgaaaccccgctaggatcgcctttttccgctgctgtcgttctgtttcggtgtgaggactaagtgcctcttccgtaagtattttacgctttatttacgtttggaactgtatattacttgtcgttttctgtaccctggctggtcctggacagagatttaatacgcaaaatagtctagaaatttgggttaaatttctgggcgtgacaaagtggtatcagagccaacttgactgtaggttgagccaaatggtcaaaccctaaggacaagttttctgaaaaaccctatttgcaaattgtctcctctcgcccttcgacatttctttatgaaacggtttttcaaaattctcctcccagtccctccaatcctcatagttgttaaacctggaggacaaaccgtcagcttcacgcctattcggaagtcaagtcaagcttcgtgcaaagagtgagaagatcagcccagagtcaagtgaagttttcccggagttttcctaaacccaatctttccctgaagagtagtatcgttagctgctagatcgtgtgttgtttgcttgtgtgtaggggtatggtttgcatcattggtggggatgcgaccatactaggttgtttgcttaagcaacttgaatcataaaatccattcacaacagatcaataggcaagtggtttagtacctcctctctagtaacccctcctatttccccatctctctattgcctgcagc

SEQ ID NO: 9947 - DNA, 1501 bp, Oryza sativa
acaaatttttaaagcaaggaaaaagggggaaacttcagggcgtgacatccactaccacaagtagctcaactggggtacaagccaaacgtcttctccttcgcaacttgtcttcaactgaggttcgattgattattgcaatgtgggcatatgacatactcagcaagccacacaacaaatatgcaagtgcacaaggataccaaagaatggcataatatatagctcatttgcaaaagcagcatttagcaaaacatttgagaattctaaaacagtagagtaattaatcatcaatattaattaacactgaactgcacacccatgctgcacaggcccaaccatcctgaacaactatacacggctgtacagatctatctctaaaccaggaatgtaccattccaaaccaggagctaaattaattaccatcaattaccacattattattaatgagtagtgtgagactaatcacgaaagacattgttagacccgcccataaccgcgggcacggctattcgaatagttttactctggccagaggtgtaccactgtacccacaagacacaactccataatatgtcaccatatcatcatgtgcccatgctgaacatgtcaccatttgtgtagttgtgacaagacccctcgcatagctcaactcaaagcagcgcacctttcctggatcgtagtcaccccctcaaaaaccaaaggcatagactccccagcgacccccgtgggcttatctccgccacttctcagtctggcacaccacaatgagccttgctatacaaagtgtccagccgttgcctatgctggcttgtgtttggcacggttaatgtttcacaaccgaaactcgtgaaccggtccttaattgtcatgagcacgaccatcaaaatcatgtgctcacaacccaccattatcaagttttagttggcacattaattaattaaccaatcattaagtaatagcaaaacattagttatcattaagtaaatgtgaaacattagttatcccaatagtgtgctaatgtttctaaacatggctaagcaattatatctaatgtatctagttgaaccaatatataaatacaactagtcaaattataccccgaggtaatcaagaaataggataatcaatgtaaattggccataacaaagaaataggttcacaccacccggtgacattcgaaaatagatgtatacttgaaataaatagagaatttaaatataggatcaacatgctcaaaggaattgtgtttgggatctatgtgacttgccttgcaatattcggtcttcaattaatcttcttgaacacttccgacgcactcacgatccttcgaaacgacaagctaacacataaaacaaggaaaaagactaataaaaaccaaataaacaatacatataaagtaaataaacatgtagatcatgattttagatgaattatgagacttgaacggcctcattccgatttcatataaattacttatgaattttataagatttaattccaatta

SEQ ID NO: 9948 - DNA, 1501 bp, Oryza sativa
ggagccggagtggaagtcggcggcggcgggatggcggtcgtcgaaggcgcagtcatcgaaggaaccggtggaggcaccgtggaggagatggcgtcatcggcggccggagtcgtcggaaggagaccgaggagaacaggggcaagggccgctcgggccgcggtcgcggcacgatcggcagcggtgccagcgacggcggtggtcagggtgtcgtcgtcctaaccagagggagccttgaaggaggagcggacggcgtcggcgatgattttaatggtgtcatcaaggacggcgtcaacagtgagggaggagggagaagccatggcggcggcagggtgcgccgaccggcggctggggtggagaggaggtggaagcgagaaggaacctaatctgataccatgaattattaccagtgatagcatcatttattatggtgagtagtgtgagactaatcacgaaagacattgttagaccccgcccataaccgcgggcacggctattcgaatagttttactctggccagaggtgtaccactgtacccacaagacacagccccacgacatgtcaccatgcgcctcaataccaccacggtacctctgaaaggagttgtgacagtacccctcgcacaacacaatccaccacagcgcaccgttcctggatcataatcacccccttataaacaaggcatggactccccagcgacccccgtgggcttatctccgccacttctcagtctggtgccccgcaatgaaccatgctatacaaaaggtaaagtcgttgcctatgctggcttgtggttggcacggttaatgtttcacaaccgaaactcgtgaactggtccttaattgtcatgagcacgaccaacaaaaccatgtgctcacaacccaccattatcaggttttagttggcacattaattaattaaccaatcacgattagccatcgtgagctatgattaaatatccatcattaggtaatagtgaaacattagttatcccaatcgtgtgctactgtttctaagcatgcctaagcaattatatctaatatatctagctgaaccaatatataaagctcaactagtcaaattgtaacccaaggtatcaaaggacagagtaatcaatgcaaagtggccataacaaaggtatagtttcacaccacccggtgacattcgaaaataaatgcacagttgaaataaatagagaatttaaatataggatcaacatgttcaaaggaattgtgtttgggatctgtgtaacttgccttgcaataaatggtcttcaattaatcttcttgaatactcccgacgcactcacggactttcgaaacgatggaaacgacaagctaacacgcaaaacgtggaaaaagactaagaaactccaaataaacagtacatataaagtaaacaaacatgtagatcatgattttagattaattatgagacttgaacggcctcattccgatttcatatgaactagttacgaattttataagatttaattccaattaaa

SEQ ID NO: 9949 - DNA, 1501 bp, Oryza sativa; identical to SEQ ID NO: 4821

SEQ ID NO: 9950 - DNA, 1501 bp, Oryza sativa
gtgaaactatacctttgttatggccactttgcattgattactctgtcctttgataccttgggttacaatttgactagttgagctttatatattggttcagctagatatattagatataattgcttaggcatgcttagaaacagtagcacacgattgggataactaatgtttcactattacctaatgatggatatttaatcatagctcacgatggctaatcgtgattggttaattaattaatgtgccaactaaaacctgataatggtgggttgtgagcacatggttttgttggtcgtgctcatgacaattaaggaccagttcacgagtttcggttgtgaaacattaaccgtgccaaccacaagccagcataggcaacgactttaccttttgtatagcatggttcattgcggggcaccagactgagaagtggcggagataagcccacgggggtcgctggggagtccatgccttgtttataagggggtgattatgatccaggaacggtgcgctgtggtggattgtgttgtgcgaggggtactgtcacaactcctttcagaggtaccgtggtggtattgaggcgcatggtgacatgtcgtggggctgtgtcttgtgggtacagtggtacacctctggccagagtaaaactattcgaatagccgtgcccgcggttatgggcggggtctaacaatgtctttcgtgattagtctcacactactcaccataataaatgatgctatcactggtaataattcatggtatcagattaggttccttctcgcttccacctcctctccaccccagccgccggtcggcgcaccctgccgccgccatggcttctccctcctccctcactgttgacgccgtccttgatgacaccattaaaatcatcgccgacgccgtccgctcctccttcaaggctccctctggttaggacgacgacaccctgaccaccgccgtcgctggcaccgctgccgatcgtgccgcgaccgcggcccgagcggcccttgcccctgttctcctcggtctccttccgacgactccggccgccgatgacgccatctcctccacggtgcctccaccggttccttcgatgactgcgccttcgacgaccgccatcccgccgccgccgacttccactccggctcccgcggcgcaacttccccccgagatcctggcgcttctcgcccgtctcagcatcaccacgacgccggccgcccccacgcaggacgccaccgcgcaaccgccggcgctcgacgccgccgcaccaccgccggcgctcgacgccgaagccgtcgccaacctccacagccaagccgtcgccgtcctcaacgtgaaggcgctcgtccccgtcaccctcgacctcgacgccaacaactactcccgctggcaaggccttttcctcgtcgcgcttggaaaatacgccctcaccgatcatgtcttctccgacgtacctcgccctgatcacgccgactggacacagatggactgcgtcgtcctcagc

SEQ ID NO: 9951 - DNA, 1501 bp, Oryza sativa
ctaacatcagtggagagtctctagttctctgcatatatttatcatgacttattccaaattaatctactgtatgtaaatctgcttgtagatgaaatggtggcatgatgacatttactgcagtttatctttttttagggccaaaaataatcacccatggctgtttggctaaatttgaaaaattcccctttccccctgagttggctgaggattatcttcaaagcattggactcctattaaattgcaatgtttaactatggttgccagttaattggtgatgtatatatttgacatgtgatcaacctttttgtatgataacaacatccttttacatttatttagagattatcccttctgcacacatcaagctgaaataattaggtaactgaataatgggaaatcaagtctaagaataagttgctcaatttaattgttttcttcttgttatgatatatggatatggcccatttctttttaacatgtcacacgacatagttccttttgttaggaatttgtaacatatcttttttttatttatattacccagttcaaattctatgtcatgctgtaggtgcatacttttaatgattctcattcatgttactctagataaatttttcatatgatgtttaattagttcttgtattgcatggtatttaattatcataggagtattgtttgagggttaatttaacctcatgtgctgatacagtgccatattgcaacaaactacgtatctttctcactgttaggtacattgactttttttttctttcccaggtgaatttgtagataaggttgtttcaaaatcaccaactaggcatttcattattcatgcccggaaggcattgctaagtggcctcagtcctgcagaaaatcggaacgttcctcctttaaagtatgtcacgcccatgattttctttgtgtaaaatattattcaaatttgatggataagtcttcgtggtccttggtcgtgattcttctttttgcttttgggtagtttcaccttttcaggacagcatctacttctttagcgtatttttcagttgctaggacagctgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggtaggtatggctttgtgttttgtgaatgaagaaaaccagaaaattgccccatctcgagtgccatcctcttctcaatgagagtaaccattgaagttctaacatctggtatcaaagccacactttcctgtaggctaaacatctcttgttccaccccttcccaagctcggttgagctctcagctagcagcagcagcagcagcaacaccggctgctcctccttcccctttcccttccccctctccacgcagcagccccccggaggtgtgcca

SEQ ID NO: 9952 - DNA, 1501 bp, Oryza sativa
ctatgatcctcaaatatttggatcaatctaatgaaaataataattaccatatagatacccttcagtcacaaataagtgttgttttagaatccatgcgacataattattactacatccgtcccagaatataagaagttttagtgttagacacggttattaagaaagtaagtagaattaaatggagaggttgtgattggttgagaagtggaggtaggtgtagaaattgaatggtggagggttatgattggttgggaagagaatgttgatggagaagttgtaatatttttggacaaaattcttagtgctagaagttgttatattttaagacagagggattattgtttagaatatagatctgggtatatgaaaataacatggccaaattcgttatatcaaaaaagctttcataatgtcacgcttctgcaactcattttggatttatggaattgaattaagtggtcaaagttatgtcttattggcttttggctttgaaaagtcgacacttatttgtgactggagggagtacagtttagtcttccacaaatatgttattgcgagatttactgttgaaggtgcatccctggaatcatgaaaagtcaataacaccgagaattgggttttcctgccgtttcatatacaatcaatttaatactggttgtcactagcaactagctggaacctagtccacctggtgggttctaactgggtattgcgactacttaacacagtttttgaaatgattccatctccagtggacagtgattgatttcctgttgttcctaatgttacaggtagctgttactttggtacacttggcaaggctaaccatgctaaactttattagtgacaaggaggacagtgacctagcaagatccaaacttgtcagggcaaggctacttgtcaatgattcaatcaggtattccattgaggttgttggataagtctttgtggtccttggtcgtgattcttctttttgcttttgggtagtttcacctttttcaggacagcatctaccctttagcatatttttcagttgctaggacagttgcggttagtaggacagcagcagttagcatctcctttatgcctcctttatgctttattaagtttggatgccctctaggacagcatcccatttaaatttcgaattttagactaggagggtgcagcaataggctagcagccagctatggctatatatatatatgtatccaaccttcctcgggtaggtatggcttttgtgttttgtgaatgaagaaaaccagaaaattgccccatctcgagtgccattctcttctcaatgagagtaaccattgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccctctccacgcagcagccccccggaggtgcgcca

SEQ ID NO: 9953 - DNA, 1501 bp, Oryza sativa
ctagaaataccatcatcgttaaggttactgatggaaccctaacaacgatggcatttctaggataaatagcttgtacaatgacattatatggaactcacacttggcgatgttatttcttggaatagagcgcttgtcaatgatattttttggatttttctctacttttaaataacaaaacatttcattgatttatgaaaaaaaatctagcccccccctctatatatacacactagaaaaaaaaatgtccgtgcgttgcaatgggtgaagactattttaatcttattattattattattatacagtttagttaaggtgaaattcactgcgggaattcgcttggatatatctctatattttttttagaaaatcatgagttgcagttaggaatccgattgtctcaagttaatatgcgagttttttaaaagagtttcttatacatctccttttatatttcccaaagcgaacaaacttaaaaatcaactcaaatacggagaaatgatcggaacgattgaggaaagaaagagaatggcggcccctttcctttcgcactcatatatggatgacgtaccaaagtaccagtaaaaacatcttcaactttataataagagataatatcaaccaggaatacaaaactaaaaagggaaaaaggaaagaaatgaaattgaaaaaaaatcctatacagattgacaaggtaaagcattgactactccaaacaaaaagaaacatggattaagtctataaaaatattcacaaaacaacaccttttaagagatcatcatttattttccggtgatcgaaattgacttggacgtgtattaaagtggggataggcttgactactcctcaattttcatcaatttccatttccgttagtatgttttttaaactgaaaatcagctcattttgctaaaaactatatatataaattactttaaaaatcaaataaatttatttttaattttttcaataattaatacctgactaatcatatgctaattatgtttatcattttacgtgtggctaatcaggattttcgatccctttagaacgtcaccataaggtcagtagccttagaaaacaaaaggatgtatcaaatccatacaaacaaaacatatatatatttacagagaatttaccgtgaaacaactttgtcctcaaacagatgccagttgccacccaccgaaagatacctgtacgtcgtatgtactactggtaaaatggcacctctctctctaaaaaaaggaaaaagaaaagataaagaacgaaagagatggaaagacggtaaagccgaggaagagacgacggaagagaggcatatgggtggtggacgtatgaaacgaaatcgtcgcgtaaggcgtagcgaccacaaggcgcgctatccacacttccacatggaccacaggcggcccaccctgccctgccaggtgccaaaaccaaccttcggcgttgcggcccaaacgttcgttttccttcgccagttcagctcgccatttcgccatgg

SEQ ID NO: 9954 - DNA, 280 bp, Oryza sativa
cctttccttgtttgttttttcgtttcaggaggtccaactgatgaggttcgatggtgaatgtggggaacatagatcggttgtactgatatcttcctaacgtcggcgctgatccttcaatttacatgtactggtgagattaagaaaatatgtaaatgatccatctagggatggcaatttccccattggggccagggatccggcagggacccgcccccacgggggcgggggagaattctcacccatgggtgagtggggacggggccccgcaaacttccgggga

SEQ ID NO: 9955 - DNA, 1501 bp, Oryza sativa
acgatgtcgagaatcagtcttatgcatgaatgggccaagaactcagaattgacatgatgaattgggccaaaattcacaagtctgtgaaagagagcaaaggaggaggccacctgccgattttgggccaggtcgacccagcccatggtttggccaaaccccccgcagcgccactcgatccagggttctcctggatggctgagatgactccccaatgatggttggtgggtattaccgacctttccaaccgtcgcaaccgtcattctcaagttataaaaagagctctcatcctcacttcactcacacacctcaagcaaagctctctcatattctctcaagtttagtttagtagtattaagctagtggaataggaatagagtagaaatcatgagtccggaagtcttcggaagagttcgggtatggatcttgtcggagatatgggcatgggggtatgtgaagtagaggggaattactttccctccggtcacatgactctgcaggttggccccgctcgcgcgtcacgcgagtcgtggaagcgccggggggggggggggggctcggggcatgacgtcacccctcaggctcttccgcggcttcgccccgaggccctcacccggtcaccacgtggcagagggagagagcaagaggggagcacaggctgaacagccataaatgtgcgatgccccaactgtccctcaccgcatttaatgcggtaagggcagacgtgcggcgtgccttacgaacccttgtccatcggatgtgaccggtctgtgaccggcccgtctccgtcacatccgatggatagggcaatcatgtcctcacgtcgcccttgtccccagtggagtgggggtgggtatgacccgtcacatccgagcgccgctcgaggaagggctgttgcgtgtcattgttcatttatgagggaatgacagggctatcccccgcgtcaggcaggggacggcgccgggttccactcgagaatcggttattgcttagcttcgggagaaggcccggtttaaagcccaaaaagtggagtggggttcccccccggtggagggtaggtagaggcggcacatgtggtatccccttaagctataaaaggaggaccctgcccattgagatagggggacgactcccagaaaacctgagctcgagaggagaaggagcaggtgcgctctctggggggaagaaacccttgtaaaactcatcaataatcccaaacacaggagtagggtgttacgctctatagcggcccaaacctgtataatcccactacgtgcaagcttgccggtaatcttagggacgagcgagtgatttccgagaggcgggcctccgcccccggccgaactcacgaaagggggggtctcacgacctcccgctatcggggggccatccctcgacagctggcgcaccaggtagggggcggttgcgcgttccgagaggaagttgttttcttccgtcccaagtttctccaggccttagccgaccatggtcaaggtcctggaag

SEQ ID NO: 9956 - DNA, 1501 bp, Oryza sativa
atagtggtagcccccggccagtcccgcacaaaccgaggggttgtgcgggtgctggcctgagcgctaggaaagcaaaaaatctcgattttatggatagaaacgacggaggtgctcgatattccaggggttgggcagctctgtgccgtcctccgtggttaaccgaacggagcctggccggggcgctccgatcactttgtatggtccttcccacattggcgagagcttgctcagccctaggcgcgactgaacgtggcgtaggacgaggtcgctaacttgtagtgatcgggcccggacgtggcgttgatggtagcgtcgcaggctttgttggtagcgcgcggcgcggaaggccgctcaccttctccgttctgcaagataattgagatcgtcgcggcgaaggtcatcttggttggcctcgttgtacagtgcgacacgaggcgaacccagggaaagctcggagggtaggaccgcttcggcgcagtacaccaagaaaaatggtgtttcccccgtggcgcggcttggagtggtccgatttgcccacaacacggcgggcaactcctcaagccatgaatccccgtgcttcttcaggacattgtacgtcttggtcttgagtcctttgaggatttcggcgttggctcgctcgacttggccgttgctcttggggtgggcgggtgaggcaaagcacaatttgatacccatgtcgtcacagtaatcgccaaacagctcactggtgaactgggtgccattgtctgtaatgacacgattgggcactctgaatcgagacgtgatgcccctgatgaacttaagagcagaatgcttgtcgattttgacgactgggtaggcctcgggccacttggtgaatttgtcgatggcgacgtacaagtgctgatacccgcctcgagccgccttgaacggtccaaggatgtctagcccccagactgcgaaaagccaagatagtggaatgacttgtaatgcttgggccggctggtgggtctgcttggcgtggaactggcatgccctgcaccgctggacccattcttgggcatcttgtaatgcagtcggccaataaaaaccttgccggaaggcttttccgaccaaagttcgtgaggccgaatgggctctgtactcaccctgatgggcgtcggctatgagctcgatgccctgctcccgagaaatgcacttcaagagtatcccgttcgcggcacgccggtagagggccccctctacgaggatgtaccgcttggagatgcgtgcgagcttttcagcttccgcgcgttcctcaggaagagtattcccgtcgagatacgcccggatgtcggtcatccacacaacctgacgagaggggtcggggttgacctcctcgggccccgaggggcgcgggtcgccaggggttgggccgaagggcgcgtcgttggggtccctcaaagggctcggtcgcgccgatggttgcgcaagcctttcttcgaaagtccccggggggagtggggctcgtgccgacgcaaca

SEQ ID NO: 9957 - DNA, 1501 bp, Oryza sativa
ggaggcccgcctattggaaatcactcgcttgtccctaagattaccggcaagcttgcacgtagtcggattatacatgttcgggccgctatagagcgtaacaccctactcctgtgtttgggattatggatgagttttacaagggtttcttcccccagagagcgcacctgctccttctcctctcgagctcaggttttctgggagtcgtccccctatctcagtggacagggtcctccttttatagcttaaggggataccacatgtgccgcctctacctaccctccatcgggagggggggggaccccactccactttttgggctttaaaccgggccttctcccggaagctaagcaataaccgattctcgagtggaacccggcgccgcccctcgcctgacgcaggggatagccctgtcattccctcataaatgaacgatgacacgcaatagcccttcctcgagcggcgctcggatgtgacgggtcatacccacccccattccgccggggacaagggcgacgtgaggacatgattgccctatccatcggatgtgacggagacgggccggtcacagaccggtcacatccgatggacaggggttcactagccacgccgcacgtctgcccttaccgcattaaatgcggtgagagacagtttgggcgtcgcacatttatggctgttcagcttgtgctcccctcttgctctctccctctgccgcgtggtgacagggtgagggcctcggggcgaagccgcgggagagcccaagggggtgacgtcatgccccgagcccccccccccgccgcttccacgactcgcgtgacgcgcgagcggggccaacctgcagagtcatgtgaccggagggaaagtaattcccctctacttcacatacccccgggcccatatctccgacagtagcccccggcgctatatcagatatcgatttcctgggatcgttctgacatggcgcctcacgactcctcgagctggggttgtgggcccggcagggaatccaaaaggatatcaccgcgtggccaggttggcgtactaaccacaacagcggtttgaccgcctctgattgcgctcatgatgaagacacttgaggcgcgataaccggggggtcagttagaccacgcctcgattctctcgcccgctactcctacagcggtagtggtgacagtttgcccaacttgcgctcatggccgtggcacactccacctcgagtgtgccactgacgggcacactaaaggcggaagcggatacaacgggcgacgtgatgattgggcgcgggatgcgaagagacaaatgcgggcgcgaggatcgtaagggcagttatgggggcgcgaaacgaggaggcgagcgcggatgaggcaaggataaaagggggcggagaaggagactctgccttcttcctttcgccaaccgcccactcgtcctttcgcttctcgaaccctaacattttcgccaccccacactgtctcgtgctccacgctctccatcacctctccgc

SEQ ID NO: 9958 - DNA, 1501 bp, Oryza sativa
aagattcgaggcatgaagcaagagactgtttggtggaaattgtttccgttctctcttcatgagagagcgaaacaatggtacacatgtaccgttgggtgtgtaaacggtgacagggagaaattgcaagacaggttctgcctcgcatttttcccaataacccgtattactactcttcgtgcagaaattctgagtttccaacagataaataaagaatcgattagtgcagcctggtccagataaactaatttagttcagtctggcccaaccctatctatacccgattacgtgctattgcagcattttcatgcgggtttagatagggagtctgcattctaccttgacataactgctggagggtcattcatgcacaaaactcccaccgaaggcaaggaaattctcgatcgcatatcaaaaaatacctcctttgtcgggcagtgtgttgaaccccatccagaggcatttgtgtcaggaagggaggacgaagggagtatgctttacaaaatgttgagatgagtatgtactagcactatttttttaaaaaaaaattgagaatatatgttttaataatttacgtttatttatatgcatgcatgggaagaattagcataaatatacccctataggggaacgcataacggggacgaggggagcgctacgtaatcgaggcttggatgtgggaccgccagctgggtcgttatatttagtatctttacctattactagtaagtgtgcacgtggaatccacgttgctaataaaataaataaaacacaggacggccttcctctggagagcccccaacggcgcgccactcctctcctctcccccgccgccgtgccgcacgccgttcctctcccctctaccgtgctgcgcgccgttcctctccaccaccgagctcgtcgtcgcgactgccgtgtctctccgcctctcccgctgctgccgcccctactccgcgcgccgttcctctctgccgccgagctcaccgtcacgccggccgcctctcccgctgccgccgcccttgctccattgaccgcctcacgccgagtttgctgccgcgcctgctcgagagaaggagagaagagaagagaaaaagaacagaaagggtggggcctataccattttctatcacttacatatggggctcacatatttattatattttatttttactgactaggatgccacatcagtgaaaccgagtgtctatagtgccttggtatgttttcttgaatggttttacgtagttcagggtatacatttcttgtattgcggttaggggacctcaggcagactcagcgtaaaattgagggacgtcaggtgaacttattcccaagatgaatgacctctgatgtactttttcccaaaaaatcactgcacatgggccatgcccgccttgagcccaaggctgtggtctagactaacgagcaaaacagcgaaaaccccaagcgccaccgcttcactccccgtcggcgaccagccgactttccccaatgccggcgccgc

SEQ ID NO: 9959 - DNA, 1501 bp, Oryza sativa
agaatcctgtgcttcatgatcgcagtaaacatattgatacaaagttttatttcatctgggattgtgttgatcagaaacgggtggaggtggaatacataaggttagaggagcaacatgcagatattttaacaaagcctcttggtaagattcgatttttggagttgagaggcaagctgggattagttccagtctgatgcttcaagattagggggtgaattgttggattgtaatcttgagcatttatattctcttttgtttcgttgcatgtagagttctgttggagtctgaattctagccagtagaatagcatttttctgttttagcatatttgcttccttctttagctgcaatgactcggctcggatcgtgggatggcgcggtcagtagttgatccgagattgtcatgatttgattctattatacatgtaacaaaatctgtgtggagatgaataaatagaagagaaaaccgaaaaagctgcactgtattacgcagcgccaactctgttcgtcagttgttctgtacgactctgtattttcggaacttcttcagttagctgtagctgcacctacaagcgtcagagtgtgtgttttagagagactgagagccagttcgcgtgagtttttttctgacaaaggcgtcattagctctggttgcgtcttgagccatctcgttggagttgccgttgtcccgtggacgccgctaagccgcccaaatccatagacgatgaggcgttgccaactaacgcttgtccccatcaccatccgatgcccaccggagaaggccattctcaggttgccaaggggttggttgccgatacccggaggtcgttaacatatcatccacaagccgcgatggtattgtcagactatatgtgccggcacctgtcatgatgcagccttgctgggcagagatgccccacaaagactactaatcggtgacgccctctgtcccccacgctcatcgtagcctctgcgggttgccgccgatgtctactaaatcatcctcgccaatgctatgatcttcctcatgttataattgtcgagccacctgagaagaatgccggagcgccattgcttggtgcttgcacgatcgtcgccaagtccagccatgatcccttcgctttagctggctgaggtcgtcgtgccatccttccacgacgctttcgcttcggcacgtcgggatcatcctcatacccacaaatacggtgtcatgctcgccggtcttgaccgctcgatgacaaaatctttatatgtacaccgccatcgacgatgattgccgaatcgttgccgtcgccgatcatactctcagacccgcaccgccgaggcgtcttcatgattgtcatcgatgccggtgatgcgatctcgtccacaaacaggacgtatcctcgtcatcttcaacgatcattggcatacatttatccttgcggctatcaccgatggcgaacctgtttctggtcatcatcgcccgcactgattgtttctccgccaatgacaagcccgt

SEQ ID NO: 9960 - DNA, 1501 bp, Oryza sativa
gaaccaggctcatctgccaccgcaaatctctgccatccaacaactttccaaatggtatgagaattaacatccatacctatcttttttagtagctccggatcgtatgcccgcgtgtgagcaaatatctgatcctttagcatgtagtaggcttgcatctcctgatcaccgacaagatcgaggtcagcatcgttcaagaggcatggcgggatgccagttgttggtatttcttacgatcacagatagaatccgcaagcgcatggatataccgatgtaggactttccctacggagtatttcaagggtatcgaatccaagggaacgtgtgtgattatctcttcctccggttcatcaaggacataagataaatatgggcacagggcagagaggatttcttagtgagaaaaagtgtccaaggaaagcttaattttaatcctaacgcgatacttcaggcactagcaactcgctgttcctagatgtcgctctactatgtacccgcacagggaggacttaagtgctcttgagggctatcaccacctctacacccacgtctaacgtattgtgggatacgcagcaagtactggaaattaattatccagacaccgtgtctacgcaattaataactactctagtgctagctaaagactaaagcaatcactatataattaatggactatagtgaacaataatcccatatgctaattaggaactaacgaagaataattctcgctaagcaaatcttaattactcagaatgatatttctattgaaccagagtaattaacaaagtacaagaataaagagaggattatcgacaactctgggattcctccgacttcttctactttactctatccctattctaagtgtactatagaacatataatgaacctaaagtatacttagagcctcttgtaattcagctctacgtcttggtgtgtgttggaatgagggagaggagctctatttataggcttcatatgatagttacattatgggaaatgtcccaaacaccatccaaccatcattagggagcaatcctggacgcccacatggaaggctgggatgaattgggcttcatggcggttcagccgaaccatgggctggcccaactgcctccggccttcttctatctcctgacatttgggtccctctttattattcttccagcgttggcccaataaataatgatttaatatggtttgtgggctcatcactccatggactccaacgggaagtataatccccctgcctacatgtttattttttctcaactctggtaatttgtcacctgcatacaaatatacactagcactagtggaaatcattagaaataaaccctaccactatggttgatgttttacatttatggttttatgcaggtattgacggcatatattttgtatttaacagccatcaacaaaacctcccacacttagctctttactcgttccgagtaatggttaaggatgaatgtggaataaaactttccaagatataatacag

SEQ ID NO: 9961 - DNA, 1501 bp, Oryza sativa
tttttccctctctcgcgttcaaacgggcggatttgcccccgcaaatctcgccgccgccattgatggcggccgaacctcccgcgccggtttccttcctccccagccgctctctccccttccaaccctatttaaacccttcccgcacctcctccgttcgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatccttgccgacctcgtccacctctccgtttcggtcgccgaccgccggagcgctgccgtccccgtcgacccgagccttgccaccgcctccctccgctctggccgcctcctccgtcgccgccgtcgcctcggggtgagttgtggaccgtcgcctcctttcccccttccctcccctctctcggccgccgctccgccgagctgatggtctccgggcgagggaagccgcctcccgtcgaccgcgccggcatggccgccctcgggcgcgccgagtggctgccgcgtggggcccggctgtcagccgcccgcgcgctcgggtgcggctgacgtgtggggcccacggcgccggccggcgtgagccagggtgcacccggtccaccgtggaccgtgaggctgccgcgtgggccccactcccatggacccggtccgcgcaccccctccccctcggctgacgcaataaaccctttttaaattaaaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggt

SEQ ID NO: 9962 - DNA, 1501 bp, Oryza sativa
tttttcctttttccacccacaaaacaaccatacacatatcacacacatgcacattcttgatcagagagtatgacttgcgatctccttaggtctggtcttttggcttggtgaaatatgtgatgcaggtatgccccgattgatccctaccaagctccacatatacaaccttgtagaattgggacaattcagcaaaatatgccttggtgagaatccacaaatcaaaccacacgagagacttgagagaaagtcattcgaggagtatatctactttgaaaaaatatatgaaaacccaagagattgacaggaggaacaagaaggacttgagccacgacagttccattcatcaattacccaagatggatagttagacactggaaagttcacaagtacttgtatggcttagaataaattgtatacctgtattatatcttggaaagttttattccacattcatccttaaccattactcggaacgagtaaagagctaagtgtgggaggttttgttgatggctgttaaatacaaaatatatgccgtcaatacctgcataaaaccataaatgtaaaacatcaaccatagtggtagggtttatttctaatgatttccactagtgctagtgtatatttgtatgcaggtgacaaattaccagagttgagaaaaaataaacatgtaggcagggggattatacttcccgttggagtccatggagtgatgagcccacaaaccatattaaatcattatttattgggccaacgctggaagaataataaagagggacccaaatgtcaggagatagaagaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagc

SEQ ID NO: 9963 - DNA, 1501 bp, Oryza sativa
gggccgaggggaagggggcccaagaggagggagagaaggagagggagagaaagagagggaggaaagggagacttcggccgcgggccgaggggagagagggaggactttgggccagacttggcccaaaggaggaaggagggttatttttaggtttttatttttaataaactttgttaattgtttttgttgcttaataattatttccggtgctctgaaaattcaagtaaaatttgagggctccttttagaccaaggcgaatttaacaaaaattctccgggccacatttgaatttttcttgtacgtattttagtgtttgccaatttctttccgaattttaattaattctattattccttttagcgaatgatttttaatttcgggacgaatttatcaggacgtgacatcagttcaatacactttcggcgcatcgcgacctttttctactttcattgtttcgacgagttcttgttctctagttgggctgcatcgttttcgatctccggcgagaggtaaaacttgttattgcggcttgcgttctcgggattagtgctcacatctttatgacactctaatcttgtttatgtgaatcgtcgagttatcataaatgcaatataatctagattgattttactatctggtcttgtcggctcgtctctatcatcgaaatcagccgatagaatcaggtaatatcattggtttagatcatatagtatatccaccatctcgaaaaagttttcattggcttgtttactagatcttatgtttctctctatgcttaatgctacatcaattaagtttgatctaataagtaatatttagaaccataatctctagcttgcttcatgattgctaatagagatagtatcggagtttcagccgatcttacctggtttagttatcttgttctttatttatttacttgacatgctaaatctgccatttatattaagatctcgctaagactaaacatattaagcttgatctcaatctacttgggtcttcctaatagtagaccgacacttgtttaatatatttaatctataatgatatcttagtataaagatgtattggagcaatagccgatacacactagatttacctatcagctatgcaatgaacataaataatctttcctttgaagtacttttaaacttaagtgatttatactgtctcggcagccatccgatctatcccaatcgcttggtttaaacacatttcgaagtatagattatatattgttattatctaaagccgataaagtaaatttagccctttgtttactatatatatcactgctgatccgaaatataccgcatcggcttgctctcagacgatatgtcatcagcaatccagatgatcggttatcgttgatggatttaagtttggtttctttgtttcttgttgattgcaggatcaaaccaactggcacgctctgaacccaaaagcaaatttaggacctgcactagagtaaagcaaatctctcaggccagtgcgtgttttt

SEQ ID NO: 9964 - DNA, 1501 bp, Oryza sativa
gagttatacaactttgatgttgaaaagtcatttagtatttgaaaatgttatttgaaattgtcataatttgaaattcaaactcaaatttataaaacagagtcatatagcaaaatgactaaaacaaaagttgtagatattgatggtttatataacttgttgttgatgactttttcagttgaaatcatttagtatatgaaaatattctttgaagttgttataatttgaaattcaaattcaaattattgaaacggagtcatatagcaaaaacactaccacactttggagctaccctgtaggtcattatttttcctgtgcgtttcgaaacaaacctacagaaatataaattattgtgaagggcttacttatacccacagaaaaatgtaatatttctgtaggttttggacacggcccacagaaaaatgggcattccctccttggcagtagagaactgtatttttttttgacgttttaccgtcacgataatttgtggcgcgagggaacaggaaaatatggcgccaaaatttcagtaagcgggaatattggcgccctccgaaatattttttctgtaggttttgggcttccggcccacaaaaaaaattgaggtaacctagtaaaatccccaatcttatccggaactccagatccaccgccgccatcgactcctttctctctcgcgcaggcgcgtagcgctactcagcagcgcggccccgccgccgtcgccccaccgtgcgcccgccttcgcctctccctcccccactcgccatgcctcccccctcccccactcgcccctgctccgcccatcgaccggcctagcaccgccgcctccctccccaactcgccgccccctcatccccccaccgcccatcccctactcgtttctgctccgcccgtccatcggcccgcgccgcccctacaccatcccgtcagcctcaacacctccaccgccacccctacagccggcccttactccgccattccgcagctgctgcccgtccctactgaagtccaagagaagtcctccttcagtgttgaagtcgtttctgctattgtttgcctccacatagtaagcaaaacagtctgtatgttttgattttttatgttaaatctgacatgcatgagagattggaagttattttgcatatttagttgtagcttctatacaaaagtagaacacagtgtgttattttgttaatatcagcaaaactgaattttacatatgcattggtccagatctatgtaatacttttcaaggatgccccaatctgtgaagcctggtgaactatccttgttgacctgttgatgcgctagctgtgttaactctcagacgtgctggtctggtagcttcaacaaaatctggtaagctctagttcacctacctagctaagatacttatgcatgcttgtggccatttaagttggactgttatttttgatgttccatttggatgtgatctaattgttaaccaagcctactttatatactaagatagttaaatgatatt

SEQ ID NO: 9965 - DNA, 1501 bp, Oryza sativa
aattttacaccttttctaactatttatttgttgaaaatgataactttgattgttatattatctatttatgtgttgtgatgacgtattaaagaaaaatatcactttgttacacattctatgtggtaaaatgttgctcgatttctcttatacatgcttgagatttacttgatgccaggctcgaggctcgagcccataaacgagccgagccgagctgcagttttagctcgctgtagcgagccaagccaagccgagcttcccttacaccaagctttcacaaaccgagccaagcccggctcgtttccacccctagctggaaacttgaccaaaggacatggtagaaaaaataaatgctcggaactacccgggttccatctagatccgaaaaaatatatgttagaaataagagaattgttttatccgctaatatatactatattatcaatcatatgtaaaaatattccgaatatatctacctacaaacatggtagaaaaatggtttttaatttcaatatatccgcgtaggggagggtggccacgtgaccggatccacgccggggaggcccaccgccatcggatcgaggtggggcggcaccactgcagatgcccgaggttgctcccatcacctgagcccgccgtcgccgctcccgccgtgctcttgcgggatccgttgcaaagctccccgcaccggaacactattttatgagctcaattaatattgcagttttttttatgtatcttcttgaacactttaattgtgtccctagattcaatatctacagacaaatatatatctgttcctgaatctatttccgacgaaaaatatgggataggatatataggatgagttgtgtgttatccgtcgttatctatatacgtggttctgaatttgaagaaaaactatagaccaggatactagagtggcagaatgtaatgacatccgagcgtaccttagccgattccaccgctaggagggagtagtgaagtagatttccattatggaactatatatatataccttttggcatgtcctgatttatatctcacggttgttttaatttattttatttttttctaagtttttgcctcatagttctagtcgacttacattatctttaaatattactctttcacaatataaaaatacgatgaaatgttttagattaaggaatactctctctggttccttattaaacaggggtaatgctttagataagagttaagataccaattaatgatgataattaattagagtgactatttcctattgtatccatattaaatacatctgtgtgactagcttaattaatatgttttacatgcatgcatgtaaagggagtaaattagtccaaagtagccacaccaaaggtaaaacgtcagtttttatttgcatccaaacagttcaaatctctaacgtcaactaatatattaaaccggagggagtaatagatatgcattacctaaccagctgtactgcgtatatgtagtacttaatatggtataa

SEQ ID NO: 9966 - DNA, 1501 bp, Oryza sativa
catagacgccacaaagccacaagccaatacaaacctacatacgccaagacaagctgccagatatcgacatcagagataagcctagcaaagccccatatggtacctacgggaaccaaagagaggaatctagcgctgtctctaatctcgcagggcacggattcgaggaggaagattactctgttgtcgactacgcgatgatacttcagtccgctatatcgataacagatagataggctaccctaaatattgtactggtgtgattatggtgaataagagcaacaaccggcttcggccaacaggatatagggctattacctgacaattcaggggcccgaacctgtataaaatttttgtctccatcttcttttactacaatctcgaatatatcctagtaccaacgatccccatactatgcaaatacaggaatcgcgacatcaaacgtcgacaaagatatagaaagtactactgtttttcgctttattcctccatttcaaaaatgcaaaccctcacaaatcaatcacgcatgagcacatggcatcaacttcacataaggaaaattgaggctgcctttcaaactgaaattctactataaattcatccatcctcgaacaaaattgcttggaataaactcaatttttactaaaggggtgccaaagttctcattgctacttcatccgttacatcccaattcctaaaatatagctacttttagtgtttaaatttttatggtgagtaagtcgagtccccttgtggccttctctctactgttggataagagaagggagagatggggaagaaaggggataggcagcgagaggtggaagtctactacacttgagccccatatgttttttttttctaatgccacgtcagtcaaaaccacacattcatattggcttaggacttagtacttcataacttgaatggttttgtgaatggttttgcaaagataaagggtgaagatttatgggattacgacttgggacgtcaattaaacttgacgtgaagttgagggattgaaaacggactttttttctttcatgggcccgtgccctactccctcccgtgaggcccaaccatctccgtctctctctctctctctctctctctcttctctctccagtccaatctcacccatcgccgacgacccacgcacgcagtccaccaacgcgccgccgccgccgaatccgcttcgctccctccgccgcgccgcgcgccacctccgtcgacgctggcccgacgcgcgcggttcgtgaaggaggaggaggaggaggagcttctgccgggtcggaccgtcggtttctctcgttggtaggggaagaagccctttggttggatttgtttcttctttcgtctaatttggtttagctcaagatttggtttcttgcagcagcaggcagctcttgtttctccataacttctttgatgcttcaatttaatttgatacgcgaaattatatctgcagacctgcaggagggtgcgcagggtttcttcttcgaca

SEQ ID NO: 9967 - DNA, 1501 bp, Oryza sativa
tcgcaagaacgcgcggcgcgcccacccaagaacacacagctcctcctcctcctccccccttcccttcccccaattcctccccgtctccggttcaccaacccgccacggatttcttctcgatcaccaagaccatccacaagacggaaccggtctccaagacgcaatccgactcctccgccgagagggtcacctcaccgagcgggtcacgcgcgaacaaccgcctcgccgggatccctcctcctcctccttcttcgccgggaagacggattcagcagcgagcgtgcgtggcgttagcaagaaccagcgagaccgaggggtgagagagagaggaggatgaggaagaggaggacgagaaggggaaggaggcaaagtaaataaagggagatgtcgaggggttgaatagaaaagtggactaggcttagcttaccgtgcgggagtagtatacagaattgctgcggggatgtttttgcgaatgggtccttgtagattacagaatttacgttggagttaattattggaggagaggagagtgttgcttccggtggaagggtaagcggcgtagggaatagaataccgtggatttcttcccctccggttttttcacgtgagtgtccaattttctctaaactataattattttcgatgtgactttatgaattttgttgttatattatttatttactatacaaaaaatataaatatcatatcattaccaatgagtttgattctaatatatgaacatgtttgattggttgtattgcgcatgcactgtattgccgccgccacacacaacatgtaacacaactgtagcaataactagcgaacgcgtccaatatattcaagtaaaaaaatagagtgaccaattcaaaataaaattatcaatttacttccatcatcaagtaacaagatagtagttagtttgtgcatgcagaagaagtcatcatgttgtcgcctaaagccttaaactccgcattttttactagtaggctaggagtaagagaaaaaaaaggcaaaaaagccacatgtatattccatataaatcaggctagtccaatgtcaacactatcgtgaaaaccgaagagactttcaccagtaatttatagatgcatgtgtttttaaccatgtttttattactatgttaaactgcgaggcatatgaataggctatgtgaggtagggcaattcaacgagcgtgtaaaaccacaagttagtcaccatgaagctaagatactcatttggctgattaaggctacgttctgctgtgttgctgggataagctactgcctatccactagaaaacgaagaaagtctaatacttaatatgaaacagtttattgagcagattgagtatctacttggcattagaacaaatttaaaataaacttaacatatatcaacataacaagtgacatataaaaatatttatacaaaatattttttcaaagcatagagtaaataaaatatagtataacattattatagccataaggttcgaggcctga

SEQ ID NO: 9968 - DNA, 1501 bp, Oryza sativa
tctgctcaataaactgtttcatattaagtattagactttcttcgttttctagtggataggcagtagcttatcccagcaacacagcagaacgtagccttaatcagccaaatgagtatcttagcttcatggtgactaacttgtggttttacacgctcgttgaattgccctacctcacatagcctattcatatgcctcgcagtttaacatagtaataaaaacatggttaaaaacacatgcatctataaattactggtgaaagtctcttcggttttcacgatagtgttgacattggactagcctgatttatatggaatatacatgtggcttttttgccttttttttctcttactcctagcctactagtaaaaaatgcggagtttaaggctttaggcgacaacatgatgacttcttctgcatgcacaaactaactactatcttgttacttgatgatggaagtaaattgataattttattttgaattggtcactctatttttttacttgaatatattggacgcgttcgctagttattgctacagttgtgttacatgttgtgtgtggcggcggcaatacagtgcatgcgcaatacaaccaatcaaacatgttcatatattagaatcaaactcattggtaatgatatgatatttatattttttgtatagtaaataaataatataacaacaaaattcataaagtcacatcgaaaataattatagtttagagaaaattggacactcacgtgaaaaaaccggaggggaagaaatccacggtattctattccctacgccgcttacccttccaccggaagcaacactctcctctcctccaataattaactccaacgtaaattctgtaatctacaaggacccattcgcaaaaacatccccgcagcaattctgtatactactcccgcacggtaagctaagcctagtccacttttctattcaacccctcgacatctccctttatttactttgcctccttccccttctcgtcctcctcttcctcatcctcctctctctctcacccctcggtctcgctggttcttgctaacgccacgcacgctcgctgctgaatccgtcttcccggcgaagaaggaggaggaggagggatcccggcgaggcggttgttcgcgcgtgacccgctcggtgaggtgaccctctcggcggaggagtcggattgcgtcttggagaccggttccgtcttgtggatggtcttggtgatcgagaagaaatccgtggcgggttggtgaaccggagacggggaggaattgggggaagggaaggggggaggaggaggaggagctgtgtgttcttgggtgggcgcgccgcgcgttcttgcgagattgggtggttggttttgattgtggtggtatggtagaaaaactgcagatttaatctgaactgcgttggggggagtggaagaggaggaagaaagatcgggtttcgaggcgggggggggggagatgagttccgggtcggcggtgacgggcggcggcggcg

SEQ ID NO: 9969 - DNA, 1501 bp, Oryza sativa
aagttttattactttaatacccttatctatcgattcaccaatagtaatttttcttttcattttgtaataactttttctccttttaaaagtgccttaaaatgtaaggggtggttttttttgggtggatgataatgggccggatactccctccctccattcacaaatataaatatttttagcgtttaaatttcattcataatttggtttacaccatcagacgttatttttccgaatcaagtaaacttcatcagtatgtccctaatttcaactcaaccttaatttgtgttaaaaaaaaaacccccttgaaatgccttaggatggtattttgttactttttagctgtcatattattgtaggcattgctacggtcaccactgtcacttctgatcattgtcgttttaattaagtaaaatatgttaaaaattcagtggtgagtattttgttgaccaattaatctagcaggatttagaactatcattttccatgtgacataaaaaaaaactgtgttgtcaaagtgttgggatataacggtatatatatgtgtgacaacggtcttcatcgacattagtacatcacattacatcgttctctctttcagattatacgcagctgcaaaattcaagacataaattttactacgatacttgagtaatgtgaaagttctatgatcttaacagggcctcaatcttggcgcggctggagacggacactgttgaataaattggaactgatcgaaggctcgaagcacagattatactagtatacacgagttctagatggatgcatgttgttagcctccagatatcgtgtttatgttcttcctgtctctacaaaatcttttctctgtatcctccaatgtacagttatgcttttttatttaatttgttttgatttctgtatgtataaggattgcctcatgatcacaatagtgtatatgttgtatatatctatcaacaatgtataccaagtttttccacataaccttatctgaagcatcctttaataattcaactcatatccctgatgatatacacattggttgttcttattatctgcttttaggatgaactcccagaaattggcaatttgccagagatatcgaactgaatcaaattagtgagctatgtaaactctgagataagccgtcggtcaaaagggatttcttcagaaacctatcaaagcttcgacatcagcatgctcgcgggtgaattttgagggggagaactttgcctgtgaagctcctgcaataatcaagataccatcagggatatgtatgtgatcatttttgtcagaatcggaaaaaaaaagttgtttcatccagctatttatatttgatatggatttttcagaatgttccttcctcattctgctaatgatcataaatatgagtatctatgctatcatatggttgtttttttccaatttcaccttttccttttgcttaagatgtagaagaagttaatcgataagcgattggatttttaccttggtattggaggtc

SEQ ID NO: 9970 - DNA, 1103 bp, Oryza sativa
gatttaatttctttttgatcttggtgttaaaaagtaatatgtctaacttggatgtagggagtccatcaacctgcagctcggatgtagagcatgcacaataccaacaagcacaaggctctactcaatctgttggatcatactgtctgttggcttgggaggaatttggaattcagcttagacagagagaatggaacggccttcgcgtctaccgggaaacagtgtgcctttgtttgaacccgaattctattccctggcatcacgggtaacaagtagatatgatcatgcatcgccgagatgtgctggtttgtgctggttaaactcgtagatgcaggcagataagctccgtggcaggtttaatcttttgtggcgtggattaaattagccaccccgtatccatcaatcagaaaaagtttgatattttgatactaaagttagtcaacttttttaagaacaactaagaagaaagcccgagcagatgcgcgggcagttttatgaagacaatttttaaaaaaggttatatctcaccatttataagccgagaaatatattgcatactttaatatatttaagtaataaggttttctcctagattaaataaaatcactttgccacatataaattaaattttcttgttgtcacttcaacctattatcactgtttaaaagccaagtaactattcatagatgaactacgtaatgtatcaataaaataagcctaatacatcattaatacattgaaatatccactacacgtaaatgtttcgtacctcaccaattttcaaaactatatataaatattgtaaaaataccacttgtacaaattaatagaataacataatgttatacataaatgcttctctaatgcgtgaagccgattgtagtggctagacttttttttgtcatttgctttgaaacatgggtcccatatcgatgtagttgtgcacctccagactaacctggagcacaattttaatgcctaatttactatcacacccttatcgagttgtgcatcggtaagtagtatgttgagcactattggtgactgtggtctccattgcgaccgccttaactcaaccatatgtacgtccctgttatacttatagc

SEQ ID NO: 9971 - DNA, 673 bp, Oryza sativa
ccaccatcccgttcggccgaccggagtccgacgccctcgcagctgcccacgctcgctgctcccgccgtcgcccctctgccgtcaccaccgctggacctggaggaagaaggggaaaggaaggggaggagcggctgcggcgaggggggagcagaccgcgagccacgggaccccgcctccggtgacgccatgctcgcctcgcgctgtcgcccaccgcccgccccttcctcacagcgtgccgccgcccaccgccgctcgcgctgccgctcatgcgcgccccgtgagagagagagagtgaagagagaggaagaggggaagggtatgtatgacatatgggtcccacaattttttaaaaaaaaatgctgactggattggcacgcgtacgctacgtaggataaaaccgctctggattgggtcgaggggggtaattcgtccggtattgaaagttcaggatgagcaatgtccggtttttaggttcagggggtaattcggacgaccacgatagttcagggggtaattcatactttttccttttactaatgaagatgagacttggccctattccatgaagtcaacatgacggtgttaactcaagacaaatatgtcatttatacccttgtgaatttaacctggtttcttaaagttttttattcaatgcagttttgtgcactaatta

SEQ ID NO: 9972 - DNA, 1501 bp, Oryza sativa
cagtgggattgcaccattgtatcatgtttagttccagtatgtacatgccaagcagcaccaccagcagactgacacagtgataggcgccgaatggtacttctgtgagcgaggtgtacgagaatctttacagacggcgagccattttccactctcgtaagattgcggcattttgctgcatgaatgccggccgttgcattctgcattctcctgctgcccatttggatgacacaggacacgacccgctcgtgcaggggttgccactgacaatgccgagctatggaagccattggcagccaaagccacgtccatatcccgaggtggatgaaagaccaggcatgtcctccgtgaacatctaattcctcatgcctcctaaaccccaacacgcacaaatgaaccgaagctttttagggcactcccaaccctccacctagtgtctatagaatttattaggctgccacataagcaaaaatatgatctgtgttggcggctgtaaaatgtcgattctataccgccaacatctacataaagttcggataataaaacatctaacatagtgataggtgcttaatctcacatattccataagtgttggtatatatttgtatgcagatgataaaccccgatgttgggaggaaaatcagagtatagtgagagaaatgtgtatccatataaggaggggttgtgaacttcatcaaaacatcagtgaattaacccaaaactgcgagaaatggacagagaagagcccagggagtccacagatcgaaggccaggctaggagggcccagcccaggttcagccgaacccctctgatcactgttgatccttgggtttggcttggacgctccagatgctctcccaatgatggttgcgaggcaattcggacatttccccttacaatcgtcatacctgtcctataaatagacctcacttcattcactctcacacacacttccaagcttgagctgaattataagaggctctattgtactatattgtatactagaatagaaagagagtagagtagaagaagtcggaagaattccggagttgtcggtaatcttctcctatttttcttattctgtttataactttgaatttaatataatattcttctcgagtaatttagatttatcttgtgagaattatctcttggttagttcctaaatagcatacgtgattattgttcactataattaactgaaatatagtgattgctttggtgagttataaacactaaagtagatagtaattgcttagacgtggtgtttaggtaattgttatccagtaattgatgtgtatcccgcagtacgtttgaggtgggtgtagaggtggtgatagccctcaagatcacttgtaagtcctccctgtccgggtacatagtagagcgacatctgagaacagcgggttgccagtgcctgaagtattgcgttaggattaaaattaagctttccctagacactgtttctcactaataaatcctctctatcctggcctatcattt

SEQ ID NO: 9973 - DNA, 1501 bp, Oryza sativa
ctatagacactgtgcattggggaggtagtgtctacaaatacatttattattgtttctctcttttagacactacctatagacaccgtgggttgggagtgccatagcatgttcacatttcattgtgattttcagtaattgtgatcggtatcccgggctcccaagttccacccagtacctatactgctcccagattaatcaatgtaccgacactaactgaaacctattaatgtcactgggagcatgctgctgccatttgagtcagtgctcctagacttttcttttcccggaagaaaggccatccaatgatagaaggaaaaaatattataataaagtttttactcccgccttatttactctatggatacttcttcagtaaaggcaacgtactacttgacaattgatgaattgtgaagtaactcagatgagtattactccctccgttccttaatatagggtgcaactgctctggaccctaataccaaggaggcgtaactattttctcgggtgacgacgcatgcaacgtttgctctgcccgtgtgcagcatgcatgcagcccttcgcatctgcctttaaatgcatgcatctgttcgcatcctcccccacgaacgaccagctattttggcgcgcgaaagaccccgcgaacgcatgcacgtaaaaatagcttggagatttggaggcatcatcaatggaatgcatcaatgaaaattttggacgcgccatcaacgaaaatttcgaacgcaccatcaacgaaaatttgaattgagctaatctaatcgccagcttgttctataaatatggtgagagacattcattccacaataagcttgtctcagctttcctcccatgattgaacacaatggcaggtttggatctaaatcaaccttttaattgggatgaagttgaggatttggagggtgaaatacttgatttgaactacgattatgtttgctatttagagaacgaaggtgtgtacggttgctgctagtgttttcttatttttctcttatgtacctagtgtttcgatcttcttctatgatctgtatgtgcttgatgatctagtttgttatatcggtcagatgaagaaggtgggcacgaagacgttgacaacacagccgcccgcggcgacaatgatgatggcggcggcggcggtgacaacgatgatggcagccgtggcggcaacaacgatgatggcagcgacgacggcggtggcagcggcggcggagacggcgacaatgatgatggcggcggcggtggcggtggagcacacgccggcacaggtaatacacttaagtgtttttttttgctcagcttgtttactggatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgtaatatatgcacgtactaagcatcatcaaccatgtctaggtatca

SEQ ID NO: 9974 - DNA, 1501 bp, Oryza sativa
gcttgtttggtttactatcataccaaaaaaaataatcaaaatctaggtaattttttacaatagcaatgttttggtaaggtaacattgaaaatgaatgtgtttggattgatgtcaattaggagccaaaatttatattatggtgaagaaagttctagaattgtgtcaaattgagcatgggcattaccaacctttggcttgaaaccaagccaccacattactaactatttaaactaaaaaatactatatattttggcattgatccaaacatgccctaaaatctatatagtagcaacaaaaggcacaaacattaccgtgagaagagaagggctcaccgggaaacactacaggtaggtcgattggctgcggaatcaaagcaatgaactcgtcgcgcaagcgctgatggccaccaccatggagatgccacgaaagacaggagataaggagaggacgaggcggcaaagaggcggcgcattgaggcaggaaaagttgtccagccgctctccaccgtcgctggtcccgcttcgctctccgccgtcagccggccggtcacgaggcggcggcgccggtgcttcgattgttggctgggatcgatggggttagggattttagtggggagacgaacagtttagttggtgaaaagaaatttatttttgtcattgaccggatattaaaagatattttcaaatacgaataaaagaactaatttcataactcgcctagaaaccgcgatacgaatttattaagcctaattaatccatcattagcacatgtgggtttatgtagcacttatggctaatcatggactaattaggcttaaaagattcgtcttgtgatttccatgcaaactgtacaactagttttttattttatttatatttaatgctccatgtatgtgttaaagattcgatgtgtctgcattgtactgtgtaattttaaaaaaaaattctcctccactctgtgtgtgtttggtttctggaatagttagaaaagaatggaagtttgaggggtggggttgttaaatacgttgtttggatggtatctacggattgaaggagttctactcggacaagactgggtctttaccatatcgtgaggggtccgatatctccgagtcctacttggagatcaagtgacccgcggtatataagataccccctgggtaggacctaaggcatcgaatatcaccaccaacacatccaccacagcctacggagccggagcacgcaggagccaagccaccgggagatctagtgggaccaactcgactacggtctcgtcggtatcatcgagttctgctattccctttataatctgtggttttcatcatataatcccataccaactggattatggctattacttaccaaggagcctgaaccagtataatccttgtcttttgtttgcttgttgtcgtactatgtagatcctcgtaccaatggaccccaataccctctatatctggtctacgggtacccaccgtcgacagcgctgccttcctgtg

SEQ ID NO: 9975 - DNA, 1501 bp, Oryza sativa
ttgaaggtttatttgtctctagcatagcttgtatgtattctagtcttttcatgagatttagattttgcttttaagggagatgatgcatgacacttaaattctatacttgaattaagaaaatatgcaatgttgatgctagcatgtggtttgatttataaatgctctatatatatatgctttattgaattgttattcctcaaatagctttaattgctcattgtgaaaaagagaataaaaaatatgaaaaaaatgaataccgaatccttggaaacagtcttgacgacaaggacgtattcgatgtgagcaaaataatgggtgccgaatccctagaaacagtcttgacgacagggacgtacccggaataaaagagaaaaatatgagaaaaaaggctcaagaaaagaaaaagttaaaaaattctcttggttattttgtgctaaaggttatttgagaaagagtgataaatgtaataggtatatgtgtttagtgtttattcttcaacctatgtgcttgttcagatgttgcattataaatcgtatgaaatcatgaatttcgattgttgattcaagcttaattgtaaaatctttggtttatggttatactttaatacatgcttgttatcttatagataggtttatcttctttttattgcaacaaatgacttgatatattatatgtatgctaagctcttgaacattaatgaacataattcctatgttggatgaaatcattgtcaaaagggggagaagtattgtgaaaatttttggatttttgggagaagcaaggtgaattttcggagttgttgagaagagcatgtttttgttcaattgggaatttctttcttttaaaaagggggagaagttttcttttggatttttgagcacgatgtgtacgtttgtacgacgtgtgctttttaccacttttgtttttatttttccaaacaccaaaacatttttgataggtttgccaatgtgttcatcaaaggggagattgtaaaaccaaatgtgtttttgattattattctatgatgaacaattggcattggagattattggttttgttatttagaatttattcacgaagtggttttggagatgattggattcataggtgatcgcaggtttatcattttatgtgaccggtcagaccgggctgtgtatgccggtcagaccggcggtgatcgagcggtcggaccggccagcccacggtctgattggccgacgctgtgtcggtttcggtttcgagttgtttgtttggatatccgtgattgtttcatgattatggcttctagatggatactatacgtatgcaatactgttgtttgctactaatgagtcaagttggagatagcttggtctcggaatatggtttctttgtttatttcatgtgtaggtgactcgatgtctcgggagagtatttgcggtgatggaccgggagtcggcttggggataagacgacgtccgtggtggtcagagatcatgtgggatactaaggctagagttga

SEQ ID NO: 9976 - DNA, 1501 bp, Oryza sativa
gcgtcggattgggcggagctacgccgagcgaggccagcgacgagcgggcgctatggagcacgggcggcgacggcggcgagcacacagctagcggcggcaacggtcggggcggcgccagctagctacaggaaggctacacatgctactaccgaaaactaaggggaagagatggatcgaggagggagaacgggggaatgcactaccgagatgaggcggggcgctgtgacgagaggccgacggcacgggagtgatctctccagcctcgggccggggaagaggaagaaggcgagcgcccagagtccccttccgtgtcctcgctcgtgccggctcctccggcacgcacgacggcgaacggcaatagcgaatagagcacgggaggcggcgacactggagtggaggcgaatgggagaggaaaggaaagggggtgaagcttgggtttatatgggcgacaatgtcggtttgggagaggggaaccgactttggacggtcaagccagtgagctggcgctccggctagcggccaaatcggcgacagggaggaggggaatgacgccggcggaggaagaaaaaggaaaaggaaggaagaaagggggcttgccccttgccactttcggaaaaggaggaggggatgggggcgacgcgacagaggggggaggagctctgcctccgtcccttggaggctagcgcgcggagtggcgggggccgggtcgatgacgacggcgatgacggcgggggcggtttggagcggagcaacgacacgggcggcaggcgcggcaggcgctgacggcggcggcgactggccggtcggccaccacggcgcgcgcgcccgggtggcgcggcgatttgggcggcatcggcgggaacggcagcgagagcggagagggaggagggcttggcgcggctcacgggcagagcggggagagagagagagagatggggagggagggagagatgggccgagaggaattcggcccatcgaacccgagggaggcaaagtagacttttgcggagggatttgatttgggaaggatttggattcgggattgaacttgacgatagatcggggattcgagatctgagatggcacggacactagacaacaagcaaagaaacagatttcgcaattaggatttttaagagatagttttcccgctaggcgccacgacagaacgggcgctacattaggctagagttcaatgcacgtggttggtgaatattccataaggcatacgatggacttattgtgtgcgtatgggatgcggagtcgaatttggaaggagtccaaatttggtatgattggagtttgtaaagtttgtttcttgtacgagaaggtttcctaggtggattaggacttctagtaggagttttgttcgtgcctttaggctgcctacctcatgtataaatagagagggagcgtgaggcttcccggtatcggttttgagagcattgagttgagagttgagttagtgtttcaagtttagtcgagattttcgtgaggggtg

SEQ ID NO: 9977 - DNA, 1501 bp, Oryza sativa
gaattctggagttgtcggtaatcctctcttatctcttgtactttatttattactctgatttaatagaaatatcattctgagtaattaagatttacttagtgagaattacttcttggttagttcctaattagcatacgggatcattgttcactatagtccatttatttatagtgattgctttagtgtttgatcggcactaaagtagttattaattgcgtagatgcggtgcctgggtaattaatctccagtggttgatgcatatcccacagtacgtttgaggtgggtctagaggtggtgacagccctcaagagcacttaagtcctccctgtccgggtacgtagtagagcgaaatctgagaacaacgggttgccagtgcctgaagtattgcgttaggattaaagttaagcttttcctagacacatcacttctgaccctaaagggaggtgttcggcggtggacgctagggtttgttggatgcaacctgtagctgtcgttctacgtctattatagtttttagataataaattaaaacccaggcctttacatctaaaatggatgtacagagccatcctagatatatactccctccgtactcgtaaagtaagccgtttaggacaatatttaagtcaaaccttgagaacattaaatcatgaataactcttaagttgttgagtttgaaaatttaaaattatatgaatagatttgccttgaaaaatactttcataaaaatatacatatatcacttttcaataaatattattatagaaacaagaagtcaaagttgtgttttggagaccgtgtcgctgtgcaaaacgacttcctttatgagtaaggagggagtatatatatctgagaggtcgaagatgcattctatcccttgtcccacaattaagctcattgatcagctttcgtcatcatcccactgctccccgcatgttgcccaccttgttggaaataaaccttacacgatgtatctagtagtagctagttttacgttcctttctgttgatgcatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtga

SEQ ID NO: 9978 - DNA, 1501 bp, Oryza sativa
ttcgcatggcatccgaataactaaatactgtacaaactatatattggcaacgtatattatgtcgtcatacatcattctataaacatgcatagctaaattagatcatatgtaaataaaaattacaaattcaattgtgccaacgttttcatgtaaaagaatattttttttgagggaaatgtaaaagaatatttatctagggaccacactattaccttttttttgaaagaaaattggaaattttaataataagttgttgttcatctccagcttcagtcacagcataatcacgttgtgtcacctcacttaaaatagttctcagaattctcatcatgtctggatttcgtgatactgatacgaaaaccgaacaggaaaaatttcccttgagctgttggtatacttggtatgcaagagtagttttaccaagtcctccaaaaccaacaaccgagacaacctttggatgttgttgctttgactcacagccatcatcatcggacaataatttgattacttcatttttcggcccttcaatacctacaagatttgaagcatgctcaaagatagagagagccctgtggtcaatgattgtattgctggtcctgcagatggtcttctctgatctataccttgcatgcctttctccgacaatgttgatttggctcttgaaatcttctattgccttggcaattcgacgtttagtcttcatatttgcgagcgatttcttacacttactgatgaacccatctggagtggcagattcatcatcaacatggaccatgaactcgtcaataatgtcctccatgtcgtaggatagctcccttacttccgtcatccaagcctggtcttgggcatcaggattctcctcctctgacatattgagaaggaacgcatggatggccatgagttcggtagagagagacttgatctccttgtgcagccccttgaagatcgtgtacttatcaccaagcagagcggctagcttcgcaaggacgggcttcaaagccccggttgctgtgctcactagagctccctccatctcttaaaactctgtctgttttgagggcaacaacaaacccgaaaattattttccattaggaacagaaacatgaatctgttgctagctgatacagaatacatgtacgaatcatatacagggacataattaagcttgcttaagccacaagcacgcaagacagagccttaagccggagggatatagtaggcatatagcacacaaacctgaaagtgatctgtataaagaggagatgacagatcagggtcagaagtcaccacagagcagaagaaaactcaacaaaagctgcagatatatcggtatatatgctgtactatgctattagccttctagagaatggtgtcgctggaaccgatcgaatttgccagggcatatatataccgctgagcagcgagacttgacgcgccttgccggtacgacacggccgggcaggaatgagtttttgctggggacagaacttgttgattcagg

SEQ ID NO: 9979 - DNA, 1501 bp, Oryza sativa
gggcactagggcaggccgcactgccgcacgtgtccagggctgatccaggcgataggggcagccgatgtcgccacgtcgggcataatcagggatagatctagacggcgagagactgaaaggtgagggacgagtcgcgcgttttgtggaagacggaacaatgccgctctgatttctggtcgccgattcgctaccctggctccctgattcgtcgtcacgcgcgcatgaatcgatcaaaacacgtgcgatgcgactcctcatctcctctcagctgggccttctccaccaataaagaaatctatgggctggccgaccgggccttgtcgagtggaagttttaggctagacaatggagaaaggttccttggtttgggctagaggggtgcccatgtggtagagatataggggttacaagatatttcgaattttgggccgggttcctgggcacccccctgggcctattgggctctgcccctggcgcggccgatggggacggtggcgaagggcaccacccgcgccgccgtgcacggctcgcgctcgccggccacgaccaccctccatgtaagtactccctccgtactcgtaaaggaagtcgtttaggacagccacggtctccaaagcacaactttgacttcttttttctataaaaatatttattgaaaagtgatatatgtaacttttatgaaagtatttttcaagacaaatctattcatataatttttaaatttttaaacttaataacttgagagttattcatgatttatattctcaagatttaacttaaacattgtcttaaacgacttactttatgatgagtatggatggagtatacgtagacgtagtcgcgcgcgcgtctcagctacttaattttagctgtcgcttcagttcgtttgctgctgaggcatatatatgcagaacaaggaggaggtggaaacggcggtggagagaggtcgggagcagaagcacaaggcgagggaggaagtggaggacaaggtggacgccagcatcgccgaccaccgccagccaacgaccaaataaaatgatcatccgagacttgatctgtgttctttgtactattattagtagcttgtaaatacacggacccaggaataagtaatcttatggatttatagcttgtaaatacacggacccaggaataagtagtcgtatggatttacgaacccaggaataagtaaatcttatggatttgttacatacacaaaatacacgatgacaacaatatttgtttcaagttaccgacgtttcgacattaatctgagccgtggggagaaatctggacgagcacgccaagagcggcatctgatggtgcagtatttcagtctccagcatacgtcgccgcaggtcgccagactctatgtctatcattcatggacatgatcgtgcagatgcatatctcaattgctccatgatttatttcaagtatcgagagaaatcaagtgttattttttcctctttaaacatacaattattctcgttcctcgttc

SEQ ID NO: 9980 - DNA, 1501 bp, Oryza sativa
ggttaaaaaccacacagccattctatgatctttagtcctggttggtaacaccaacccggttgaaaaagtgtccgccccctactctttttattcccggttgaaaacaccaaccgggactaaaaatcgatgcatagtatatataatccctcgcacttatcctctagcaaccatatcttcccttatcctatccctttcctctctctgtctctctctctatcctatcctctcacgcacgattgcggcagtgggtgagcgtgcagtggacgcggggaggcgcggcgggcagcggcgctcggtggcgggcggcgcggaggggcgtggcggcaggcggccgggcgcacgcggagggtcggccggccaatgtttttcttttttttccccccttttttccctcttaatttgtggatgattttttttgactatatatgttttgtggatgatgattttgttgttgtgaatgatttgggattatggatgatgattttgttgttatgaataatttgggattgtggatgacttgggatgttgggagatgaaccgtggatgagttcaactgaaaaaagtgcaaatagataaaaacaatgatccacaagcatctttactctcgggtatttaaattggaactaaagatcgtcatctttagtcttgaatttcttctctcggtctgcaaccgagactacatgggttatgagccgggatagaagatgcattctccagtagtgcaacagttccagactcattcctacagtcttattcttctgcattgagatttaccactataatttgatttttttttttgacacagggagagggagtatgccttagcactatgcagaaactattgttaatattgaccgcctgagctgagtcaagccatgtaggttccgggcgggcctgttaaaagcccccgtggaaactgcgcagcgcagtacacaacctgctgctagcctccgaggcctcaactagctagtgtgaaccatggcgttcgagctggagctaggccctcctcccaacacgaccatggactccatgagcgtccggtaccttctcaaccagatcggcagcgaccgcacgacgcacatccagatcctcgccacggtgggcggcgcgctgctcggcttccaggcgctgctgggctaccggcgccggcgcagcagcaacaagctcttcctcgtcctgctctgggccgcctacaccgtctcctccaacgtcgtctcctacaccgtcggcctcgtccagtccgtcgccgagcccgaccgctacagcgtgcagcagtggtgggccgtcgggctgctcctcctcctcggcagcgccgacaccatgtccgccttcacccgcggcgacgccgagcagagcaaggggatgatggcccagcacgccgtgcagaccgtgctcgtgctctgggtgctcgtcacccgggccaacaacgccatcctgctcgaatcctcctccccgcggcgtcaactgggagtggaccatcacgctctccgtctgctggctc

SEQ ID NO: 9981 - DNA, 1501 bp, Oryza sativa; identical to SEQ ID NO: 5729

SEQ ID NO: 9982 - DNA, 1501 bp, Oryza sativa
aacacatagatttctacggatgacactgagatttgtattttgtacaggttgatcgggagaagatcttttggcaagtaaatatgaagaaatcaagtattccttctccacagaatcaggctacgaatgctgacaagggtcaaatgtgtgatcaacaacaacacaagtgcccaagaaggtgtgcaatgggcactcttcccttgaacacaaacatggacacactgccatctgctgttccttctccatctggaacaaagattcctctataccacgtagctcacagcagggccggtgataaagggaatgatttgaatttctccatcattccgcatttccctgatgacattggtcggctgagggcagtgatcactcgagattgggtcaagaatgctgtttcaccccttcttgattcctccttgtttcccgctgatcgagcaaatcaggttcggtatgatccgctcgagaatgtaagtattgagatttatgatgtcccaggaatcagctccctgaacgttgtcgtgaggaatatcctcgatggcggtgtgaattcttcgagaaggattgatcggcacgggaaaactctatcagatctcatcttgtgccagaatgttgtcttgcctccgtgatcgcagatatctatctggttctgtagcttccgaccggggcttttagaagcttgaaaatttggcatgcaaatagccagaggtgaaccgatccctttaccttcatgaagctgcattcgcttattgtatgtaccatgagaaaaataccaagaaccgtcaagtatgtgcatttccaagacataccttggttgctatattagttgatgagattttaatgagttccaacaaatcttcgatgtcatctctcattagtaagtaccattccaaattagtcaactctactttgatatcgagtttgtgaataatgccgtttggattgagctggctaataaatcaattcagctgttgctacgttcttcctggcgtcctgctgttgccattaatttgtttctactgtttttggcaattggcagctagcacagcctctttgttttgccatgaaagctatagctggaactcctcgccgcaaaaaaaaaaaagaaaaagaaaaaagaagaagctatatatatagtaagaaaagaaaagaaaagaaaagaaaagaaaagagaaagctatagctggaacatttggaatatattgcacgctgttcgccggtgaaatctgttactacagaacatcctggtaacagtatcatttgatagcacaatataaggtgttttgctgggggctgctcactggccataatgtggggaccacattctaaacttatcttcaaaaggttgtggaaaaccatccaaaaagaagtgttgttttgatctaaacaagtccagatcaacattgtttcaaccattccactttctatacacatacatgatgaaattaaccagtaaaaataatatgttgggagagggtgagcgaaattcaatcctactatagtgtgg

SEQ ID NO: 9983 - DNA, 1501 bp, Oryza sativa
agttaaagctcgccggaccgaccaaatcgccatgaacacgtacaggtctgtaccttttgccggtactttgcacaggaacacattttgctcagaaagaaggaaaggtggtagtactacgtgtcaggtccatggaaaacaaaaaagggatggtcaactccactccactcactccacggtccaatttacgcacctcccccacctcggcgagtcgcgacgcttccgattcgatcggttcgcgttccccggcgtcggacagacagccttcacgtcgtctacacgtcgacgcctcagcttctcctccccaccccgccactccccgccggccgccggtcttctccgcgaggtaaaccccactcgcgagactctctctctctctctctctcgctcctattttgactggcttgggtgcccacggggtgttcggcgttatgccgcagaggagagattcttcgattccctcgtcgccagcggtttcgcgttgccgcgttcgtctccttggcatctgatcctattcccctctccgcgcacgtcgggtttcccccccgtggacaacgcaaccgaccgaccaagctgcggacagcgccgtctctgctgtctctctctgtatgcttcccttcctcctcaagctgggcctcggtggtcggtggttaggtgaaggtaaaccaccggctttctcacgcgcctttctttctgttcatttccttggggtttaattcttggttgccagcgagcccggtaggcagtagtccacccaccggcaggttcttgctcctcctcctcagccgctgccggatttgagatgagatgagatgaggaggcgctgggggtgcctctcctccctgtgccgccctcgccggggtggacgcgcggcggcggccccgctcccgcagccagatccaccgcgtctcgagtccaaggtatctatatatcatccgtagctactagctagtgcctttgtttctttccaacttccaagggtaaatgagttttgctagttctctgacctggaaggatccaggatagttttgcttggtggtgccatcccttgctgattgactgcgtaccaaccgcaaagggcgcaaggaatgtttagtcagggcgtgtttacagtgtgattgatgaaaaatggtggtggagatcctaccaataagaaatggaattatcttttaatttcatggttggaattttgattgtttgcaagatatatagtcctaagagttaaatttcaaggttggaatgcaagatatgtatagttgtagagtttgacattgtaggaaaggatgaactagataccactaaaaaacatacagatccagtgatacacactaatatggtttgagacctatagttccacgagtccctaacaatctacatgtgtgataggatgttagctgtccatgaatttcagttcctctcccaatgacatggactagcaatgcagaaatttatttatcatacaatgttgagcaggaagtagaggagcacggcgcttccgataaag

SEQ ID NO: 9984 - DNA, 1501 bp, Oryza sativa
aggcatccaacatggtgtgctatccattctacaaataaataagaaaaccatctgtgacatatgtttgattggaagatgccccaaaaactgctattgaaaaccaatgaaataataagaatagatgcaagcaacaaaccttcacttctctgcattttggttgatcctactttcctccatctcctgttggctcatatttgtggaagcatctttggcgctaagagaaattgggagataagtagaacacatgatagatagaaatatgcctcaaaatttgttactggaagccaagaaaaccataaaaaaaaatagatgcaagcagcaatcttcacttgcctctctaaagtttggttgatcgtacttctctccatctcctgttcatttatcttcatagatccacttcagtgttgagagaaattggaagaggtatggcatgagagagagaaaatgaaaagactcataggaagcaagtccgtagaaattggaggaaaaaggagtcctgcaaaggttttggcatctaaaatcaacctgggcctactgctcttcccctaaggcccatttcatttttgccttatctaatccagaggatacagatggatggactggattggagctaatgccaccctctgcattagcttctctaatgtagaggacccaaatccccaaactagagttgaaaggccatattttgagcatcggtgcaaaaataggttgtggaggatagattgcaaacttcctacagtgaccacatgagcaacggaaactctaatgagcgatcaatcgccctggctattggctagcaatcgccccattcccccctccctccctccacctggtttcctttttttggcaccgcattacttttctattttagtaaatttatgcacctaaagtttatacacctcaagtttacacatctaaagtttagagaccaaaagtttataagtcaaaagtttatatatccgattcaaatttgaatttgaattcaaatatttttttatatatagtatttctatacatctaaaatttatacacctaaagtttatagacctaaagtttataagtcaaaagtttatatacccgtttcaaatttgaatttgaattatatctgattcaaatttgaatttgaattcaaaaattttctatatatagtatttctatacatctaaaatttatacacctaaagtttatagatccaaagtttataagtcaaaagtttacatacccgattcaaatttgaatttgaatttgaatttgaatttttatatatagtatttctatgggtgaatagccaaagtggtcctccaagtttcatcgaaagctcagtttagtccttgatgtttcaatctatccatattagtcattcaagttttcatcttagttcaaacttatccttgaaccaacaactctcttgataaatgacacttatacccccatcattcacatatataacagaaaattgcatgcttgatttttttttatagaaaatgcatagtaaattatg

SEQ ID NO: 9985 - DNA, 896 bp, Oryza sativa
caccttgatgccggtgttcgccatcgcggccagcaccgtcgggtccgcgtcgaagatcctcaccgcggagatgccgttcgccttcagaaggctcaccgccgccggtggtcgatcaggtcctttgcgtccctcccgtagcacaccccgatctcgcccgcatctgcattgacgagcaaaaggaattttagcatcgtttggcgttgccgatcgatcagctactactagtccaaaatcgaaagcgtttctacgtttgccatggttacctgtacgggagatggagagcagcagcaatgcggtggcaaggaggagggagcagaggaggtgagtgagtaccatatgtgctctgatagtttgatcaagacgaatttgatggttgggacaggactgaggtgcaggaatttatagcaagctagaaattaaagcaacaaaagtcatgccacgacagagtagagaatgaagaacttgatacctaactgagttatgaaggaaagcacatatatgccattagcggggtagggggcataattatgtactgcttcagcttatcattgcgcttgtttatcatcattaggtgaaagccacatatacaagcataacgcatcataagcacgtccgtgcgggagtgtgtcactaacacatgctcgaagaaacccaaggtagcaacaaatgaaatccatccatttagcatagatcatttttttggaagaatctatatttcaccattgacagatcatcagttctacaacctacctttaatgacgaagtgaacgtagctgaactgatcattagcttccttgtggtggaacttgcttacctgggttcaagtcgtagatttgacacgggtgctcgcatttcactggtggagaaaccctttgtagtcccggtttgtaaccccc

SEQ ID NO: 9986 - DNA, 1305 bp, Oryza sativa
cttatatatttaggtagtgaacttatgaaaggaaattaagtaaagaaatcgcattagtattgacaaggaaaaggtgatcgaggtatcgagacagaacttgaaaaacttattttgtagagtagaggtctgaatttaacacatactatttgtttgaaactgggtgataagatgtagaaacacatctcgggcgaaaaacattaaacatgtaaattacgaacacaagaatgtgtgaggctgattatttggatgattcacatgtataatgtcaattctatgcaaataaaaggaaataatatgtcaatgttgggttctttaaaactcctaaaaaatatagagaaaggaatatttagtgccaaaaagataggcgttagttattaaaaaagatcatataaagagaaaaaaaacattttgtcgattactttaaaagccctcaaatggtcatttagattgaacacatttttcctaaaaaataatttatccatgaaataaatatataaatatcccattgctttagtgtcctcactaatctcatgcgatcccgcggcaacgcgcgggacgtttttctagtataactaatatgtttagagatgttatacaaatggaaatatcaaaagcattctgaaagaaataaggtgcaatgctttttgggaaatatagcaaattttaacattaaaactttatcctagaatataatagttttttcacctacattctcttcgtaatcaatcacaattttccactattcgaattcttcacctaactcctcttctcaactactaatcttttcccacttaattatacttactttcttaacaccagtgtgtgactaaaagatcctatattttgagatggctgtagtagttttagaactgctttctagagcaaagacacattttttcagaaaaatccaaaaatcactttcggagaaatccaaaaaaatcactctaggacaagtctgaaaatgaccagatcaaaaactttgatgcagagtcatttcaatttttttgatgcagagttattttctgaaattctaaaaattaagtccggaaatcactttaggacaagtccgaaaataatcaaatccaaaatttcgatgcacagtgattgttgacggttgttatagaccaatttcggccgacaatataaccggaattaaggagaactagctatgcttgcatgcatattttgtttaagaataatctatctccacttgtacttggaattttatttgtttgctgagaactctacatattttgtttaaaaatagctgaacaatcaatcaccgcccgtcgagaggtagactca

SEQ ID NO: 9987 - DNA, 1501 bp, Oryza sativa
acaggaaccaaccatagaaaaaataaactcaaacggacaaaatatgtgacttgtagaattttccaaagctctaccgaaaagtcattcgggtgccatttattaaaataggtgtaactttctcatacggactcggaatcaggcaaataatatatccacggacatctacagaaaaggttacatccgattcttccccgctttgccgggtttggcgagattaaaacctccgaattgcgcttgcaagattatgtttttgaggagagaagtttttcggtagagctttggaaaattctacaggccacatattttgtccgtttgagtttattttttatatggttggttcttgtgtgctcctaagcgtgaaaaaaatatcaaagaaataaaataaaaaaaaaagttgcacatctctctcttctgcactagtttagagagagatgagaagaaaggaaaaattctacaagtcacaaattccgtccatttgagcttattttttctatggttggttcttgtgcgttcctaagcgtgaaaaaaatatcaaaaaaataaaacaaaaataaaaaatttctgggggggggcgccagccactctggcgccgcccccccccccccccaatgccacctcagcatcgccccgccacgtcggcggggggacggcgccggagaggctggtgccgtcccgttggacgacggcgccagccactctggtgccccaaaaaagactatttctgggataagtttttttaggggtctatttgcgaaataagttttttaaaaggaccaaaatgtgaaaaattcagctagtatgggtgccgaccaataggtgtcggttagaaaaccggtacctatacccagttgtgaaccggcacctatggctctgtagtagtgcacacacgctgctcgtcgtcgaccttgccgatccgctgctctggtcgacgtgcccgtccatggaccgcacgatcccttgtagctccaacatgtgtaaggtcgagggaaggtgcgcttgcgctgtgtacccgtgcaaccctggtgagtgggcagtgctctccgcgaacaccatcgatggcaagaacccgttgttcccagccagcacgcactcgtgctcggcgccgccgtcttgtgggtgcttgtcacacccggagagtttcccctttttcgtagtttctaattcaccaataaattgtctataaaaattactttgattaaccaggagaaaaccctaattaacaatgtattaataatcgaaaatgtcagggagaatttttttttcgaattctctttgctctaaaatcattaacgggacttaaagtggaatattcagagcatcggaattaatgttattaatttgaattcccaggatttgaattaataataatttttctccccacctttggtcgtgaatcgtgcccgattcactcctctcttcgtctgcggtttcgttttgcataacgagccgagtccgagtcagtttccggttccgttttcattctttcccaaaacggcaccgt

SEQ ID NO: 9988 - DNA, 1501 bp, Oryza sativa
acagtgtgcccaccgtggcgtctgcgcggggtgttgccgctgctgccgcccaaacgccaggaggaagtagatggataagctcgtcgcctcgggcggaggggaccgaggaagagggtggtggtggcgctgctgcctcagaccgagatggatgtcctgcgcatccatgctcccacgatgcccacgcgacggctttgcggagccagtcggggcacgccgacactcgagcgacaacgacggccggcatgccatggtcctgccgcagtgccaccgcgagccgggcatagtccgctctcttgttcccgtgcccctgcaccactaccaccacactacaaaaaccctcatagggatcggccttataggtgccggttcctttaaaaccgacacctataggccttttcccacctccgcacgtggaaaaaaaataagaaccgacacctttaaggcattattataggtgtcgtttcattagtaataaccgataccaatgctataggtgtcggttttttaaaagaactgacacctataatattttataggtgttggtttttataggtgtcggtttatttaaaagaaccgacaccgatttttataggtgtcggtttatttaaaaaccggcacctgtaaccgacacatatacaaaaacgagccgacgagccgagcgccgtccttatctactcgatcaactactcccacccacgtcgttgcgtccttatccactccctctctctctctctagcggatgcccggcggcggcggcggatgccgcgccctcccctccgccagatccgacgggaggggaggcggccgggcaacgggcggcgcgcggcggcggagctggtgccctcccctttgctggatctggcgagaggggaggcagcgggcggtgggcagcggcggaggtggtgccctcccttccgccggatctggcgggaggagaggcggcaggcggcggcggaggcagcgccctcccctccgctggatctggcaggaggggaggcggcgggtggcagcggaagaggggctcgtcggcgacgaagcggatggtggaattgggatttattttagatgttttggtggatttgtggattggagtatgttcatactgtgatatgtgattgtgaattgattttggtggcgatttatggatgatttggggatttggggattttaatttgatttgagagcaactcgggcgatgacgtagtgacagtgttcagtgagctgagccgagctggttttttttggcttgagtaaagctaaaggtgccggttttattttgttcataggtgccggtggctagtattggctggatttttcacattttggtccttttaaaaaacttatttcacaaatagatccctagaaaaacttatcccataaatagttctttttgggtgccagagtggctggcgccgtcgtccagcctctctggcgccgtcctcctgccaccgtggcacacgcgaatcgacgtggcaggaggagggcgctagcatggctggcg

SEQ ID NO: 9989 - DNA, 1501 bp, Oryza sativa
gattccgagtccgtatgagaaagttacacctattttaataaatggcacccgaatgacttttcggtagagctttggaaaattctacaagtcacatattttgtccgtttgagtttattttttctatggttggttcctgtattctcccaagtgtgaaaaaaatatcaaaaaaataaaataaaaataaaaaaagtgcatctctatgtactgtttaacttatggctatcatttcatttggttatattttgaattagattaagtaatttcatatagtggtggagtgcattatatttaatatgcagatcaaatggttttactaaaggagttatggtctaattttaatgaaggtgcaaagtagactaagtggtatgctatttctaggcttctaactaagtggtatataagtatattacatttgagtttaaatttttttgtggttggttgtatcgtgatcctaaatatgaaaaaacatccgaaaaaataaaacaaaaataaaaaagttgcaattccatatagagaaataggaatggaggcgaggggtggggtgggggggcggcgccagccatgctagcgccctcctcctgccacgtcgattcgcgtgtgccacggtggcaggaggacggcgccagagaggctggacgacggcgccagccactctggcacccaaaaagaactatttatgggataagtttttctagggatctatttgtgaaataagttttttaaaaggaccaaaatgtgaaaaatccagccaatactagccaccggcacctatgaacaaaataaaaccggcacctttagctttactcaagccaaaaaaaaccagctcggctcagctcactgaacactgtcactacgtcatcgcccgagttgctctcaaatcaaattaaaatccccaaatccccaaatcatccataaatcgccaccaaaatcaattcacaatcacatatcacagtatgaacatactccaatccacaaatccaccaaaacatctaaaataaatcccaattccaccatccgcttcgtcgccgacgagcccctcttccgctgccacccgccgcctcccctcctgccagatccagcggaggggagggcgctgcctccgccgccgcctgccgcctctcctcccgccagatccggcggaagggagggcaccacctccgccgctgcccaccgcccgctgcctcccctctcgccagatccagcaaaggggagggcaccagctccgccgccgcgcgccgcccgttgcccggccgcctcccctcccgtcggatctggcggaggggagggcgcggcatccgccgccgccgccgggcatccgctagagagagagagagggagtggataaggacgcaacgacgtgggtgggagtagttgatcgagtagataaggacggcgctcggctcgtcggctcgtttttgtatatgtgtcggttacaggtgccggtttttaaataaaccgacacctataaaaatcggtgtcggttcttttaaataaaccgaca

SEQ ID NO: 9990 - DNA, 1501 bp, Oryza sativa
ataaaataaaatccaaaattagccaaaaaaataaaataaaagaagagttcatgtaggaatacaatttaaaattagctgaaattcggaattaaaaataagcaatattaaaaaaataatccatataagaacccaatatgagattaattaaaattcagaaaaaaataaaataatacccaaaattagaaaaattaaaaaagagttcaagtaggaatataattttgaaacaactgaaattgaaaataaaaaataaaaatattaaaagagcacaatacgtattaattaaaatttgaaaaaaaatttatgaaactagaaaaggaaaaataagatttcaattaggaatacaatttataaatagctaaaatttgtgataaaaataaatactattgaaagaaaagaccatctaaaacacatgacgagataacttaagtaaatggcctacagaggagtagagcagtggctgttgatacaacatataaaattgttaataaaacaccgaatagaatcctaatgatgtttaaaaggagggacaacaggaggccgtgaagcaaatgaggaaggcgattgccgggacttctagaaagtaaaaaagaagtaaaccccaatgataatcatattcaatttttaaaatgtcaatgacaataaaaaggagaagcagccggcgggtgtatagtagtatagttgcagagccgctgacggttgatgggacttttagaaaataaaaaataaattccaacgatagttatgtttgtttttagaataaagagtaggcggaggacgggcctgttaacagtgaaatttggtaagcccagagtagtcatcggcttagagtcagcatcggcttcgaagtcctgagattagccgatgagagttgtcatgtcgtcagttgtcggattcttgctatattcggttaaggaaattgatctactaaaggaagcttatccagaaaagaccgagttcaaagagaatgcggcatggcaagttatatattaattaggaatagtttgttagtttccttttatctttagaaaagtgtgtttagtgtcctataaggactttatcttttccttttatctttaggaaagtttctttcttgtctgacaaggacttgtatcaacccatgggtataaatatgtacactctaggtctatgtaatctatcgctacgatcaatacaattcggcgcatcgccaccttttaccttttctactttattttatcatccggcgggacttggcacctgacgcggggctgcatcagtgttcaatctccggctaaagggtaagtccaatgttccgtcggcccaggcaattgtctaatctacatcagcatcgttcaaggctgcatcagtacattcgacctcttggattgctccggtttggatgatataattgtctacctatttatcatatgtctctgttaatctagtcttagcatatcaatttacctctatcggctgcttctcgctttagggtttctgccggtattggcaagggtgggcatga

SEQ ID NO: 9991 - DNA, 926 bp, Oryza sativa
taccactcgacgcgctgcgcggtggaagaaaacgctgagaagtcgaaggaactctcgcgaagtagcgcgcgtcgatgtagatgaagtagtcgatcgcacccgctcgaccttctcctcctcgtgcattctcctcgccgtactcccacaccgatcagcaccgcaaaccagcggcgcctctaccggtatccacacgtacagggacggaacgccacgcgcaaatgtgctagcacccgcgcgcagctagggttttgctcgaggagggaagtgacggctagggtttctcacgtgatgcaatgcctccgccggtcacaccctcacgaatatataggatccatcactcgggcctccaaggcccgtaggactcctattcggatccctatccgaattaagctcatattggatctctatccaatccccttattccgacccattaagcgtgcgaccctgtaggttcatatatactcgatcggctgtaacccgaaaactccttttcggtccacgcgtcaacagcggcccctagcagaatgtattgacccaccgggcatacataaagatcatatcggttgaacctctagtgtatacttgtatgaacccctttgcttcacgatatcgattaagctcaaggctagatatgtgccatcctctaatagctcaatcattcactcgaacctgttgatagattatataacttatgattggctcatcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagccactggtggagaaagggtttttactcccggttcgtaacccccctgtagt

SEQ ID NO: 9992 - DNA, 1501 bp, Oryza sativa
ctagggtttctcacgtgatgcaatgcctccgccggtcacaccctcacgaatatataggatccatcactcgggcctccaaggcccgtaggactcctattcggatccctatccgaattaagctcatattggatctctatccaatccccttattccgacccattaagcgtgcgaccctgtaggttcatatatactcgatcggctgtaacccgaaaactccttttcggtccacgcgtcaacagcggcccctagcagaatgtattgacccaccgggcatacataaagatcatatcggttgaacctctagtgtatacttgtatgaacccctttgcttcacgatatcgattaagctcaaggctagatatgtgccatcctctaatagctcaatcattcactcgaacctgttgatagattatataacttatgattggctcatcaatcacctttggcatggccatgcacttccataatctacaacatcgaggggcccagagatatctctccataggaggggcaaatcccatcttgattattcatatcccactacatgtttcatagcatacccgaaaactacttttataactacccaattacggagtagcgtttagccactggtggagaaagggtttttactcccggttcgtaacccccctgtagtcccggtttttcaaccgggactacgaatccgggactaaagatctttagtcccgggtgaaaaaaccgggagtaaaaatccatttttagtcccagttggtgttacccaaccgggactaaaaagactagatccggttgctctttattattttcttttcttcattgtttttaatcaaaatcacaaatcaatcccgtgcccaaaatcacaaatcaatcattcttaaattgcttccaaatccacaatcgatcatctcaaatactcaaatacatcacaaaatttcaaaggaaaattacatcacaacttctacaaaaggatcaaatattcacatcacacacaaatcaaatacatcacacaacaatcagatccaatcaaatacatcacacaacaatctcaattcttaaaaaaaaatatccgccgcctcgccgcgcgccgccgcctcgccggccggccggccctccgcgccccgccgccctcgcaccggccgccgctgtaggctgccagccgccgccgtgccggctggccagcctgtcgcgccccgccgccgcgcggctgccggccgccgcctcactgcgcgccacgccggccgggcctccgcgcccgaccgccctcggtctgttagagagaaggagaggagaaggagaggaagataaggttgaggagataaggttgaggagaggaagagataaggttgaggagaggaggagagaggagttaaaagagaaaaggaaatatctcgatccgatcgcgcatgcctattcgatctccgcgtcgatcttttttcccggttggtaacaccaactggaagtaaagcgtatggcgatcttttttcccggttggtaacaccatccg

SEQ ID NO: 9993 - DNA, 1501 bp, Oryza sativa
aagcaaaagaaaaaggagggaaaggtatggctataaataaaaaataaaataaataataaactcttgctcttccaaaagtggagcatgatgaaaaaaaatatatagccatactctctctatgaaaactaaaggatattttggaggaaaagcataagcacaaaggagaagcattttctttatccacatgtcattttgtaccatatattccacacacactttgcatgatcttgatctaagtatgacttgctatatgctttaatctagatttttagcttagtgatatatgtgactacaagtatgcctcatttgatccttaccaagctccacatattcaaccttagtataggaatcaaaaggcaatttttttggtgatgaataaatattcaaccacttttgagtgattgagagaatcacttgaggaatatagttttaatttgcaaaatttttgaaaaccatccggaatgaaaattaagcagggagatagaaaatggtactctatgatttgttcaatttctcaatctcttaaggtggtgagaagcgtgttgtcacgcccagaaatttagcccaaatttctagactattttgtgtattaaatccctgtctaggaccagccagggtagacaaaacgacaagtaatatatagttccaaacgtacataaagcgtaaaatacttacaggagaggctcttagtcctcgcaccgaaaaggaacgacagcagcggaaaaaggcgatcctagcggggcttcagctccactccacaggcaaaactcaactggggtctgagccttgggcttctaactttatcttcaactcagaagcactacacttctgaaaaggggaataatagcaaggctgagtacaaccaccgtacttagcaagccacaccaacgatgcagacgtgcaaggggatacaaggatggcttgaggctatttgcataaaggcggttgtaaaacattttattgagcaaaacagtaaagctattgagtaattaaggtaacattaaatctccactgatcaacgctacaccgcgttgaacaggcccaaccaactcacctgaactacagtgcattgagtcgatttattaaggtgagactaatcacggtgaatctggtcgatcgcccataaccgcgggcacggctattcgaatagttttactctggccagaggtgcacaactgtacccacaagacacaatccaccggcatgtcaccgtgcccggccggacacgccaccatgtcgagtgattgtgacaagacccttcatataacccgctctgaccaagcacaccacacctcaggtttcacccccgcccccagcaggcagcgggcagtcccctctcctgcctagatgaatccggaagcgataaagaccgtcgcagggcccgccccgctccatcatgcccacccttgccaataccggcagaaaccctaaagcgagaagcagccgatagaggtaaattgatatgctaagactagattaacagagacatatgataaatagg

SEQ ID NO: 9994 - DNA, 1501 bp, Oryza sativa
gtggccccgtacgtcgtacgcggcggcggagcgcgccgcccacgacgaccagcgcccgccatctggcctggggttgcctcggatacgacgccgcggcggcgcggctcgtcggagaaggggaagaaggcgacgccgcccgcttgcctcttcgtgggcttcgagactagtatttgctttggattctcagtcactcactaggcctggttgagagatgggctggtcgagctagtgggctggcatgtgaggataggttggttgggtagactattccatcttttaattcttagggtaattttcgcaaaactataggtgttttaatcaagttattacaaaactatgaaactaccgatttaacactaggtttatcatagagctataaaatatcgcaaaagtacatatttagtaacaaagttatcacaaaactacaggttttatatcaatttaatcataaattttggacatttataactcaaacataatattagagctaggaattaaaacgtaaaaatatgtactttttgattattttattattaaatttgtagttttatgatacttagccttaaacgtatagttttaagaaaaaattattgttaaatatgtagttttatggtacatcaactttttgcaataatttagcttaagtatctattgttctgtgaaatttactataattcttataaacaaaagattccttcgtttcttaaaacaagaaaaggataaaatattccaggaaaaacttggagtggaacttcgtacgaatttggaacaaattaacaataaataaggtaataaaataactaaaatattgttcaacaagaagaaatcgtccataaattcaggactttttatagattccaaaattgagaattcccattaagttgcttgaataatttgttcttcttcttcacctgtacaaaagcacaaattttactgtttaaaattatccaaggcttttatggggcgggctttctttggtcaatggtcactaatcaataaaatgttatttggtttacaatagaaatttgatctttaacaaatgaaatactttaatcaataaaaagtgtttactagtgtcactataataccatttattgtatagattaatttaatcattttgatgttaccatgtcccaaccaattggttgacagcatcatcaccaccaccactcatgacatgccacaatgaaaaaaccaacagctaaagcaacacaaaatcaaaccccaatcagctgcaaaacagaaagacaaaacaagaaaaacccatagattcaaatttaaaattcgctggaggaaaaaaaaacaaaaaaaacaaatcggaaaacaaaatccgcttatgcagtcgtggcccccttccccatcgcgtcttccattccagcccagatcgagcgagagagccgtctccctcttcgcttctcctctcccccccgtgatctgaccgccggggacgaccccctcccaccacccgccgccgccgccgcgcccccgcccccgccggcga

SEQ ID NO: 9995 - DNA, 1501 bp, Oryza sativa
tccatcagatctggctgacagagggagacgacggtggccggcgattgaagatgggggcacagtgggaagaggaggagggacgcgacagcacggtggatccgctgtcctcgtcgccgcgccctccgctgagctcgtcgccgtcaagctttttgcctcctcatcactagctggatctggcagtgctcacgccattagcgaggatgtctgggcacagcggtggccagaaattgagggggggatggtgggaagaggagggggatgcagcagtaagtcagattcgtcgggtgccattccctccgtagagcttgtcgtcgccctatcgttcgttgggagaaaatgaggagggggcaaggggcggggtggtgaccccatcacctgcccttgcacacgcgggtgcagcgcgttgcatcgcgcgggcctggccgagcagcgaagctcaaatcgagcgttcctgctcagcctggctgtgggggcttttttgcatccgctcaacctggctgggagtaaggtgcaggcaaccaaacagcgacccactgcatccacgtgtgcgagccaggttccatgcaggcaaccaaacacacccttaaggtgcgtctcgtcgtccccgtgttctgtttcggtaactttcgtctctttgctccgtgcgtgacttgggaaggtggagttttcgtacgtattcggtttgttgctgtacgcgtgtgtatcagtgtcacgtttgtttcgtgcaaacggcgtgagaccgtgagacgtgccgagaacgtagaaatttatggctccatcgtttggcttagggtgtgtttagttcatgttaaaattagaagtttggttgaaattggaaaaatatgatggaaaagttggaagtttgtgtgtaggaaagttttgatgtgatggaaaagttggaagtttgaaactaaaatcggccttatttgcaaacgaaaaataatttattaataaaaattttgtatatgtattcttagcaatctaaaaataaagactaaaaaataaactaggataagaaaaacctcaacattaatctaaattgaagattgaaaatttaaattttagcttatgagcataagaaaaatatgaggttgttcgtaggattctcttaattaggccatttagtgtgatgaggtagcgagtggctcaactcttcatatcgggcatccacaatatgcatgtaaagtgggttgtaaggaataaaatactagtactaccaagttgtatatattatgggagtagtacgtaacaaatatcaggtgatatgctgactacctagtcataaggaataaataaatcatttgtcttatctctctatcatggccagtggttgtggggtccagtttactattcatttttcttctttcaccattatagctacaacaataactaatacccataaattaggtagtaagggtctatttggattgttaccctgccaattttttggtagtaccaaaatctaggcaagttttaatattaccaaatatttggtaaggta

SEQ ID NO: 9996 - DNA, 1501 bp, Oryza sativa
ctgcagggcacgaggagtctgacaaggttatttgatgggctgacatggagttaggacaatcttctttctagggcatcaccaatatttagggccaatttggattgctaccaaaaacatgccctatcaatattttggtaatttgaatagtacttgtgtttgatttggattgaagcccattcattggtaatacctaatctagatttggcattatctagaacattctttactacaatttcacattttgactctatgttggtagcaaaccaaatatgatcaaaaacaatcttaccttaccaaatatttggtaatattaaaacttgcctagattttggtactaccaaaaaattggcagggtaacaatccaaatagacccttactacctaatttatgggtattagttattgttgtagctataatggtgaaagaagaaaaatgaatagtaaactggaccccacaaccactggccatgatagagagataagacaaatgatttatttattccttatgactaggtagtcagcatatcacctgatatttgttacgtactactcccataatatatacaacttggtagtactagtattttattccttacaacccactttacatgcatattgtggatgcccgatatgaagagttgagccactcgctacctcatcacactaaatggcctaattaagagaatcctacgaacaacctcatatttttcttatgctcataagctaaaatttaaattttcaatcttcaatttagattaatgttgaggtttttcttatcctagtttattttttagtctttatttttagattgctaagaatacatatacaaaatttttattaataaattatttttcgtttgcaaataaggccgattttagtttcaaacttccaacttttccatcacatcaaaactttcctacacacaaacttccaacttttccatcatatttttccaatttcaaccaaacttctaattttaacatgaactaaacacaccctaagccaaacgatggagccataaatttctacgttctcggcacgtctcacggtctcacgccgtttgcacgaaacaaacgtgacactgatacacacgcgtacagcaacaaaccgaatacgtacgaaaactccaccttcccaagtcacgcacggagcaaagagacgaaagttaccgaaacagaacacggggacgacgagacgcaccttaagggtgtgtttggttgcctgcatggaacctggctcgcacacgtggatgcagtgggtcgctgtttggttgcctgcaccttactcccagccaggttgagcggatgcaaaaaagcccccacagccaggctgagcaggaacgctcgatttgagcttcgctgctcggccaggcccgcgcgatgcaacgcgctgcacccgcgtgtgcaagggcaggtgatggggtcaccaccccgccccttgccccctcctcattttctcccaacgaacgatagggcgacgacaagctctacggagggaatggc

SEQ ID NO: 9997 - DNA, 1501 bp, Oryza sativa
atgcaaaaaagcccccacagccaggctgagcaggaacgctcgatttgagcttcgctgctcggccaggcccgcgcgatgcaacgcgctgcacccgcgtgtgcaagggcaggtgatggggtcaccaccccgccccttgccccctcctcattttctcccaacgaacgatagggcgacgacaagctctacggagggaatggcacccgacgaatctgacttactgctgcatccccctcctcttcccaccatccccccctcaatttctggccaccgctgtgcccagacatcctcgctaatggcgtgagcactgccagatccagctagtgatgaggaggcaaaaagcttgacggcgacgagctcagcggagggcgcggcgacgaggacagcggatccaccgtgctgtcgcgtccctcctcctcttcccactgtgcccccatcttcaatcgccggccaccgtcgtctccctctgtcagccagatctgatggagcggaggagcggcgagcagcgagcagcggacggagaggagcatgagaagatgggcggaggagcagtggacgaagagaagcgccggaagacgggcggaggagcggcgaacggcgggcagatgggcgcacatgcggctgtgggcagagaggagttgatggtgacgaaggcagcaccgatccccttcctctatttctttcgtttcttttttttttgcccctcgttttgcgttttctctttctttctttcgtttttcactagcaacagagaagtctgtatgtagaattactagtagtagattagtttcaccggttcatccaccttaagaatttttttaattatttttttatatattgtagaggtaacctcacctaactatatgtatacgaagagataaccacactcacatcatgcaaccaaccaaacaaaattccttctaaacagtatccctcatacaggcaaccaaaacaaaatctcatgttagcctggctagaccaatacaactaaccaaacagctacatatgtattcttctggccaggtcaaactcagcctagatgagagagatagccaggctagggtgatacgggtaaccaaacacaaccctaaatttctcgcgtcacccccccctgctgaaacgcaacacatcccgccaaagacgacgacgacgaaataccagagacgccatcgccacggagacgtgaacaccgagcgagcgctctctctctctctctctcgccaaaaaacgtacgttttctggcgcattgtcagcgtgtgccttggccaaatttacccacgcaagctagcggcatctgacgcgcgcgccgccgatgaaacgggcctgccgctttggcatcgtgcggtgccacggttaaccgcaccaccaccaccaccaagcaccaacaacaacaacaaaaaaacgcattgattgcgcggcgacgcgagccacagccacagcccccaccgggtttaataccatcgcgttggctggcctggcatccatcggcagtggcagtgcagtg

SEQ ID NO: 9998 - DNA, 1252 bp, Oryza sativa
cctcctcgttgacagatatttgtcacccacagtcgttttcaacacgagcacctgcatgggctgaccctgctggctgtccatcttgctgcaaacaaaaagctataatgtaatacatccaaaatctgtaacttaacgaatcaagaatcagctcgtgaagtgcaacgacgggatgcggatttcctatatccaacgggaatacaatcaataagctgctgacgctagtggccacaagtaaaattaagtaatatctagtctaaaaaaagtttattctgtcaaaacattcagataaaaaatcaacgggaccatatgtaatgagcagttcaggaaaaaaaaaacaatccatctgctttcttgaaccacaaaattcaagagaatcgccatcaagctccttgagttttcatgtattgaaaatttcagaaggaacaaaacaaaggagctcaagaaaaacatggctcagttgcaagcaaatgaacctctcaactagcggacccatcgtgctgcccgcagccccctgcccatgtgggatcgatatgccatcgacgaggctgacccatcgcaacagaactaaagcttgtatacccttcatcccaaaataagctcatttataggtttctgtatccaatcgagcttaaaaaagtagctcagttgcaaccccaacaaagcaaagcttcacatacacacatacgatgcgttaattacgtttctaaaattactcccgcatgacacaaccgtgattagatttgagaaagatagtgatgtgtgtatgtgttatattatttgttcaaatctgctcgtttaaactccaaaatatgcagatctgccattaaaaccacattaggagtaatataattggtattgcaaagcttttttgggggggagggagggggtggttggatgtctggttttattaatttttcctgtttgcgttaagtatgaggattgcatgccctttacattttgagaggtctacacactccatgacatgtgctaattttgcctgacagaaagacaagcgggactacctatcttagatctatttatagcaattttacaagtgtttgtcgaagaacaagccggccaacgatctccatttgcaccatacatccatagcttagctttcttgcctcgccacccataaatacatgcccacatatgcaacatcaatcaccaaaatcatcgatccaatggcctccttgtcatccttcctgctcgccacggcaatggccgcattgttggtcatcggctcgtacgc

SEQ ID NO: 9999 - DNA, 1501 bp, Oryza sativa
tcaagagtgaggcggcactcaagggccccttctccgtccgcttccttgtcaagaacggcggctaccgtgtcgtcgatgacgtcatccccgaaagctttacggctggctctgaatataagagtggcatcaacatctaagtgatagacatgtgtgcttttttttttgaaataattcttaacctctctataatcctttttttttcaaaagagagatcaagtctgcattcggggaagccaaaaattaagtttctatggttattttgtgaaatatgccatcaacaaaataaagcattccatatgccatgtccgcatgttgctgcagaggtatatatccagacgattttgagtatattactgtaacatgctgaaaattagatattttctaattatgtatcatgccggttcttatgttcttaataaccttctaaatctaggaaattatgattagagggaccttctagaactaacttgcataaaacccctctttgatatttaacttcttttgtgtttttcatttaaaaatatatttggttaaattgaggtatttcttgatttggttttaaattaaaaccttctttcgacaaaatttcctcttattcaaatttagtttaaaaacccttttcatttgtataaattatggtccaagaaaaccctccaaaccaactctttgtaattccaattttaattggaattaattgtcgacccatcctttgattccaaacctatccttagttccctttccaaatctcaaatatccaaattcctccttttgatctaaccgccaatttagttcctacggcttgatcccttctcggcacaagaatggtattattacaaatattatgaataattgctcttgtgctaagaaaatatattttatccttctcttccacacatccaaattcctattagcctcaaatacttctctaaaatccatgccatatattttggggctaaaatcctatttattttcctctttgtttgcttgcctcattcccaaaaatattttgaggaattatattgttaatttctctcccatttgagtgcatcaattccaccataccccacttctaaaaatattgcactcaaataaatagaagatctttatttcgaaatttatctccacatataaactccctccaaatataattccatctatacacaaaatcaattctactcaatttgggccgaagttccttcacctaagcccaagtctgaaagtctaatttccctcccttattcctttcctcactgtgggcgccgccgccgcccagctgctcccggagccgccgtcgtcgccttgctgaccacgccaagccgacgccgtgccgtcctctacctcctccgccgcccaaacgcagcagagccgccgcgtggacgcgccgccgacgccgaccaatcacagagaagagccggcgccgttttcttctcctccactccaccagcgccgtgcttcccttgtttttctcctctctgaaccgccattgaccacctcctttcgc

SEQ ID NO: 10000 - DNA, 1105 bp, Oryza sativa
aagggatggagaactgacaggtttggcccactgatttttttttttaaaaaaatgctgactggactgcacgtggacccaaaaccaccccggattgagtcaggggggttatttgtccgtttcaatagttgagggtgtaaatgtctggtttcgagatcgagggtgtaattcggtcgacctcaatagttcgggggggggagtcattcgtactttttccataaaaaaatatcaattgaatttatagtgtactcttttttattgtacaatctacaccgagacctagaattgttggattattttcataaggccacgtgctcctccccacatacgcctcgtcgagttgtcatcttgtattcctatcaaatgtattgcatcaactgccgccaccgctcgatatccagctagctgcctagctgtgctctaccaatttacttagcaccaaccccatctcaccataaatgctaacctatgtcccctatcgagcagagccgcaacgggccagcacatgacccatctgtcaccgccatgattccatcaacatctagctgttgatggcccctctgtgacatatactatggatgctacacggtgcccctctatgtgcctggccatcactcctgaccgttagctctaccacccctctgttttctgttagcatcttcacccctaatattttcgtgtcttggtccatatcctccataaacggaacatcacaaatttttattattcgcaatttaaaaaataagtagagaaaacatgggaatgcatagctaccttttgagaggtctgcatgtcctgcaccagtgaaacaatcggaactaccaagtttgcacctatttataggaattgtattagagttgctcgacgaaaaagccggccaacgatctctatgccgcaccgtgcatccatgcctggttttctttgccccctgccaccataaatacacacccagctgcaatatggatcaccaaacacctcgatccatccctctacccttcaagaaacaagaaagacaacaccaacaaactagctagctcgccaatggcctcgttgtactccttccggctcgccgtggcagtggcggcattgttggtcgttggctcatgcg

SEQ ID NO: 10001 - DNA, 1501 bp, Oryza sativa
aatatatcacttctacctatttatttctctctcatcttttttttttctaatcctaaattgttttcagttctacgatgaaagataacaatttaaggtcttgtttaggaaagttaagattttaataaatagttggttgatacataactcctggcttctagtttattataacctttttcaccctagatcgttttgagtattttggaaaaaaaatgcaacaacgagaaccaccccctcccaaatatgccctaagttttattgggtgatgggatgtttggttgatgcctaacattgacataactaagtttagcctagttgaggtatgttggcacaagtgtggcttggaaatagttgtccacaagtgtggcatgcttagctccaaatttaagaatatggcatgtgggtcccatgactaagaaagtatggcacgacacaattacggtagtaaaataaacatatacctaaaaaattgtggcataactaaagtgtggcaaccaaccaaacaacccctaaggcccttcacaatgcgttgacctggcgagttgccttaccgcaccaggtcagactcatgcggacgtgtcaccttcactcgcgcctttgcgtagccactcgcatcttatctaaaccgcgagttctttcgtcgcatcgagggcacgcaacgcagaaacttgaggggcgcgtgtgctgtggagttcgttgctccggagtcgcggttccctcgcatcacagcggagacgtgatttcctcgcgcttgcgttgtgaagctcgtgactctgaatctgttttcgctgcttcaggtgggcagagacacgctatacgtgcgctgcactgctactgcccttagggtacaccagcacacacttgccttgatgatgttcctccaagatgagcgttcgacgaaacctatctataccaaaagttctggtttgttgatgacaagtttccaatatatttgtagaatcacgtccttatgcaccaaagtggagcgcacacggtgtgctcggcatgttttagcgtagaacatgctaccgtgtcaaccgtaattcaatctttgtaggctttttctctaccaaaacataaaaaagaatctagttccaactaatcctaacaataaatccaataaaattaacaaaataagcaacagctctgtcgagcaggattaacgggcaaataggacaaaaacagtcgcttttaaaagtgatcctatgtatcttttctgtttctcctttaagcacgtagtactatagtagtactaacctacagcgaatcggtctgtgcatccgtggctgctccatgcaaaatccagcaggccaggaccatccgatccgattcatgtataaaaattctaaccaccttcccaaccaccccgtgcgccgtcgctgctccgtgacagcaagcacgcgtgctgctatcacggtttcattgctacttcatccgtttcacaacgtaagtcattctaacatttttcatatttatattgatgctaataaatctttattagcat

SEQ ID NO: 10002 - DNA, 1501 bp, Oryza sativa
cgcattgtgaagggccttaggggttgtttggttggttgccacactttagttatgccacaattttttaggtatatgtttattttactaccgtaattgtgtcgtgccatactttcttagtcatgggacccacatgccatattcttaaatttggagctaagcatgccacacttgtggacaactatttccaagccacacttgtgccaacatacctcaactaggctaaacttagttatgtcaatgttaggcatcaaccaaacatcccatcacccaataaaacttagggcatatttgggagggggtggttctcgttgttgcattttttttccaaaatactcaaaacgatctagggtgaaaaaggttataataaactagaagccaggagttatgtatcaaccaactatttattaaaatcttaactttcctaaacaagaccttaaattgttatctttcatcgtagaactgaaaacaatttaggattagaaaaaaaaaagatgagagagaaataaataggtagaagtgatatattattatgatgattgggtatgaacggtttcaatcaggtttgacccccccccaaatatttgtatgaaggatgatcttgtttctatatatttttggtgggtctaaggataaagcagactactggttgcatgagccttggcgcccgtgcatcaccatcaattatttacgtagtactcgacaacttccttctctctcctccaccttagacttttctaccgtctataggttaatagatggctttggtaactttattgcacttgtcctaactgaaaccaaatttagttttttctatataagggtattattttactcggcatgtaaatccaattgaatatatgcatttttttaaatcaacttgaaatcaacttcagttgaagagctgaagatattagatacccaaacaggatgcttgtggaatggcatatagtagttagatgagccgtgagcggtaacaaaaattggaaaaatttggaaaccagccgacgcagcggcagcttacacgttgtctttcgctgacgatgatgtgttagtagtagcactgtagcagccaagcaggagcaggcaggagtagtagtgatcacggtgactcggaaacgcgccgcacaagccatcccaaaatctcctccaatttgcttggctttggaaaaaaacccaattaaattataccattattccataatcagcagcggtgacggcttggcttagcttaactttggctttagtactcatctcctactaagctcgtggacttttccttctctcgtcaacagcagcgcacctcacctccgccgctcgcctcgcctcgcctcgcctcgccttcctcctcccatcctcaccccgttgaatttctcccacctccgatttcttcttcctcgttgaaccattccccacccttcttctcctcctcatcctcctctccgcgccccgcctctgcggcgaggtaggtgttcgatcggtcggatggacgcgtcggatggcc

SEQ ID NO: 10003 - DNA, 1501 bp, Oryza sativa
tcccaacaatcagcgtcccatgagagaatcgccctgatgcttaaagaaggctgggaacatcccatcacacttaaacattggtagaatattcttcgagaccactacaagatccttcaacaaaatcttgacgctgcattttggataaaatggccttattatttcaacaatataatttttagaacataccgtaacatgtacgctagtatatgatgaaatgggataaatcttctttgcagtactgccctccgacttggtcaaacagtagtgtagtgtgtagaggatttgtttatgatggaaccatcttatactaaaaaaattaggatgagccttaaccaatctcacctcatctccaaatcacagccaattgatattgcctaaacgaagaaaacgattaaacccgataaccttacgagcgaaacattttgactttatcatatatatctatctacctattatattattaaaacaactttgaaaggagacaccacgttcgctgcgggaactataaattctcacattaatcagaaaaaagaaaaaatattaaccgttagatcctaataagtctagattttaatggttgagattcaatatgagtccgtacaaaagttctgaaaaattgcagtccgtttagctaaagcacaaggaaaaagttgcagtccttcaaccatcggtgcattacagctggactatgcatcagatatggattgaagtatgtatggcatcaacaacaccatgaatgagatcctatttgcaaactgacacaaatcaaaatcagaatagcaccatgggagacaccaataaatactacccacatatgattctgtcactcggttggtgactaataataattcaattcggaatacaatattcaaaataaaaataaggccagctgaaaaaaaaatacaccatgtagaatataacacgaggttaattaaaacttagaataaaaataaaataaattctaaaattaaatttcaatactaattccaaagaaacttaaaaaatcattaaaatacgaaataaaattataataaaaactcaatctagatgctataaattcccatactcatcggagaaaaaaataaaaagaattcatgtaggtatacaattatcaataattaaaatccaaaataaaataataataataataatttgaaagaagagaccatctagaatataaacgatgttacttaaaatttagaataaaaaataaagtaaattccaaagttatttctcaatatgattttcagataaacttaaaaatatcattaaaatttgaaacaaaaatagactataaaattaaataagtaaaaaccacatgcaagaagagtccatagaaaaatacagcctataaatatccaaaagtaagagtaattaaaattcagaaaaaaatataataaattcctaaattaattttcaatactaaatcggtataaactttaaaaatatcatgaaaaatcggataaagtaggaatataatttcgaagtaaccaaagttggc

SEQ ID NO: 10004 - DNA, 403 bp, Oryza sativa
ttatccaaattcaaacagttcagaccccccacccccaccccacccccccgggcgggaatagttcagattcttacctgatttaaaaacctacaagcttcagcctaaagaaatccaagaaataaactagtagccaaaaactagaaaaacgagtttctccggattgtcaccatcttctaagaatctctagctcccaaaacatgtagttgaggaacataaatacagagcacgtcaagactggaacaaacatgaacatccagattaagcaccaagtataactgggtatatatcgatctgttatctgtatgacttaaggcacggtacaacgacaaggtaacatcatagcgaactagctatgccataagtttctccttttggagtgacgaacagctacatatatcaacca

SEQ ID NO: 10005 - DNA, 369 bp, Oryza sativa
tgaggatgcatctgaggatgatggtgtcaatgaatccgaggatgagtcaatggcatcagatgggatgcctgacatattcctattgcaacttatgacaaaaatgacccaccaatgatcgtaggcagcgtatatccaaacattaatgaatttagattggcaatagcacaacatgcaataaaaaaggagtttgaatataacatcatccgaagtgaaccagggcaatttactgcaagttgtgctgctaaaggctgcaaatggaggattcatgcatccgtggttgctgatggtgtcactatgatggtatgtttttaatttaaatcagcatgcattctttaagtatattgtcatatgcatggagcccatacttct

SEQ ID NO: 10006 - DNA, 624 bp, Oryza sativa
acaaaatataccaactttatatacgtatatatagaaagtttgttttgcatacgtgtatacaaactttgcatacgtgtatacaaactttggatacgtatatatacaaactttctatccgtatcttttttatacatgtatacaaacattgcatacgtgtatacaaactttgcatacatacatattaaaaaaccgaaaaaactgaaaaaaaatacggatagaaaaaaaacgtgcgaaaaaaaaccgtggaaaaaacataacaaacaaaaaaggaacgggcgggaaaaaaggaaaccgaaaaaaaagaaaccgtgtgaaaaaaaaaccgcggaaaaaaaaacagaacaaacaaaaaaagaggaacgtgcgggaaaaaagaaaaccaaaaaaaaaaggaaaaccgcgccgccgcccgcgcccatctccacgtgccacgtgtccagtcgcgcgggagaggaggcgcgcgactgatcgcctattagtgttctcgtctaaacaccccctaattagtaattttgcctagcactcaatccacccggattgcttgcacaccccattcccaccctacgcaaaaggttgaaacctaaaaaatataagtactaatcgcattctccaaatgaagcccca

SEQ ID NO: 10007 - DNA, 1501 bp, Oryza sativa
acagagatctagtaggagctagcgctgtgtccggaactaaaggtatccacgattccacggaccatggctaatgacatagatttttttcttggatcagtgagttgtaggcatgccaaccttaagaatggaatcacatcctccattatcctccgtccctatcctcgaatataaacagtagagctacaacagagctttccacagagagagatgatgaccagtccactagcatatcaatatttcctgggtcctggggtggtcttgaccaaacagattttgaaataatgagaaaccggcaaattttccaattcaaacctatttttcttttttttctcaaggtgatttaaatacaagagtaaatatcgtaaaactacatatacttaggtcaaattatcacaacactatagatttaatagatttaaggtaatgtatcacaaaactaacgttttaacatcaattttatcataaaattatagtttttatgtggagtatcacataactgcatattttagactttaagtccttagtagttagtatcattgttttgctggagttctaaatattgtagttctgtgactaaattggcacaaaatctataattttgtggtaaatgattataaaatctgtagttttgtggtgctccgtctcaaatatgtagctttgtaataaagtaggtgctaaattttgtagttttctgaaatttattttaaatataaactagcatggtgacctacgcagattgcgcggctagcatcattatattttctctcatataatagaatatatgttttctcaatgtattattcaaatatatcaaaatgacaacataattttaaattttgtactaactttacgaaactactaatgtgcaatattcatattgtatttatatacgtgttagttattaattatttttaatatcaaattttagttatttgtaaattatattcctatatggactctagactagtctttcaatatttctttttctttaattccgtattttcgttatctgtaaattgtatttctatatagactcaaggctcttcttccaatattatttatttttaattctgaattttaattatttctaattgtatttctatgtggactctaaactcatctttcaatattctttaatttttaattttgaatttcaattacttctaaattgtattcctatattgactttagactcttcttcccatgcttttttttaatttcaaattttagttatttgtaaattgtatttttatacgaactctaaactctacttttaatattattatgtttattccgaattttagttagttttaaatttctatatggactctatactctacttctaatattccttatttttaattccgaatttctattatttcttaattgtatttctatatggactctagtctcctcttccaatattccttatttttaatttcgaatttcagctatttctaaattgtatttctatatggactctgtttttctttttctctga

SEQ ID NO: 10008 - DNA, 813 bp, Oryza sativa
taaagatagcgatctttagtcccggattcgtagtcccggttagataaccgggactaaaagggggttatgaaccgggagtacagagggtttctccaaaagtgtacaaatgtaatctacttatgttgttttcttatgtgacaagtttaatcaaccctaatgtgaatacagaggtataacatgacaaaaagtattttgtgcaaaacaacttgtatagttttcttatgtgacaggtttaaacatgtaacgtgatgttgaatgttacatgaagatattatgattttactccacacttgctagctactccctccatccaaaatgtaacttttgtaggaattcaaccaatcacaatcattcttatttaattcatcgacatacttttttttctcaactaatcaaaatatttcatcattcaatctcacatacttaattactttatgtaaaaacctctcgaaatgctttaaaaaattggaacaaaggtagtagttagtccctctacgaaaaggaaaaaaaatcttctaactacaatcgaacacatgagttaaacccgtaggttgattttttttttcccaggagcacacgctgcagtactcctaagtggcaaggatttttatttttcaagaaactttacatgagtgatgtgatgaatcatagtttttgcaatgtctccaataatgtttacttttcagttgtgcactgcacagattacactgtgttcattctgtcagacaaacgatgaaacaaacctgtagtaggtctgtacgatcagtcccaatagaaactcgacacgctcgttctctccttttcctttccaga

SEQ ID NO: 10009 - DNA, 1501 bp, Oryza sativa
aattataaaataatagaaatttggaattaaaaataaggaatattagaagtagagtatagagtccatatagaaatacaattacgaaaaaaaatagaaattcggaattaaaaaataaggaatattagaagtagggtatagagtccaaataggaatttaaaactaactaaaatttggaataaacataataaaattaaaagtagagtttagagtccgtataaaaatataatttacaaataactaaaattcgaaattaagaaaaacatgggaagaaatttagaagtaactgaaattcaaaattcaaaattagtttagaatccacatagaaatacaattagaaataataaaaattcaaaaataaaaataaataatattggaagaaaagcatagagtctatatagaaatacaatttacagaaaattcggaattaaagaaaaaaaaatattaaaaaacgagtctagagtccatataggaatatatataatttacaaataactaaaatttaatattaaaaataattaataactaacacgtatataaaatacaatatgaatattacaccttaatagttttgtaaagttattgcaaaatttaaaattatattgtcatttgaatatatttgaataatataatgagaaaacatactatatgctattatatgagagaaaatataatgatgctagccgcgcaatctgcgcgggccaccatgctagtttttctacttggaagagattaaataaagagagagagcaaagctatctactgacatggagatagtctatagagaaaaaagaggcaatggattagagagctatagatacccatgtagacatgccattgaattgatttattattaatatagtttactgctgagatgtacatattttataataacttattactctaacattacgggtgctccgaggtctcacccgtgatgtcgccgtgattaacgatgccgtggtgatgcggtcctcgccgtaggcagtactactatacatactccaatccacggcacggaggcaccgacggacgccggaggggacgtggatgacgtacggttatggtgtgatggggccatggggggcccggggggggggggcagtcgccccccgccgttggcggaagcagcgtgtgtgtcgctgcgcgcgcgtggcgtgggacatggtggggttctcgcgcggagcggacaagcggatttttgtctcgtatcgtcacgttccaaatcttggaagggcatgcacgcccgggcgccgacccggccggccctggtcagtggtcacaccgtggcaacgatgtgtcgcgtcggcgcatggtgtattggtgcacggcgaagagacgccggttgagtttggcaagattttgggaggaaaggggtacaaaggctggcacgcattgcgcagcttggcccgaacaccggccagcttgcaaacacaactccgcttatcatgaagggctgcgagcctgcgactgcgagcctttttccttggtgattgatttgtaa

SEQ ID NO: 10010 - DNA, 1501 bp, Oryza sativa
taaattttttctatggtagttagaaaaccacatctgaaagccaataatcttcgtctagtgaccaaaaaactaccaagccagttataagtaagattttttggtgattacgaaatggaatgttcaaaaagattcaccaaagaatactatttaaaacacatctgatagttgtttggttgataagatacttacagagacagagagagagagagagagagagagagagagagcacatcacaatcacgatcagttcatgtcaaactggttgaaacatattcatgtaccatcttggaacatggttcatttatgtgcacataataattgctaagttgtaccaaagtaccaataggcttgactaattttcatcaaattatacccttagcaacatcgtgcaggtccttttttcacaagagttacaagaggaggctgctctccatcattatttttctatgggccaaaagaaaaattagatcttccgttcaaaaaaaaaatctccgttcaaaaaaaaagggaaaaattagatccgatttggacggctgaattgtatttcagctccaagcccaacaagatcatatatgccatccagtagaccatcttttcttagtattagctaactgagtagatgtggcagttagtagggacaaactgatccagctagggctgtccaaatccagtttagccattttttgtcaacctgcctttgacatgtctgcaggtgaatgaatgagatggctaggtgtgatgcagttgctggaacactatggttagctatgatttggccagttttgctgatgcaggaatgctcaccccttttgatctagttctagcgccattcaataggatctgggtggggctgagaatgggtcaggggttgtacagtacaacgcagggactggcagctaggcaagattaaccaatttcaaatttattatttgattctcatcactgcatatacacatgacacataaattattttccattcaggctcggaagcaaaatacaagattacaagacagttcttaatttggatttttgagcgacaagttgacaagtgatcctttattcctttgttcagatagtaagttctagcaaacgttagaacagatttttcaagactgacaaaaaaaaaactttggtggctaagctaccacaatggtaattagcaattaaacatacaagcaagcacacagcacatatgtccagggtagctgaaagtcaatgtgaaataccagggctgatagaatttgaaatacttgagttgattgtttcagttgtatctatttttcagttgagtaatatgtgacaccaaagctcacagagtttcaccctttaatctctagtcctctactatgtcaaaactcaaaatggttcaatacttccttgtcaggtatgaaatattgctttattttatgagatatctactctagttatggaggaatttttggcaagggaatgtgaatttaccggctattgatgacatcaatttcatgtaaggttgacacaa

SEQ ID NO: 10011 - DNA, 1501 bp, Oryza sativa
atagatttgtgacactagaaatatccaacttcaaaataaatcctaaatcgaagttgtgacaaataggtttaccgtatctatggccatcaaggaacaaacagggtgatgagcagcactaccatcgactcggatgattggggcctgggggtactggactacatcctccctcttaccagatgaactctttccaataatgtgattgccggtgttgtatctatatccggaggctcgtgtcagatcaaagtaacctaatgctcaacatcataaaaaagaaattaaaatagtactaaaagcctttataaaacatgtggttttagaagaccatacgcggactaattggtggatgcatgaaccgacgtgtcgattttcaagtatgtataaaatcaaatggcccaactcaaaagacggcggccagaggtgcgggcggcgcgacggccttcgtggatggcggcggcggcgcatcctggcgagggcggccgggatccggcctccctaggccagatctagccgggaagctgccgggctagcggcggctgcggctggaggtggcgcagcgcggaggctgcggcgcgtcagctgcggctgcacggcgtcggcatcggcggcgctggaggtggtgcgacgtccgggcagctggacgacagcggtggtgccggtgccggatgcggtgcggtggccgcgctgctggacaccggtgccggaggcggcgaggcggccgggcggctggaggcatgaccggcgatgctgggcggcccgggtggccattggtgggcggcgaggtggcggcggagcggtggcttcggcgaggccgccattaaacctggcggcagggtagatcgcgctggcggcgaggtcgtcttccttgtgggtggctaggcgttcactgtgtttggggagctcctccccttcttcgtggggagcttttaggcacggtggaggcgttggccggcatacagggaagactcagtttgccaaagcgagcttgttcccgttccggtcccataggtcggattcgacatggaggccgacggacggcgtggcggaggtggcctgggtcagcgtgcaagggagtggaggcagggtaagggcgctggcggcggggtcgtcttccttgtggtcggccaggctaatcctgtttggggaactcctccccttctctgtggggagcttctttgcaggctggaggcggtggtcagtctacaaggaaaactcaggttgccgaggcaatgttgttccttgtctggactcccttgggccgcattcgacggggatgccggcgtgcagcgtggcggaggcggcctgggtcagcgcgctggcgaaggtgggtgctgtggcagtcttgtcattggcaggacgggaagccggccggcggaggggcgtcggtcgggtgtggcggaagccatgtgccgccgatgtttagttggtggtttcggatttggcgacggaccatggcggtaaggggttccgagcgaaagcttagcccaatttctttgggccaata

SEQ ID NO: 10012 - DNA, 383 bp, Oryza sativa
atgttgggaactatgataatctcggtctgatgtttctaactaacactaaatgagatcactgatggcacatcacatatagttcttgatgtgcctcatattgagtttatccagcaacatgctccccaacatatgtctacattattaataccacgatctatgaggcatgatcatcaatcaatatatgtactaatcattaaaccatatttgttacacatatgatatttcatcagggatcatttataaataacaacatacaacataaaagtctcttgaaggactcacatatttattaatcaataatgagttatctatttcaagaaacaacgtatgataaatatataaacatagtatgtgatataatcatctctttaattgtctctagg

SEQ ID NO: 10013 - DNA, 1501 bp, Oryza sativa
gtgtttaagaaaagaaattggaaatggtcggaaacatattatttacacgtacgaaaaaaagattatcggttagtttgggagttctccgaccgttttcgttagctatagcagagcgcaggtggcgccttcggaatcccaccccggagcggaggcgctgcgtgcgcgtgtggtggtcgagccgcgagatcgatcgagccgagacccgagcgcgcgcggtggtaattcttcttcgtcgcctcgcgatccgcgggtggtgtgtgggagaggcgcccgggggggcggtgccggtgcgggcgacacgtcacggcgcgaaggggcatgcggtcccgcggttgtgaagccccgcgccgctcgacgcgtgtgcgcgcccccgcggggacgggggacgcgcgcgggtgcagcccatgtgcctcctccccttgtctcccgggctagctactccccacacccacacccacagcgacgcgcgcgccaccaccaacgcccccggccctcctctcgcgctacctgacgcttcctttcctctcgcatacacacttgcgcggactagctctgttgctttctttccggctacctggaagacgcacgatccgaacccctatccaggaccatctcatcccatctctctgcatgcattgcatggcagctatctttacttgtgtgcctacattctgactgatccagtacacggttttgtatctgccttcttctggttctcggcgcataggatcggatcatcgtatgacacacatgatcgctccggatattccttatatctgcagtgtgctacaccacacacgacgacgcggtaaaccgtacgtgcagactgctgatcgatcgaaaattcgaaattcagatacagtgcacgcaccgcatcgtatggttattatgagtgcacgtacggtatgattttctgaacagatgtttcagatcaaagctgcgtatgtacgtgctcgaactcagataattcagcagttctctctctccctctctctctctactcctctctcaaaacaatagtgcttatatgcgatggtactagatccgattatcgatggagcagcaagctttctactctctccgtcgcataataggtgatgttttttactttttatttgtaaagtttgaccattcgttttatttgaaaaattagtgtaaatataaaaaaaagataagtcatatgtaaagtacttttgataataaagcaaatgataaataaaataaataataattctaaaattttttgaataagacgaatgatcaaacagtgacaaacaaaaattcaaaaagacaagtaatatgggacggaggtagtacaattcaaaagaggataaatagttggctagttagctagtggtagtactagtacagtcagccatggatcgaacaattaacatgctaccgactcaggcgagaatctcatctagctatagccaaagctcctcctctccccgatcttttcaaagaaagcgagagccctttccaggggcaagtgccacct

SEQ ID NO: 10014 - DNA, 1501 bp, Oryza sativa
  unsure (1)..(1501): unsure at all n locations
tgtctcccggcctccgctgggcaccttttatcctatgaaacgatgatgaagagaggaaaaaaggagggtggccgccgcccttctggaccacgccgcacctcttcccgccgccattttcagcgaccaagaacagggagacatggcaaaagtaggatctggatgggagatcacgctggaattaaattttaaaaatatacttttcattcaattttttctcatgaatatttgagatgtaaatttnnttctataaatataccgtcgatctcgtacaaccggttgcgcgaaatcgagatgggtgtgacgtcatgggcgcgttgaaagtgcgagagcgcacggtctcgcgcggcgaaggcacgagagcgcacggtttcgcgcaatggaagagcgaggccgttcggtctcgcggaattaaacagcgaaactgtccaccggctccatttaattagtgcttaattacttaattagtaattaactaataataattagtaactaattattctaattagcaaattaataaattattaattaatcgctaatcaagataattagtcgctaattgagtcagcatggcaccggtctcgctcagtgcttgcgcgagactgttctgcctcgctgtacctttccacgagaccgtgcggtctcgcgccttcactgcgtgataccacccacgacgttattcccgtatcattctcgcgcaacggttgtacgaaatcgacggtatatttaggcaaaaaattttacatcccgaatatttattagaagaaattgaataaacagtatattttcaaatttaattcgatcacgctggacgacgtgccacggagagaaccccctgcacttgcacgatgatgacgagacgacatgggtgggaagtgtcaggacgaacaactcagcgagcccactgtcgtcctccaggccgctctagctaggcatggcagcgattcatccccagctggaacggctgcaactgcaagtgcaacgttcttatagaacagaatcatgtggtacacctattgtttgacggcatcattagttgccgtggcaatcgagttgattgcttcgcttgacatgtgagttcacatgggtctcacgctgtctcagccgtcacatcagtcaaaaccgggagcaatactgcgtttgagacgatctgattttatagcattaagaatatgttatatccgatatttcagttcagagatgatcaacaagttgagagatcttacgtgaactttttccctgtaaaaaccatgtatatatctaaaaagaaaaaataagtacttgtagaaatgtagagtatgctccatattagattttgggccacaattccagtataccaagtaccaacggatggatcggtgtaggccattccccgtcatctgtgctatcctctgcctgaaatgcatgcaacgttttaccactcgtcttattcaattttttttaaaattattatttattttatttgtgacttactttattattcacagtactttaaacacaactt

SEQ ID NO: 10015 - DNA, 1501 bp, Oryza sativa
cgtgatccttgctcactcttctcggatccatacagtcatgcatccatcttcccccatgactaccccatgcatacatttattgacgaaagtatattttttcccttgaagttcacaagtgtgactctaaatttctgacgcaacagttcccatcttcgacgtcgttaggtgaaaacaactttaaaactcggtagtagatcaatagatgctttgtcgcctcgtatattttttctgttcatgattcgcacacaaaaaatataggagtactgtacgtcttattgctttcaaacacaacaaaatcctttcatcgaatttggaccaaatgtggttccatttctaaggttttatatgtcgagcaaatattatatattcagtatataaatacctattctaattacacgtctcctgtagggctctcataacaactagaaagatggcatcgattagatggattacaatataataactgtagatttaatcttatgtgttaccatgaaaaataatgatcaataaaatccaaacgtgcacataagacattgatccatatataatataaagtgtaaccacatacatggtacatgcattatgcacacgtacgcgcaccaactacagacgcatacaaccattacaatatcaaaaagaaaaatgaaaaaataattcaacatgggtaacaaagttccattttgaataccgaaaaaaaactagtacatagtttatactccctccgtcacaaaatataagcatttttagcatagtgtcaaatcaaacatttttaactttgactattaatagcaaaaatataaaaaagatcaatcgtaaaattaatgctactagatttatcattaaacaaactatcataatatgcaattctttttatttaaaatatcttatttttgtagatattgttgattaaactagtactatcttaaagactacgtcgaagtctgaaaatgttttatattttagaatggagggagaaactaataaaggatacacaggtaacatgatatatattcatccagcatacgtgttctggtgcattgcataccacctcgtagctccgttttctgtgcaagtaggttaatctgtcaacaaagtattctttgctactagtaataacattaatggtggagcagtccaccttatcaccttgtcggataccggcttaccgctataaacagtaacggctatagtgcctgctacaggagaaagctttgtatcatcttctgtaaacagtactccaaattagatctacaacatcattttctaatccaatggtggctgcaaaagtgcttaggttgtagtggctatagccactgcaggtgatcccaattcccaattcctctagagttgcatatttaaccaattcaggccgggaacgataactaatttcttgcactaattccgaagtaattaaactaggaaatggttaaatccacgtgcagcacgcatggcccaggacagggcacgtagacgtacggtagacgattgtaatttccaaaat

SEQ ID NO: 10016 - DNA, 1501 bp, Oryza sativa
aaaacttgttatggcggcttgcgttctcgggattagtgcttccatctttatgatactctaatcttgtttatgtaattcgtcgagttatcatatatcttatataatctctggcaatatcgttatctaaccaccaatcagctaacgtctgttactagaaagcagccgattaggttaaatatcgatgttgacttagattatataggatatctaccactctatgaaacatccaacggcttgattgtctagatattgtccttcttttcatacctatagctgcatcagttgagtttgatcttatgagtcgtgattagaatctcaatctctagcctgcttttggttgccgattaggatagcatcagggtttcagccgatctgacctgatttaactactttttctttatatgctcgattgacatgttaaatccgccctttatgttaagatcttgttgcatttaagtatattaggctttcgtttggtatattctgcttgctctaatatcttaatatagagtgatatcggagtattagccgatacatgctagatttatctgatcggctatgctatgaatatatatagtcttgttgttagtatatatttcgatctaagtgatttatactgtctcggcaaggcgatcgatctttcccaatcacttgatttaagtatatattgacataaggattatctacagccgatcgagtagatttagttctttcttacttattcatgactgccgatcgatctacatatgacatcagctcaaacataaatgtaacgtcatctgcaactaaccgatcggctatcatttatggatttaaccgcggtttcttttactttatttcttgttgattgtggaatcaaatcaactggcacgctcatacacctaaaggcaagcttttggacctgtactggagttaagcagatctcccaggcctcgtgtttttacatcaacaattacatatgtgattgttgttgttgaccaaggaattattttttgttgatttgtgattggattgcacatgacgaatggagctggctcggcttgaagctggcatctctatttttttttaatcgggaagagtacaaatatgtctgttctaggttattggtgctgaccaattagtgctggctgagaaaccgacaactattgccggttctcaaccggcacctatgaaagtttttgtattagtgttcataccgtattttttggagtaaggacaaaaatcctatagcctttggctgataagtacacccagatatatgtcagatcttctttccgaactcttcctctagcttggcaatgccagcagtagagggcgacggcggctgcagggacatattattcaattccgcgggagttttaaaatttaaaaggggtggaaacatgatttcggcaataataaaaaggggtagcacacgagacctaaaagtggatggatgcacagacaaaggatttagacaggttcaggccctctcgatgagaggtaataccctactcctgtt

SEQ ID NO: 10017 - DNA, 1501 bp, Oryza sativa
ttaaataaaaagaattgcatattatgatagtttgtttaatgataaatctagtagcattaattttacgattgatcttttttatatttttgctattaatagtcaaagttaaaaatgtttgatttgacactatgctaaaaatgcttatattttgtgacggagggagtataaactatgtactagttttttttcggtattcaaaatggaactttgttacccatgttgaattattttttcatttttctttttgatattgtaatggttgtatgcgtctgtagttggtgcgcgtacgtgtgcataatgcatgtaccatgtatgtggttacactttatattatatatggatcaatgtcttatgtgcacgtttggattttattgatcattatttttcatggtaacacataagattaaatctacagttattatattgtaatccatctaatcgatgccatctttctagttgttatgagagccctacaggagacgtgtaattagaataggtatttatatactgaatatataatatttgctcgacatataaaaccttagaaatggaaccacatttggtccaaattcgatgaaaggattttgttgtgtttgaaagcaataagacgtacagtactcctatattttttgtgtgcgaatcatgaacagaaaaaatatacgaggcgacaaagcatctattgatctactaccgagttttaaagttgttttcacctaacgacgtcgaagatgggaactgttgcgtcagaaatttagagtcacacttgtgaacttcaagggaaaaaatatactttcgtcaataaatgtatgcatggggtagtcatgggggaagatggatgcatgactgtatggatccgagaagagtgagcaaggatcacgttgaggtccgtccaaagtcgaatggctcagcgctgcagcagctcagatatcagtacgccggcaggttacccattgccgatctgctggcaaccacactagctagcatccagtactatcctttcgatagcatgcacagcatcccgagagacccacaagagtgttcactgttcattaggctgttctctgctcaactgaccacgtgatgtgcacgggacagaattaaaacacaaatgcatgtttattatatgatttatttacgatgttcgatgacatgcctatttcccacagttaaaactgttgagttgtgatccaaatttatttacctttaaaataggccagcttctgttggagcgaaataaaggtatagatcgtaatacattttagggtttcaccttttatatatatatatatatatacatctcgtaagctgccatgcagcgttgtaacatcacctgatatagtgaaaaattttgttggctggcacacgtggttttttctcctgctttcgcagggttttccacgttaaatctcgtgtcttctatgatcgatctattgttttttatcgtttgtttgcctatcgtttcctaacaagtggtatcagagcttattctcatattagggtt

SEQ ID NO: 10018 - DNA, 250 bp, Oryza sativa
accggttttgagagttgggggtcgagatatccggtttcgtggtttagggtcacggattagatttcgatcactttttcagggtcacaaagtgaacttattccaagataaaattaggtttgggcccaccatagtctggacgggtggggaaaccgctgcgagtgcgacccccgccgccgtcgccggagaagaatgggtgggcggggcggaggaatacaggcgattccctccataatctccggcaatagctaca

SEQ ID NO: 10019 - DNA, 992 bp, Oryza sativa
cagcgcggcagcggcggcgcgaggcgcgaggcagcggcacggggcgcgaggccgacggcgacgatgccgacggcggcgcggcgggcgagcggcgcaaggtggcgacgcgcggctcgggacggctagggcagaggtgggagagaaggggaaaggttagggaccaaatcgaacaccttgcgagcaatgaatagtgcactttcctattattcccgattttaggttattttcaatataaatttgatttcataatttctaaatcttgtataaatgaagtttatcccatatttgtgttatcctaactaaaattctccttaatttgatatcactcatattttgtttatataatttatttgagttttaattagggtaaattcttattctatcgcaattaaatttaattgatccaaatatggtcgcgataatattttatttattactatccgtacctaatcttttatttttaatttatatttattttaccaatttgtttttaaggtttattaaagattctataattttttctaatgagaccgttattaacataatagcacattagctcaatttatctatatgttagtttattttatatggaggggtttaatatatcaaatttcaatccctaaatgcaattaggaacttggtgcaaaatcgatctacatatcgaattaaatactcccataattctattatatatacagagagctcagttcatttgaatgatcatcatttcatgttgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaagtagatttaggaaaccgataccgtattggttaaggtttctatcttgtaatcctgccccccaccctatataaggtgggcaggaggccctctagggggca

SEQ ID NO: 10020 - DNA, 341 bp, Oryza sativa
gtctgatctcttatcctacggagtactactatacatactatatatacacacacgtatgtatattctatatatatgtacatatatataatttttatatatatgcacttttaatgtataaaagatatatttgtatataaagtttgtgtgtatacatataaaaaatctaaaatatatgtgtatacaaactttatatatgtgtatacaaagttggtatacgtatgtgtaaaaaccaaaaaatacacgtatacaaactttgtatacacgtatataaaagtttacatatgtgtatacaaaatttatatacgtgtatataaagtttgtatttgtatgtgtaaaaaagg

SEQ ID NO: 10021 - DNA, 1501 bp, Oryza sativa
aaagagacaaaaatcgtcgtgctcacactcccaccaaaacagtgaacagtgagataaccattaaactaggtagttggggtatttatactgtgcaataaatatctgtaacggccaaaaaaacttacaacagtgacaggtattttagttatctttgttgggcctgagttatcggtgacgggcctaacagttatctcaatcgggcctcaagttggagcccgccattgatgatggaccaacggtgatgggcttctattagggcccggcaaagatttcaccggttatctcaatcggtcctaaactaaaccctatcaccaataggtgccatacgtgatgggctagagttttatgcgcatctaacatgtctgtgtgagtatatctttgtcggcctctttttgagcctgtttgagatcactttgttgtgacagcccggaaaatgcaggcatgtgacgggccgtcacagatgagaggatctatactagtgcatacaacgaaaaaaacaaatttgattgtgaatatacgatagctagctgcggtttaatttgttttttttattatgagatgtagaagttgaatttgaacatacatgtttgtggagtgttatatcacatgttaatacatgttctcaattttttcaatttttttcgtaactatttgagtgacataaaaacaactagggggcatccctcgagggataaaaataacttcccttctagttttgcatagagtaaattccccgtgtacccttgaaaactcactcaatccctttcgtacctctgaaatttacccgaccccttctatacccctgaaatttcaacttgatcccatccatgctcttaccgtcatattttccataatttcactgttacgtttggttgcaaatgtatttttttatcctttatgcttatttaggtttaaatataagcttaaaaacaattaaaaattttgtttgagtgcacagtgtgtgcattttataaaactaatgagactaaataattggtgtagaaaattttgtcataaattttggaaataaaataaatgtaataaattaaaatttttatttgaaattttaataggacaatggattttttcgatcgggaacattcataaaaagaaatattgtaaacattggtagtagctaggtatacaagggacacaagggattttcagagatatacaagggattttctcttttacatagtataccgtgcatataacatctgcgtcggtaggcgtacgtggagaccggtggaattcgtcaaaaccgtagatgcaagcatgcatgtttcccttgcgcattgttgtgatcccccgttcgacgcggcgcggatggccctagctagcaacactaggcgctattgttagcctcgcgtgcgacgcacacgggtgcatgaaacccaaacacccgccctgttggttgcacaaaatcatccaatccctctcgcgctttttcatgtggtttctctgagaaaccgatccgagatcgatcgatcgccacgtacga

SEQ ID NO: 10022 - DNA, 948 bp, Oryza sativa
aaataggacccatttggccatctttattgggccagctcaacagccgagagaggctgcggtgtgagctgttacttaattttgcggacactatagattgccaaatgtgtcgcccggtatggcccagccctggcacgaccgaggcacgtcctgagattggtcggggcggcacagccgaatcgacaggccaaaccgtgcttgcgttgctaggtagggccatccacgccgcgctgaacgagggatcacaacaatgctcgcgcgagaaacacgcatgcatgcatgcatgcatccacggttttgacgaattccaccggatcgactccacgtacgcctatcgacgcgacgatcgatggttttgatgaatacctaggtagctagtatatatgcaaaactaaacgtaccaaacaaattaaccgcatatgaggagtccagatatacggaagaaatatattgatcggtagccgaccgccaggaacccaacagcgtcttgcattttatcacgtcattcatccaatcttacgataaaattggacccatttggccatttttattgggtcgtctcaacagccgagagaagccgcggtgtgagctgttacttaattttgttaagactatagatggccaaatgggtcgcctggcatggcccagccctggcaggaccaaggcatggcctgtgattggtcgggttggcacagccgaattgacatgccgtcccgtgtctgcgttgctagctagggccatccactttgcgtcgaacgggggatcacaacaacgcgcttgagaaacacatatgcatgcatccacggttttgacgaattccaccgcatcgactccacgtatgcctaccgacgcgacgattgatggttttgatgaatgcataggcagctactatatatgcaaacctaagtgtatcaaacaaattaaccgcatctgaggagtccggatattcgg

SEQ ID NO: 10023 - DNA, 1501 bp, Oryza sativa
aatcacacagcactgcagccctccctctccctctcccctctctctaaagaatgccgagtggagacgaagccggccgggaggaaggggtcgtcgtcatcgtctccggcggccgaggaggacgacgacgacggcactgcgtcagcgaggtcggccaaccctcggcggggtcgcccttgagctcgcctcccctcgttgtgccgctctggctcaccgccctcgtcggtcaggtgtgcgccggggagtcgtcgccccagggagggcagaagcgggagcccccctcgtcctcgccctcggtctcagcgtcaccgttgtccccgctgcggcctgctgcttttgcgcctccgggatggacgccgacagcccgcgtcgacctacaacaggtatggccgtcaacctcctccttgagacttctcgcgctctttggctcgggcttcacccctcacctcgccgtgcctcctcgacgccatcttccgccgttgcggccctccctcctccacgtctcctcctctttttgacagtaccttctaataccccacaagtatcaggcttgataccttggtatcaaggtctgatacctaggtaccacccggtatcttgggtaccgagcatcaggtatcggtcgatacctaattggtatcaaaggtaccaggtaccaaccggtacaggtaccaggtactagaggagcacacatggacagagaaaaggaaaagggagagtcacttaaaatattccgctgcaacggtgggctagcagccctcgatgataaaacataaatattactttactcgtgacttatgtttttaatttttttaaaaaaaataaataagacggatggtcaaaattcggcgcgaaaaatcatggttgtacttaaaattggacggagggaatacatatttctatatcttttaaaaaataataaaaaagagagcacacacatcttctctagccctaaatatgccgaagaatattccatgtctcactctagtaagcgcgaaaacaatttcttcctccgcaaaccagaagcacaattaacgaaatggcaaaaccgtcaataaactgaaaccccgggccttgttatgaaccccccacgaaccttctccccgtccacgtccacccctcgccgtcgtcaaagcgcggcgattaacggcggcgcgcgacggcaattccacccgaatccgatgtataaaaccaccccgcggctcccccaaatcaccaagaagaacacccacctcagattagtcccaaagattattcgcgattaagcttgtttttttttgttcctaatcgcagatacaaagaattcgctttgcgtttgccactcgagaaagattttgttttttttttttggttaacggataattaagcgccgcccctcctcgtcgtcgtcgccgccgcatggaggccgtcggcgtggctccggcccccgcgggggtgccggagaagaagctgctcgaagtgaaggagtcccggaaggcggcgccggcggcgccgtcgacgtcga

SEQ ID NO: 10024 - DNA, 1501 bp, Oryza sativa
tgcaatgaaagatgatgatttcatctatgtgggttaacaaattttaaaattcatgttatttatgtcctctgtacaaaattcgtttactgtccgaaatttgtttattcgctgttttacacatgtatttctaacatgtttccggcctttatactttttttttcaatcatgtgttataaaggaacattcaaattctttcattgagagacagtcataatattcaaaatcctaataacaaatttaaataagatgcccgcgcaactgcgcgggctaccttactagtttactgaaaggtgtttactacaaataccaaccgatgctgtgtaaattaaatttgggaggctcctggtgctgtctagctactcttgagttgtactaagagttgagtgatactctgacattatattatgatcttagtagtctttgcttctactaattgaataggcagagctcctgccaagatttcgtttttataattgaataggtaccatttgcaagaactcgaaggttgctgttgttggaattaatgaatgggccttagcccacttgaagattaattctttggaaaatcacaaaagaccacctcatgggatggcatgcatgtggagtttagtaccaccttgcttattctaggagagggggacctccttgaaaggtaggatgccctcctagccacttgaagcatgtgtggtggagagaagagggggaacacgcgcgcgctcgctcgcctcgcctggcaggcggtgcgtgtgcacgacgtacgcgtcgaatggtctgccaaattggttcctcaccttgctgcagatgcagcctccttttacagttttgttttgctgtaaattcggattcgtttttgttttggaaacgttccgaaaaaatccgatgcgtgcaaacggcgtggagtccggataagttacgcgcgacttatccggttcggttacgcgcagtggagatcgtgcgggcgccctgatcaagtgacccttctctatataaaccgacccgccgtcttcacgcaacacacgcgaaatcaatctagggtttgcctgctactttgtactgcaccgtcgctcgtagattattccatcccgctcgccggcgtgcacctgcgatcgggagagcaggtctccggaacctttgccttcgacatcctgcaccgggagaaggcggcaataaggtttttgcgaagcgctttgcgagactgctccctgttcgtccgcgacggctcgccttcctcttcgctcgcgtgctgcgtgccttcgtagacgcctgcgaaaagtttcgatcgagcagccggtcttcccgccacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgcctataatctcaacaatccaaaaaccttattataggcactgtgattttacta

SEQ ID NO: 10025 - DNA, 1501 bp, Oryza sativa
cacccggccacaaatttgtcgggtaagacacacttaaggagttcgagttccttagccatggtttgtatctcatgagcctgttcgactacaaaacggttgtcagccatcttgtagtcatgaaactgctccatgatatacagatcattgctagcatcagtagcaccgaatttagtattcagtgcatcctacaactccttagcgtcggtcatatgcatatacacctcgaccagacgatcgccaagaacgctaagaatgcatcccacaaagagagtagtggcttcctcgaattgcttctgctgatcagcagtaagaattccttcaggtttgccagtactcacccaaaagcatttcatagccgtcagccacatagtgaccctgatctgccatctcttagagtgcacacctgtgaatttatccggcctcattgcatcggcaaaaccaatcatagtaaaatcacagagcctataataaggtttttggattgttataattataagcacataatgatttaatttattccataaataaaccatgacattgcagatgtaaactagattgaacacatcattagatctacacatgtaaactaagcagtaaaacatgaacagatcaaatatgcgcaacatatcgaacacgtaccgaggtggcggaaagaccggttgctcggcaggaactactggcggttgcgagcgtcgacgaagtcgcgaagcacgcgagcggagaggaaggcgagccgtcgcagacgaacagggagcagtcgcgcgaagcgcttcccaaaaaccttattgccaccttctcccgatgcaggacgtcaaaggcagaggttccggagacctgctctcccgatcgccagtgcacgccggcgagcgggatggagtagtctacgagtgacgacgcagtacagagtagaaggcaaaccctagattgatttcgcgtgtgttgcgtgaaggcggcggcttggtttatatagagatagatcgcctgatcagggtgcccgcgtaaaccgaaccggataagtcgcgcgtaacctatccggactccatgccgttttcacacaccggatttttcggaatgtttccaaaacaaaacaaatccgaatcccgcagcaaaacaaaactgcaaaaggaggctgcatctgcgcaagggtgaggagccaattttgccgagcattcgacacgtacgtcgtgcgcgcgccgccggcccggccaggcgagcgagcgcgcgcgtgtgtttccccctcttctctccaccacacatgcttcaagtgactaggagggcatcctcccttttaaggaggtccccctcttctagaataagcaaggtggtactaaactccacatgcatgccatcccatgaggtgggtttttgcgattttccaaagaattaatcttcgaatgggccttagcccatctattaattccaacatggatctcacgacttgtgtatacaaggttcctctggtctcaacgaaggatgccctacttggtgccaaaaatctatt

SEQ ID NO: 10026 - DNA, 1501 bp, Oryza sativa
ctgccaaggtctccattcccatgtaatgcagaaggagccagacatagcttaggaactccccgcctgtgccgagactcttagcgtgcaggtagcccctgcatctggctgcagagaagcagagcatctctacccacactccttcaatcaccctccacatcttctcctcatcttctaaattcaggagctcttctgcaatggaccaagcatcatcgatgagctctccttcattctcctcgtgtggctgctgaaccttgacgataattctctgggcaagttctctttcattcagtgacaggttcttctccttgacgatacccttcaattgtttgtaggcatcagtgaacaagtttcgcctgctgcccgccaatagcatcccaggattcacaaatagctggtacatcatgtagttggacatttcttggcactaaactgcacctttatggtgaatagatttttggcaccaagtagggcatccttcgttgagaccagaggaaccttgtatacacaagtcgtgagatccatgttggaattaatagatgggctaaggcccattcgaagattaattctttggaaaatcgcaaaaacccacctcatgggatggcatgcatgtggagtttagtaccaccttgcttattctagaagagggggacctccttaaaagggaggatgccctcctagtcacttgaagcatgtgtggtggagagaagagggggaaacacacgcgcgcgctcgctcgcctggccgggccggcggcgcgcgcacgacgtacgtgtcgaatgctcggcaaaattggctcctcacccttgcgcagatgcagcctccttttgcagttttgttttgctgcgggattcggatttgttttgttttggaaacattccgaaaaatccggtgtgtgaaaacggcatggagtccggataggttacgcgcgacttatccggttcggtttacgcgggcaccctgatcaggcgatctatctctatataaaccaagccgccgccttcacgcaacacacgcgaaatcaatctagggtttgccttctactctgtactgcgtcgtcactcgtagactactccatcccgctcgccggcgtgcactggcgatcgggagagcaggtctccggaacctctgcctttgacgtcctgcatcgggagaaggtggcaataaggtttttgggaagcgcttcgcgcgactgctccctgttcgtctgcgacggctcgccttcctctccgctcgcgtgcttcgcgacttcgtcgacgctcgcaaccgccagtagttcctgccgagcaaccggtctttccgccacctcggtacgtgttcgatatgttgcgcatatttgatctgttcatgttttactgcttagtttacatgtgtagatctaatgatgtgttcaatctagtttacatctgcaatgtcatggtttatttatggaataaattaaatcattatgtgcttataattataacaatccaaaaaccttattataggctctgtgattttacta

SEQ ID NO: 10027 - DNA, 1501 bp, Oryza sativa
ttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccatgtggggcccggccgtccgccgcccgcgtcgtcgggtgcggctgacgcgtgggacccacggcgccggccggcgcaagccgcgtgcacccggtccaccgtggaccgtgaggctgccgcgtggtccccactcccgtggacccggtccgcacgcccctcccctcggctgacgcaataaatccgattttttaattaaaatttaaatgaagaaattcacaaatatccatttaaagagcatataaacttcaaatggccataacttggccatttgaactcggaattggaccgttcaagtctctaatttttccttaagaagtcaagaacccatttgtgtgctttgtttctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatctttgaacatattgaatcccagtttacaaaattatgttgatttaaattattgcattatcgctttatttaaattcccgcgttatcactgttttatttagccatgcctatttacctttgttatgaccttattattattgttattgttattattaccttgttcaccctagattaaacaaaaccccaactagtggacactctactcatggtaccactagtataattttatgtagatgcttcgcaatttaattaggtaacattaggcggttttacaactctagactttgggaatattcatatcacctggacactttggaatggtttggttattgtggaaatggcttcacaccgccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggagatggacgaagtcgggggtcgatggacatctctaggacaaatgaaggctacacgagctgcggcccggtagtcgagatgtcatggcacagggccggtgtcctgctgtgtcacgcccggaatttctatccaaaattccaaacgcttacatgtgtgttaaaccctcgtccaggaatcaaccgagacacacaatgacaatattgataatagagtacaattaaataactatttaatattcgcaaataataaaatattacagaggtagataattcctcccaaaaatataaaacattctacgcagcggaaaaataaaactataacaaactacagaacagctatgacgactcc

SEQ ID NO: 10028 - DNA, 1501 bp, Oryza sativa
cctggtttggagatagaactgtgcagccgggatggttgttcagaatggttgggcctatgcaacagggtatgttgtatagcgttggattaatattgtttaattacttaactgttttattaaattctcaaatgtttgctaaatgctgtttttacaaatgaaaccctattatgccatcctttgttatcctgtgcacttgcatatttgctgcgtggcttgctgagtatgtcatatactcatcttgcaatcattcatcagaggaagagttctacagtgaagctgatggtgtggaggattaggtgtagccctggtcaagctgcctgtggagtggagccgtctgcgctgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatataagcatttggaattttggatagaaattccgggcgtgacagttttttagagcaggtacaatagcaggctataagccggctgtaaccatatatcgagaagaaaagagaagagagagaagaaagcgggctacagatttgtagccggttgcaacacggactccaagatattatgtgtgtatgagaggtgggaccgtgtattaatggtgcagtatatttttatagttaactattgatgaatgggctattagattggctatagatgttttggagccagtagttggctacactattgaccttgctcttaaagtaatccatttcctatcaacaagcgtgagacacgtgtcaaccaatttattaatcccgattattttgggacagaaccacccagtagtagtccgctagcgatggtttctagaataatgctctttcagtcccctcctttactcatttttgggagacggcggcgacagaccaaatcgggccgatgtagcaacccctgccgctccctgccgacggatccgtgtgaaagactgtcccaggtaattgttgcgctctctatcaacatttctgctattttaaatctcatttcttttttatcccaaagcgaagattggagacaatccccttcttcgttgctgacattactgtccctgccgccggccgccaccccgccagatcaggccggggcggcacggatctagcggtcgccgccgccgccaccggggcgactcccctggccaccggagcaggctggcgagaagccccgccgccgccatccttacggtctttgctggcgaccgctcaggcagcggcgaggtggaggaggaagaaggagcgggaaggggtggccggacttgtcgcctccggagccgtcccgggggtagggcgacgcaagagcgtgacggttgacgctgtgaggtcccttcagcggtgggaacttcatggctgcggatcaatggaggcggtggcgatgaccacggatcctgaggcggggccccca

SEQ ID NO: 10029 - DNA, 1501 bp, Oryza sativa
gttctgggtagaccggttataaaatccattcctatttcttcccacttccactctggaatcttcaacggttgtaacagaccggctggcttctgatgttctgccttgacccgctgacatacatcacatagagccacatattctgctatctcacgtcgcatactggcccaccagaattgttgcttcaagtcttggtacatcttagtgcttccagggtgaatggaatacaaagtttcatgagcttctttcatgatagtatccttcaactccttattatctgggacgcaaattctttctcctaaccacacagttccttgctcatcttctacaaaaccgatggctttacctctcctcatgttctttttaatttcttgtatgtcaggatcattcacttgagcttctctaatgtcacaccctgattttcgtcttaggatttataaattatttaataaattattaatagaatttatattaaatgttcattaatttacaagtgaagttaaatgtgggaaataaaatttcctaaatataaagcatggatggatttaatttttattaaattctccgtggttaattatactctctggaattttctcggatttttcggagctcaattcctaattttaatcatacaaagagcatttcagtaattacccacatattaaattaatcattaaatggtctaattataattttgttaagtacttttagtgtccaagtattttcaggatttttcttgaaattatttgagcattggaagtatttttaacaattgaaagatcatttaagtgattattttaattggaaaaagtttttaaatccttctctaagccgttgggccgaattcggcccaacatcctctctctctcgcgcggccgagccggcccaatcagcccagccgacgccgcccgctcctctctcctgtggagaccgacaggtgggccccacctgtcgggagctccttcaacctccggccggctgccctagccgagcccgagccgcccctcttccgcctccgattccgcctcaatccgatccgtttttatccgggtttttgaggggttttgatcctctcgttctcctctatcttttcccccaataatcggagcgaatcgttgaggattttatccgaatcgagttcgtttcgaatttatccctaaaaaccgagtttagttcttcttggatcgattcctctcgtttggagttcgatctcttcaatccaatgctataaatagcatcccctagtcgtcctcttccgtttgccccaagtcccgagctccctcgtcgctcgtagcgctgccgcgccgttgccctagccgctagccgtcgccggcgatctccagttgcgccgcgccgtcgcctccgccgtcgccgccgtttgccgtcgccgccgttaggtgcgccgtggtgagaggaatctcggccgcccgttccccttcgccgccgaccaccggagctccgccgtcgccgtcaagccgagccgccgctgccgttctcttcgtcg

SEQ ID NO: 10030 - DNA, 1501 bp, Oryza sativa
attgatctgcctagcaaatgctcttcgtcgtccgggcttaacaatatcagcggatctgctatattgactctctttaatcatatttaatgtttagaaaaaatgatttagtcaaaatcttaaagctttgagtatcgataatttctcaaaatgcttagtttaagaacaaaaagttgtcacacataaattttcttcaaaaaataataccataatgtaataaacataatagtttttataaagttgcttgaatacaatatggataaatcttgcgctaaacattaaatacttataattaaaggaagtaataaactaaatatgatggcagttccctaattaaattgaaccgaaggttgaaatactatagttttatatatactcctcaagcaatactatactctcttcgtcaaaagttaagtatagtcatgggtttctatgttcaacattacatttgatcattcgttttatttgaaaaattataattttttttaaaaagttatgaataaagtgctattcttgttttatcatctactaacaataaaaatacaaattataaaaaaaaattaaataatagaacgaagagggtgctttgtaagagcatgtctatatttgatattatatttgtttatttaagaacgaagagggtgctttgtaagagcatgtacaatagtagactataaatcagctataaacatattttaaagagataaaataatagagaggagcagtgggatacagatatgtagccagttgcagcacggactctaagacataatgtgtactccctccgtcctataatatagcaatctagtatcggatgagacgtttaatattaagatgtgtttagttcacaccaaacttccccccaactcccaacttttcatcacatccaaaactttcctacacacataaactcccaatttttttcctaaactaccaactttccccaaacttctccccaatttcagaaaagtaaacacagccttacaatgaatgtaaacaccatcttgtccagattcgttgtaatatgaaatgtctatcccgtactaggttgctatattataggacggagagagtatatgataggtgggactagatattaatagtgtagtaagcaactgttgtatgaattgactattatattacctatagatcatttagagatatagtagttggctatacgattaacttgctctaagagcacccgcaatggtaaagtaaggtgctctctataaaacatgtacatctcagcaatagactagattaatagtaaaccacctcaatagtatgtctacatgggtatttatagctctctaatccattacctcgtttttctctatagactatctccaggttagtagatagttttgctctctctcttcatttaatctcttccaagtaggaaaatatgctgacatggatctcttatagagagcatatagataaccattgtgggtgccctaagcacactcccaatcatctatggaaccttgtgttgacccgcgca

SEQ ID NO: 10031 - DNA, 1501 bp, Oryza sativa
ttgtttcactaattagataaaaaatgtttcactcgtttaaattgggtgttgtttcaccttatataaaaataatgttttactacctccgtcccaaaatgtaactatttctagcatagcactttgtcccaaaataaagctatttttctacctaccttctcctctcaaccaatcacaaccattctttttcacctactttctctttttaaccaatcacacatcttcttcaatcattctcacctactttcttaatacccgtgccaaccttaaaaatgcttacattttgggacggagaaagtagcaaatagcgaaacaatgttttagttcactgcaacatttgatccatacatagtgaaacattataaatacactaggtgaaacatttttcgttggaacaaaaaataaaacgaattcccttaatagggggtttccaaaatctgtgagttttttttgttgcaatggagtatttcagttcactgcaacattagatttatacatagtgaaacattgtgggtacattaggtgaaacatttttggtggaataaaaaataaaccgaattcccttaatagggggtttccaaaatatgtgatttttttttcaatagagtatatggtgaagatatgtagcaagtagtagggacatatggtggggtcccagtagaagcacatggacacgttgtggaggggggaggaggggagcgcccgattttctccccctcccctgggcgaccgagcggcagcattttcgcaatgtcaacgcacgtagaattaaatcttaacctttttttacattcggacaaaaatcttaacctttttctaattgaagtaaatcttaatttaagccagtaggaattgaaaggatgtcatggttgtaattggtgctgattttctgaattcatttgatcccgaaataggtactgcaggatgatgttaggtgcttgtcagatacggtggttggaatccagccataggtcatgtatggatgctctgatgaagcaacggcaaagtttgccgtatcagcccaaaggccgacgatgcctggttagaaattcatgatgagtgtttggatgactttcataagtgtgataagatttctttttttaaaaatattggtaaatccaatattttttttataaatattggcaaatccaatatttctctttagtgactctaaatagtatagcatgattttatttagattatggcttggattttgatgaccttacctttgacaagtttgacgaagaaaacatgataaaccttggcaattatagattgtgaaccaaacaaccactcattgtttcatgctttattttgttttgccacttaggagtaggctttttatgaaaattcagtatcccatactttattttgtttcccatttaggagtaggccttttctactactccctctcccaaaacataaaagattttgattggatgggacatattctagtgctgtaaatctgaacctctgtattcatgatctgctatactctccatgg

SEQ ID NO: 10032 - DNA, 1501 bp, Oryza sativa
aatttgagaaagcaactggatgcatgctacatctgtattttaatagatgatgactatgatataacttttgagtcccatccgtttcagaaaagtgaatttagaaccggatgtgatatattctagtataacgaatctagacatacatatgtccagattcattgtactagtatgtgtcacatatagtactaggttggttttttatgggacgagagagtatgtaattacagtttattttgttgtgagttattttatcactaaaaaaactttaaacatgatttatatcttattcatttgcacaaagtttctaaaataagacgaatggtcaaattatgtgtccaaaagttaatggcttcacctataaaaaaaaagaaaatataagggctcaccagtcctcacattaaaaaaaataactatatcatacccattaggacttctttgatttggaaaaaatagcattattattcgtttatttaaagacatatgccgttacaatttgatagaaattaaagatatgccatacttatacctcttcaatgcatttatcaaaaaatttgtactaaactataccccggcctcctcctttcttcactcccttcttccttctccctctttctaatctgtcaatctctttcacggttcaatcgcccctgtcaatggattaacctaaccacgccgctgctagctccgtcgccggcgaccgtggtttcaactgaatcttgggtaagagaggagagagggagaaggaaggagggggtaattttgtataatttttttatataaatgaaatttaaagggtaagtagagctatatctttaatttatgtcaaattgtaatgatatattttttatgttgaattttaattaatcttgtgttggattctatgtggactctttttctgttatttattatttttaattctgaaattcagttatttctaaattatattattatgaatcttatttttatttttgtaattccaaaatttatttatttattaaaaattttagttcaactcatattggattatacatatggactctcttctattatttcttatttttaattccgaattttagttatttataaattatattattatttaaatctcatttttttctttttctaatttcagaatttattttattctttattctgagtttaattaatcttttattgggttttttatgtgatgttctttcaatatttctttttttctgaatttcaattatttctaaattattttttacttaattttttctctgattaatataaggtggtgtttggatccagagacttaactttagtatctgtatttaaacactaatttagagtattaaatatagactacttacaaaattaattacataaatgaaagctaatttgcgagacaaattttttaagcctaattaatccataattagagaatgtttactgtagcactacataggctaatcatgaattaattaggctcaatagattcgtctcgcgaattagtccaaga

SEQ ID NO: 10033 - DNA, 289 bp, Oryza sativa
tcctctcttttgcttattcctctcctcgccaaacctagctcatagtttattttcactttatggaaaagtaaaaacaatatattaatattgaaatttcttggatcccctagtacatgccctatggggcctatttataggttcatgtgccctagggttattaaatacatcaaaatttacatggttactcgtatgatatgagatatttatgatggtaattatgaacaaattagccttagggctcttcttgagctgctaagtgggccttcattgagtggttggccctttaagg

SEQ ID NO: 10034 - DNA, 1501 bp, Oryza sativa
agttcctccttataagcttgtttatggacatgaagccgttttaccatgggaaattcgaatcggctcaagaagaacagagttgcaaaatgatttaatagccgacgagtactataatcttatggccgatgaacgagaggacttggttcagtcgcgattgcgagcacttgtacaagttactagggataaggaacgtgttgctcggcattataataagaaagtggtaccttataataagatttttcagaagaagaacttgtatggaaattgattttgccgattggtactcgtgatagtaagtttggcaagtggtcgccgaattgggaaggaccgttccaaatccataaggttgtgtctaaaggagcatacatgttgcaaggacttcatggagaagtttttgggcgagcgcttaatggcaagtatttgaagaaatatcacccgagtgtttgggttgacgcgtgatcggctagtattgccgatacatgatagccggtgcgtttgcatcgccttgagatggccgatattgttatatcgcccttagttgttttattgtaatcggttgcggtttttgctgatgtacaatggccgatattgttatatcgcccttagttgttctgatgtattcggttgcagtttgccgatgtacaatggccgatattgttatatcgcccttagttgtttcatatttttatcaatgctcttgacattataaaactagggggacatatatatatctcacaatacagtgcaaaaaattttttttcgctgattacaaaattattgggacaagtattgctggatagccgatatggctctctgcctaatttgttctacttcttctatggcttaggcatcttgagcatcggttccaggaatgaccttcagagatttggtcatatcagtgtcacaccccgaagttttcctcccaagccaaaattgtaatttacaaatgaccccaagaaaatgcagaggaaatcaggataaaaccctaagaaaacaatgcaaacaataatcggatttgacatgtggaatttttcttgagttctacatgtcgaaattcattaacaggatttttagtggaattttcagagctctagaaataatttcaaccaattaaaaatcactaaagtgcaatttttaattccagggaaaatccttttcctttttctttttcttttccctccctttttccctcctttttccttttcggatgggccgccggcccattcccctccttctttccccccctccttgctgggccggccgcaggccgagggcccagcctggcagccgccgcccgcctcctctctcggggtcgccgacaggtggggcccacctgtcgggtccttcccccacctcccgccgatcccggcgcgccgccgcgccgaaaccgccgccgcgcccacgcctccgtccctcccgggccacgtcgaccacgcccgcgcgtgcgccgcattccccgcgcccgttcccctctctctcccgctcgcgcccgcgcccgaga

SEQ ID NO: 10035 - DNA, 1501 bp, Oryza sativa
tgcaagaggggaccgcccactgccttttgaggggtgggggtgaaaccttagcgtggtgtggatggttaggggagggttatgtggagggtcttgtcacgatccccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttcctgctttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgcccgctgctgaagtcaagcttcccggtttagctcgcttttatcttttccgctgcatttgtaatcttttctatttctgtaagacgtggatctgtatgtcaacaattgtcgtttgtgtaccctggctggtcctggacagggatttaatgcacattcagcttagaaattctggttcgagaatttctgggcgtgacaatggacctagcccaagttcggccaaaccaccaggttcggcggaaccactatctccaccattggatgtggggtttggcgtggacgttccagatgcatccctgatggcggttggagggcacttcggacatttcctcttcgccaaccgtcatacctacctctatataaaggcttcactccctcacttcacacacacacttccaaggttgagctgaattataagaggctctattgtactatattgtataatagaataggaagagagtagagtagaaggagtcggaagaattccggagttgtcggtaatcttctcctatttcttttaatctatttattactctgaattcaatataatattcttcttgagtaattagatttatcttgcgagaattacctcttggttagttcctaattagcatacgggattattgttcactataatcaactaaaatatagtgattgctttggtgagttataaacaccaaagtagatagtaattgctttgacgtggtgtttaggtaattgttatccagtaattgttgcgtatcccacagtacgttgaggtgggtgtagaggtggtgacagccctcgagatcaatgaagtcctccctgtccgggtacgtagtagagcgacatctgggaacagcgggttgccagtgcctgaagtattgcgttaggattaaaattaagcattccctaga

SEQ ID NO: 10036 - DNA, 441 bp, Oryza sativa
agagcattaaaggtcagggtgagggagcaggtgacagaatgtgtgaatgtttacttgcattgtcagtttccatttggtgttaacatgacttgcagggcataaaagtgtgtactcatatggggtgtcaactagagccaaaattagaacataaaagtggtgttttaaaggtggcaaaacacgtagatggtcgaagatatgagactttcatatcttactggaccattggaagaagatacatacaacgcatgaacaagcttggataagcttgccagcagtttggcagatgctgaatgcttgagtgtaaaatacgtgcaaacattgcttgtggttcaaagttaacattttacttttttttcatcctgagttatcttttccctcatcacctataaatagctctcctttgttgagaaagaccaccagagagagaaatttgcaagtgat

SEQ ID NO: 10037 - DNA, 1501 bp, Oryza sativa
ttagagcgtgtcaacgaaatgatatggaccagattctcggcaactatatatggcctataccaaaactagccctagagtgaatgatatataaggtgtgcattttattttagtggcgcaaaatctctttatggaatgattctttgcatccctcaataaggtccttccatccaacatataatgcattttcagttgttttccaaagcttttttttagtaatttaccaaaagtttaggttgcggagaaatattgttagtgcccccctataataacatatatggttgggagtgaaaggatgattagacaaaagatcagaagaaatttaaatgagaggtgattaacataacatgtagtagtgtataaatgcttatatttttacagaatttaaatgcttatatatattaatggttggacgaaaggagtaagacactactccctccattctaaattagttgtcattgatatcaaacaagtttaatctttcaccatcaaattctataaacttatatctttatctttaaacatcgttagatttatacttttagaatcaccatgagaaacatgttcacactatataattcacttcacttgttaacttagaacggtaagtaatctgaaacgggagagtaaatgttttatctagtggttctcaacctagcagtatcactactaacaatagatgtgtctttgtaattaatggtcaaaaaaatattatatcttttatattgatttgcatgcagatttatacccagcaaacaacttaatggagttccacctgggtaaagatatgcctccacctctttcggaacacctattgattttaggttcttacaagatttgaactgtttcttgtaaatcaaattagaacaaagtttgtatcaggtccatgcatatgcaatggagaataggtgagagaacaggcgtcgattttatttgctttggagctgtgtccctgctaggaacgatttatatgtacatatgcacagctaagggagccataggaccaataggacaaattccctcctccagcatctaagcatttcctgccatgttgcccataaatgttgaataaattcgagagtgacccaaaatgtccttgagctcactgttcgatagttgaaggtaagcatgattgatgctatctaattggtcagtacgctttgtgtacacgtgctacgattaattagcaattgctacaagtctccgagttgtgtgaggcaaaattccaatccagttgtgaccataagctgtaccaagccaccaccaacattgcaaagcggctagcggtagcctataaatagcttcatatacttcatcagttcaaaggcaggaaagagccgagcaccacggcgagtagccatggcagtccccaatgccatcctgttcgccgtcgtgattctcacgctctcttcttttgccaaggcccagcaacctgcaacacctcccagaaggaacccgccacgtgcacccccgccgccgctaccaccaccaccacaaacaatac

SEQ ID NO: 10038 - DNA, 1501 bp, Oryza sativa
tatacactcacatattcttatatatatatatatatagcttaatttatttatatggctattattttatatgactgatgttcatgtcatgaggaactcggtaaaatgttctaagtatcaatctatatatgctggtgaattacttatttataaacacgatcattatagtggtgatcatcatttcatgtgttcttatatttcatgtgagattggattcaaatcaattagattcgattttactatttcttttagctaatcatggcatcaagccatcagcatggttcaaatatttaatatttgatccatgatttataatagaaattaatatttgacttatacttgatttggcttgctttcttgtgcactaatatttgtagggttaataataaataacatattctcataaattatatctattgcttaaatgtagatcttttctttactttctttgtgatcatttacggtttggcaagcaatagcaatcataacaaccagcatgatgcaaaagttttaaaaagttcgaaattttagtgatttttattgttgggaattttcaggatgttacaatagtcaataaaacttctctattgtctgtgatgcttatttccattcaattacttctcagaagctatattccttctttgtcttgctagcctgtccatttcactgggttcaatggtaagaaatgaattattctgccacttaacccatgtaaattcttttgaaaggacatttaatcttgggatcccgtattcacctacttgcatcttattgtttgctttacaatgcctggtctattaagaaagttgtcaatgattcacacttttccctttaccgttaacataattttgtttaagatatttgtcagactatcttcttctgctgaaaaaaagcaaagcatcattattttttttattcctttccatgcttatacaatgtgaaaaaatgtaatccctaacctataatttttcataccaataacaagtaccaacattttttttctaattagtggttattagtacattttttagcctaatatatctgtatagcaaaagcaataatcaatctatataagctaacacaattgttgacaatagttgttgaagaatgcaatcaaatggtgggttaagcttttgcttttgctgtgatgccttttgaatagctattctgcttttaaatgagcaagtaatgttttccttcctaagtgaagaggtagcaaattgctgaattcctataattgtttttgattgaaaatatgtgatatgcttcaattgcttatatgttacattggcttaaatgaagttatgacttgagttagagaaatgttatttaccttacttgcatcagcgtctgaacatttgtcttctgggtcaattagtaatgcatccattaggtataatcattggaagagtacctagccgactagctaaatctacaaaattgcataagcttgttgttttgtgcaatgatgctagaattttgggtgattgaataatgtatggat

SEQ ID NO: 10039 - DNA, 1501 bp, Oryza sativa
gagcgccacattgccatgatgttgatgacatgatttgtgaaaggagaaataaaattaaacaactgttttcgactggggcggacggagaatttaggtggtatccggaaaaggctagcaccgtccccggtcaattaaggaccgagccatgaagttaagcatgaaacgacccccgtacaaccgcacttctcgtatgggtatagacctagtggaatagatagctgagcggaggcagtatccatgcatagtggtttcttgatgtgtgaggtaggggctctacggtggggcagccattggtagaaccgcgaggcgggtgtctacagtggtgtcgccatcggtaggactgccatgtgagaatttaaacatagttataacttaatgcatgtgtgagtctttccttcccgggtgcgccagaactcctctcactgctagaaaccgtgtacgcgtagagtgcatgaggatgtaaagttcatggagcgggtactgccaatgcgaggttatcgaaatgctttgctgtgacgcgtctcatgtgttgggatgaggctcatgtgttgggcagtcgcggagtgtgggtaaagtatacatccactgcagtgtgagcaaaccaaatctattcgaatagctgtgctcgcgatgattgagcaccgggacgtgtattacacttggttagactctaaattcttaacttgtgtgggatgagatattgcatgatgatttttatgctgttggagccacttcctgagagacgggaaggtggacgtcctcagaaaaccatgacgactcaatggcgggaagctatccttgggatcacaatggatggtggacagaaccgtcgttgtttaatgtgaacactggtattaaaatttgatcagtctatgctaggtcttaggcttgtgaaaagatttgcaaaacttgctttgtgcaaaggaacctgaagccattccttgaaataccctctatcatatgcatcgttgctgtggtggcttgctgagtacagttggtactcactcttgctatttatatatcttttaggagagtgttgaagagaagtccttgttagtacgcttgcgtacctgacaagatgatcggagtgcagtcttgttctaggtctcgttcccaagtcggctgcctgtggcatgtcaaccgggcccttatattattttgtcttccgctgttgttctctgatagttgttggcctacatagccctaatgtaagtatttaactcttttagcctgaattcattcgtgatatgttgtgatccaactatgtatgtgtgtaccaactactgattcatggattggtacggataaacacagaagatttccgatttccaaaatcgggggtctacaactatttttgcagtaacagaatattttcatatcaggaaccttgtgccactattctctgtagtaaagaactgaaatctaaaggtatagtacaacaagatgtaaacttagctcaatctatctccctatacacactaaaagtgttgttttctcattt

SEQ ID NO: 10040 - DNA, 340 bp, Oryza sativa
ctgcagccctttgtctgagtttagtgtctgaccttggcccttgcaggttgtgtaaacaatatactcctgttaccatttaaggttacgatttattctctacaaattcatactaaattcatattatacaagttcatgcttaacaattgatttggatttctaggtatttataaaatccagattattttgtgaacgtgaacatggaatgtatctaaattcagcgtgtggacacagccatgccatgtttctcaagtcagtttatgaatatatccttgcgcacatagtttccccctatttttactcttcttaaatatatattatacgccggtgacgacgacggcac

SEQ ID NO: 10041 - DNA, 1501 bp, Oryza sativa
tggcgatgagtggccgagcttcgggatcacctaaggaacacaatgggaaagattagagagggagagagagatcatagaggacggggacgccggccgaaggcggcggccatggcgaagctcaccggcgtgcggtgcgaacggggctccagcggtggaggggctgacggcgtggccctcgggctcgcgaatccgatggcggcgatggcgcggctcagcgcagcggctagtggcgaccgaagctacggcggcggcggcggagaggagggcgactgtgctagggcgaaggagggcacgggggagctcggcgaaatggggaaaaagagagagggaggggcggtggtgcttaaataggggaagagggggctcggggaggctgggagtgggctgatttcaccggagtagtggggaggtggagagagggagcggggcgcggggaaggcggcgacgccggcggcgtggcccgggaggtgcgggagaggcaggagcagcgatttcgggcacgggcggcgccagccagaggttggggacgggcccacctgtcggtgacccgaggggaggaggggctcgggcggccggctgatgggccttggacttcggccggcccaactggtagggggagggggaaagagaatgggccagcggcccattaggaaaaaggaggggaaaaagaaaaagaaaaagaaaaaggagaaatgaattttcagggattaaataattgctcgtgctcatttttatttggttaaaattatttctaaagctctgaaaattccactaaaaatcctgttagcgtattttgacacgtagaactcaagaaaaatttcacatgtcatttccgattattatttgcatttattaaattaaggtttctctcttgccacttcacaaataatttctcgagactatttattaattaatttagacttgggagaagaacttcggggtgtgacacttgctccctccatcccacgccatggcttcgttgccggcgagcagccggaagggaagaagaaccaagggtatttttgtgtgagatgtcattgttttcttttttgacgtaaacatagtggcattgtggcgatggcaatggcaaaatctcggatttctcgccgtatggtatggtacggcagacagagtacatgaaaagtggttttgctttgcttggtcgtctccaaattgaccatggcaatccaatcctattcttactcgggtcgggggtcagagcgcaccgcatatcgcatcatttttttcgggcaatccaatcgtataggtttccactacatactttcccatttttttcttacactttggttctataaaacgccgcacatgacgtcgaaagtcaccccgctatcgcagcaatccaaaatccccaacccaacccaacccaacccaaccgcactatcacgccactcttcgcccgcccgcccgccgccggaatcgccatcgcccgaccgccgccgcgttcgtgtccccacaggcggcttctctccctgcatcacca

SEQ ID NO: 10042 - DNA, 1501 bp, Oryza sativa
tgacttcaatggtgcctacctatacaactgctgcatgtccagcacaccaatttcttgaaaagtttcttacatattgctttgttatgggagtaagagaagattttgactttatccgtactcggctgcttcacagttcctctactctaaccatggcacaggcattgtctgatttacttgctgaggagacacgcctcaaatctctacctgcaccatctgtgtcagtttctcatggtgtgttagcagcttctcagaggtttggcgcatccagaggtacctcttcaatgccttgtaagcattgtggaaagacaggacatagtgcagagaattgttttgctcaacacccagagaagttggctgagtataactacaacaaaaccactgttataagacatttgacttaagacactctgtaagttgtctcaactttgagaattacgattaaaatagaggcgacttttgagacgctttacaagttggagacatagtttaagacactttacgattagcataagactacatcgtttagatatgaatattgagacgttttcagacgtctcatttctaagatgtgtttagatatgaatactgagacattttcagacgtctcatttctgagatgagtttagatatgaattttgagacatattatatgcatgtcattgacatcaaacaatacaattattatttacacagaaaaaaagaatatttgaatcatttagattccatcggaaaactacataattccttatcatcttcatcacataatattataattatttaatcatttaaatcatgagggtttccgagactaaaataatattataataatttttgaatcattcagactcaataaagtctctctcaaatgattaatattataatattatttgaatcatttggactgcattgaaaaacatgaaaaataatgtactcgtccacagaacgtacagattgcgataatggggcactaacaagattaacgtgaataattaagcagcaagaatgtgcttctttgttagataggataattacaaacatatacacgtacttggttgatagaagtgggctggacatgctgcaaaccactttatttgttgggcgcacgatttgctttgttgggtgcgtatttgtgagaattcttggacgatagtctccgcaacaacatcctgaacaataaccctcgtgaacaatccccttggtggcggcgacacaactcacgccaacagattgcgcctccgcatctcgcagcgcctcctccgtcgtcgggtgcggggttccgccgccgctcgcgacctgaggggcagggcctccaccggcagccgtgggcataggacctcctccgttcggcagttcaccaacaggtacagcttctccgccggctggcaagcccaacgcatacaatccattactccatcatcaccattcagcagccatttggtccttttcccttttaagtctttatttggattgggttttgttatgtgttttcccttgtcattta

SEQ ID NO: 10043 - DNA, 180 bp, Oryza sativa
tagatttcattgttcaatgagtaaatacttgggccaatcaaaagcccatatctccttgaatttttatttccaacatccatacaagtgaagaaagcatcatttcatagggcatttcataggtacaccgtacgcaagtcacaagaaacaataagtatgttacgtgaccgaatatcacgacca

SEQ ID NO: 10044 - DNA, 441 bp, Oryza sativa
ccttgggccggggaagaggaggaagacgagcgcccgtagtccccttccgcgtccacgaacgcaccggctctcccggcgcttggcgatgaacggcggaggcgagacagagctcggaaagcagcggcaacgatggagtggaggcgaatgggagaggaagggaaagggggaggcttgggttttaagggcggcaatgtcggtttggaaaccgactttgggcggtcaaggcgcgagctggcgctcggcgctcgcgtccaatcggcgacagggcggagggaggatgatgccggcgggaggaaaaagggaaaaggagggagagaaagggggctcgcccctttcttctttggaaaaaggaggaggggagcgggggcgtcgcggcagagggaggagggctctgcctccgtcccttggcgacttgagcgcggagtggcggggccgaggcga

SEQ ID NO: 10045 - DNA, 1501 bp, Oryza sativa; identical to SEQ ID NO: 2555

SEQ ID NO: 10046 - DNA, 1501 bp, Oryza sativa
ccgagccgcaataaatgcggttaggtgagccctgctgtgctcacctaacccatgcacgcggagtagaacccgcgaggggtcggggcgcctcggccctcgggggcgaggcaggagtggtccgacccccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacacaatggctaaaaataattgagatgatgcggcttcaagagagaagagagaaataacattaactacacttagtggggatgaactttatagatatactaggtgattccctgcgctttactgcaagaattactaagtaatttctaacatatatatctttcaacaatcgagcaagaagtaagtatgatgttaattattaacaacaaataaaactgattttttttcaagccatatttgaagagaaataaatttaatagactttgtagaggattatagatgaaatttatgttgttggccaaaatttgtatcgcaagaagcggaagacaggggaaaaagaaatgaaaagttaggatttattagtagtaaacatgaaacaaactaaataatatcttcgctttgatacagaatatatggatgtatgtatgttaagtattataaaaaatgatggatatatttgttgaaatattatggaaatgatgagagaggtgatgattggatctatttgcattctgatttgtagaattaaataaagtatggatgatattgcatgtttgtatgaactatttgataattagttgttgctagtgaatgataaggtagcatgtttgcatgttgagctttatacttagtgggctttaactttataaaaagcatagatgagagacgattgttgaagattgcataagtgtcttaccccctcttgtgtggattagtcctggattatggttctgtgattgcttggtttgatgggtcggaatccaagaggattcggatcgttctcaccctcaccacttggtcgcatccaacccttgcaggtataaagctagttatcctcttgtgcacggtttacaccggtgctctttggttcaaaacctactaccgtgaagatcgagcctccccttgcgggtgtgtttgtatcagttacctagttctacttggataagaggatactcaatgatataaatacaagactccctagaaggaaagagacacgaggacaaatttagacaaacccaatgtggacatgagggatctagagatatattcaatttcgtcgagttcatgtttgaggaataagactgcacaagtcgtcgatcacatgtgagagctccatgctgctagatcgatagggactagattaggtcaactcaaatgttgtactcgtgtgagactaatatataaaggcaacaatgactccggtcaacaggagaagagctattacctgtcagttaaggggtccgaa

SEQ ID NO: 10047 - DNA, 1501 bp, Oryza sativa
ttatactacctaaatgctctacctttatattgctatggtttatatctgaaggcatcatcactacgccaagaaggataggttaccttgagaacgttctcaagggttacaatatcattttccaataagaagttagagtaattttacttaaggctgtgcaggagctgaagggctgtgcgcgaacccgagaaaactttttgcattctcatttatgttagccttgattacttggatgtggtttcttatgttcacactaagctaggagggatgttcctagtataaataccactctactttatccattagacaacttttgttcaattaaaacctcatgtactagatgggtaccccacgtgttgctgcaggagaattgtgtgataatatagtatatatgagttctaaaattttcttttttccctactatatgattttttcatgtgtttatttttttacctttatcagttatccataggttataaataattgggttgtatggtatgccttttggggggggagagatgtaatttatacccttgataaatcatccaaagcctaaaaacaatttagataatgcgaagaggtgcaatttacacccttgatgaatcatccaatgtgacggagcgtggggctcctcaccgggagaccgcacgggcccccctttgccggttcggccgggggctcagggtgagatcccaagctctctgtgtatgtggaaagatcgcgacctattgaaagagcatgaagcacaagcgatgtatacaggttcgggccgctgagaagcgtaacaccctactcctgtgttttggtggatctgtgtatcaaggagctacaaagtgtgagccaacctctcccttttcttctagctactgaatctggaaaaagtcatcccccttccctatgggcaaggtcctccttttatacttcaaggggataccacatgcacccctctctttccaaactggacttttcttctcttcataaatggacggagatttgcacggttgtcctccgaacatccttctgacgggacggcacacacctacctccacttctgccggaggcaggcgcgtcgtgggaacgtggctgtgtgctgacgacatgagcagtgtcagaccgatcacaaatcggtcattcttgtccaccacgcgtcagcttagcaacgtgcatgtttgcccttcttcacacaacatcttgcctgtaatggttaggatgaagcctggcatatatcgaccggggctaacgtgccatctctgggatgtaacacgctaactccagctggggacgagtgcctagaagctctcgtcttgacgggatggggcgaagcgtgcgtcagaccgcctgtcgccacctaacccgcgatttgaccggtctgtgactggtcacagaccggataaacgagtggagtgcactgtatttcgtgcggcgtgacacgtttagccgagccgcaataaatgcggttaggtgagccctgctgtgctcacctaacccatgcacgcggagtaga

SEQ ID NO: 10048 - DNA, 1501 bp, Oryza sativa
ttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctca

SEQ ID NO: 10049 - DNA, 1501 bp, Oryza sativa
gcggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgt

SEQ ID NO: 10050 - DNA, 1501 bp, Oryza sativa
tatgtcctgaacttagcatcgggcttacgagaaacaacgcatgtactcccttatcgattcccccggcctctggcgaatgccgagtagatgttgctgcgtcttcggctcctcataggtgccttgaaagttaataacaaaaacatcgcgcaattgctcccatgagtaaatgctattggctggtaaattaaagtaccaagaacgggcgatgccatctagagcgagatggattacctttgccttggtgttttcgtcgccgtgagcggcttcgattgcggactcatagatggacagaaattccttcgggtccgttttgcccgagtaccgcggaacaggtgggaacttaaactggggtgggattggatgaatcttgattcccctgctcagcggtagccccttctcaccccctggcttgttcggcaccagctgcggatatggtgtggtgaagggtgaagtcatgacttgcgcatgaggttgggccatcgtgttcggttgcccggtcccgaacggcgacgcttggggaaccgccatggataggtcgaacgtacgctgtgtccaagccatggcgacctggttcggcgcttgattggttccgaagcttggtgccgtcgcctgtggttggacggtcggtgcttgaatggcagtgttggggtcgaactgcggtccttggctccaaggcgaagcccctggaccaggctggttcgacggtagccaactgggtgcaccctgacttgcattcccttccggtcagatcgaaggggttgtacttgaaatattgtggggttagttgagctggtgaaggaaagcttgaaactgcgcttgccaggctgaaaccccttccaccatcgcctgtgatgtctgtgccagtagcggaggatgcacttgggcagcaaccggccgaacttgtgcttgtacgtgaggggatgggtgtatggttacggctgaaggctgtcaggcgaagcacgctggcgcttgcatgacttgcagcggaaagacctggatcggcgcttgcggatagacttgaggtgggttatagcctgccgagtactagagaatgggtgctgatgcagccttagcttgtcgggccgcttcgtacgcctgctgctgcccttccatctgacgaagcatgtcctgaagtcgtgccatgttctgacgcatggcctccatgtcagcttcggcctgcgcgtcgaggttggggttgacttgtgcagcggcgagcgcggtcgaagtcggagcctgctgtggcgaagcagcttggggcgccacctgttggctcgttgaaaggatctccgccctggtctggagcacccttgctgttgcagccgtgttcggcgcctgccccgtcgaagcggcaggagccgaaggtggtggttgcagcgcaggtgccgaagccgatggtgccacgccagcttcaacgtcgggcgccgaaggctctactacctcttcggcggccatctcgcctcttgcttcacactccattcgcctagcaaccttctcctttgcg

SEQ ID NO: 10051 - DNA, 1501 bp, Oryza sativa
atactagccgatagcgatagagttttgagatgtcggctatatgtccaatgtagataatgatacttgagtaaataatgatataatgcaatcggctgatgataatacagtataacagtcatataatccaatagaaaccaatcggctaataatgatatgataggataagtactgatccaaaggataaagcatacatcggctagaggtccgatgtcataaaatccataagattagattgaacagtgaaatctttattgcaatcggctaaatccaaattgtatgtaatccttgtaagccgatacaacgtccagatacctcatcggctaaagccccgatgaaacccttattggcagtcaacaagcatgctagatattacgattctaagcatgacttaatagatcaaatttagttgatgcaacactaaatatgaaaagaaacataatatctggacaatcaagcctatggctgattttaagggtggtagatgtctaagttaatctaatctagcaacacaatttagccgatgccggcagaaaccctaaaacgagaagcagccaatagagctaaattgatatgctaagactagattaacagagacatctgataaataggtaggcaaatatatcatccaaactagagcaattcaagaggtcgaatgtactgatgcagccttgaacgatgccgacgtagacgagacaattgcctaggccggtggaacgttggacttatcccttcgctagagatcgaactgaactaatgcagccccgtgtcaggtgccaaattccactggaggataagtaaaaacctcggtaaagagggtggcgatgcgcttagagtagtattattgatcgtggagataatttacaatgacctgggtgtacatatttatacccatggggagtgttcgcggtatgtcatgagtcccttcgaccagacctaccgaaaccatgcaaccagcgaggattcaggcccaggacgctaagatcatttgggcgaagtcccatggcgaagactatgaagtagaaatcgcgaaggccgaagaatcgcgctggtatccggcaagaccaaatgcatcattgggcgaagggtgtatgccgaaggatggggtcttcgccataacaagcccaactttgaagaggccaaaggggccatcccagccgctcaggcctgttcgccaattggcccattagaggcccatgtatccaaattacaatgtatacccaatcaaacgtccctttcataagggcagccatgtaaattcccctgtaaagcctaaatcctaatgggggaacctttaataggattataaatagcccctagggacatgtgaagtggggaacccaaagaaagatctcaaaataatacatgtactttttccaacactgttgagtaaccacgtccttcgatgtacgcggttgtcgcttcgacaacagctggcgccgaccatggggacctctgagtgaaaccactaagagcgaatgccaccgaagaatgtcgcaaagga

SEQ ID NO: 10052 - DNA, 351 bp, Oryza sativa
ttctatttcccctatcgattctagcatgatcctttccctcgtacagatgttttccatgtatgttttaatctgaaaacaacgatctggctgtggaagtatgaatgatgttgccaaattaactcacgtcactttcctttagccaaatactcccaaatataagcttcggttaagcaccctataaataccacgtaccatcagcgacctgatcaagcaatattgttcaatctcggtagggaagccacaagtttgtacttcatcttcgtgtacctcttttaattctcactgacctttctgttcgcgtgattttttttactctttgcttctcatcatatatatatttgctttagcagc

SEQ ID NO: 10053 - DNA, 1501 bp, Oryza sativa
cagcagtgactagggcaacggcgcgcatggcagtggctacacacgacacggcgacacacgaaaaagcttaaccctaaaacgagaagaaaacctcaccggagaacggaacccggagagggatgatgacggcggcggcggcggttccggcggcaacacacgtgatcgacggcgacgctagatgagaaacaactgaatagattaaatagatgaattgatgtttgcggcggaaaacacatcaataaagagggagaatggagtaccggcgacgcaacgacgacgtttaaggaaaggaaaggaaacggtaccggaaacgaaattggacttggctcgtcatgcaaaacgaaaccacggacgaagagaggagtgaatcaggcatgattcacgaccaaaggcaaggagaaaatttattattaattcaaatcttgataatttaaattaacaacatcaattctgttgctctgaatattccgctttaagtcctgttaatgattttggagcaagagaattcgaaaaaaatctccctaacatttccgattattaaatacattgttaattagggttttctcctagttatccaaagtaatttctatagtcaatttattggtgaattagaatctacggaaaaggggaaactccaggtgtgataggaggggtataatcgtcatttagtagtgaaaaaaccatttttttccttcttttttgtctctttcgatggaatatgatcgatgtcagtgtaatggattgtaatggatgaccacatattgatatagccgggaaaaaacataaatgccaatgttaccctaatcactttattagtaaatttttgatttacccttaatactattggtagtattataccatcgatagagagcaccagagcatcgttcatttctatatatatgaagtatactatatgtattataatattcgatctatattacttagccataacagtaagtacaagtttcaatcaacctgagataaacttttaacgatctatttgcagcgttcgtgtacataaatagaagtcggcagtattgtttttacctcctgctaccttacttacatggtgtagtgtacatatatatactctctccgtcctaaaatatagtaattttttgagtggataggacgcatctgaacagactatccagattcatactactagtatatgtcacatcctactaaaaattgttatattttgcgacggagcgagtaccttgtaactaacattctgagatatattaatatatatagctctctattcctcctagattaaaaatgtctcgctattgttaattatagacttgtcttctaataatgtaattagttaaaccggttttatgtttttacctttcaaacaatatgggtaggtatatataaagctctcgaacaatggaaaaaaaccttattttttttcataaagttggaatctttttagtgtaaaaaagaaaacagtgcaataactggggaaacgaaggaatacaaacttcatagtagt

SEQ ID NO: 10054 - DNA, 1501 bp, Oryza sativa
cggcataataggccagccgtgtaggcggaggcaccactcggcggcgacggaggcaggccggcggtgaagtcgtagacgcccaacagcggcggcataataggccagccatgcagacggaaacaccagtcggcaagagtagtgccgcggcgttacatgcaaacagcagaaaataccaagagagattaatctgacatttagagatcaatctaataaacaacaataagttgaaaaggaaaaaacccggcgaagtcggaaattaaaaggaaaaaactcgccgagattgatctcttcgactgactccgaaacggagcggaggaggcggaggtcgcagtcgcgagcggcgttggtgtccatcagcacgacgctggacggcaggaaggcatcggcgtggctgcagccgtctcctatgcatccgattagattggttttggcatgcttcgtgtttgtagatccatcttgcaacaccatggcatcctcattgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgtacgagacctaaagtggatggatgcagagacaaaggatttagacaggttcaggccctctcaatgagaggtaataccctactcctgtttggggatttgaatccgccgagtgtgtattgatctgacgatcaggttgtgtcatgccctctagagggcctcccgcccaccttatatagggtggggggcaggattacaagatagaaaccttaaccaatacggtatcggtttcctaaatctactttacaatattatcaaaccaggactttagactgttccgtaatatataaggaaacgtaatacccgagtcatgatctattacatattccatagatataagttatcccctatgactagtcggataaccatgccgtatgggtatggggtacccataatatccacacaatataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccttattattgacctctaagcgtgccattagatagatctcgagatttgagggcgcggcccgagagaatggggcggctcgggtgcggaggggagagagagagccggtgggccgggtccatcccgcgtggtccccggttggacccgcttgtcggcgactcggctcacc

SEQ ID NO: 10055 - DNA, 221 bp, Oryza sativa
ttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcgggaggccctctagggggca

SEQ ID NO: 10056 - DNA, 317 bp, Oryza sativa
aaatgtattagtgctatggtatggtctcctatcctgcacgattttttaccaacaatctcagtttgtaaatttagttattaaatgttcagttttgctatacacctgatatatgcaacaagataacataacggtgctctgtggcaatgaaacatttacacattaaacattgcacatggaatactacgataaggaagaatgtggaatggtgtttataagcgggagaactggactccatgcaatgtttcttgtctgattggtgatttagtgatgccatttcctgtcataaactgctgacttctaatatctttaatataagt

SEQ ID NO: 10057 - DNA, 1501 bp, Oryza sativa
tagcatttcttttactttcttagattataaaaactagtgtgtggttgtgtgtttttgctatgtacatcttacttatatagagagttaaataaaaactctactatctttaaaaaaaaaagtatacatgctacatgcacgagtatacactagaaaaaaaactattttttgcatacaaccaaaactgattttcgtaggcggcacatgcggtcacctatgccaactgcaggcgaaaataatttcgttgaaaaaaacaaaatttcaaaaaaaaaatcaaattcgaaaccctaactcctttgttcatccccaaaccctagcccaccgctagcacaaaccctaggtcacaagctgatgtcttcgtcgcagccaccaccaacgtcgtggtactcgccatagtccatcctaccgccgacgtcgctgcccgctgctagatctgtgcaggagagggcgggggagtgttgttgccgctggattggcgcggggagggccacagccatcaacgcactgctcctccgtgggcctcccactcgagcccaccatcggatctgcgagggggccacagccgttgccctcgccgccgctgccaccagagcccgcgtttgccatcctcgcccgccaccaccgtcgggatggaggagaggtatggttgtgaggagtagggagagtgaaggagtggagctgtgagatggacgggaaaggggagatagagaggaggggagaaaaaaaagaatgggaagaaaatggggtattttcttatgcaggccgcttaagaggactgcgtggaaaaataatgtttttttttcgtatgcgggcctgttaagaatctgtgcaggggagatcaattttttagacggaatcagttatagtttgcctacaacctaaagagtgttttgtccagaaaaatcgatattgtaatagtgatattccggtaaggacatgcggctgtgctacatatataaatagattattgttgttgtgaagaatgtataggtgtgaatttttatacatgttgagggtggactctctgaagtgtaagtcaccagcgcgcagcgcgtatctaggattatgtatatgtacgacatttttgtacgtctgtatatacatacgtacgtacataagtatccagggatcgatgttggtgtgactttcttgggttctgatggctcagctgtctttttcttgaagtgagttaggccttattagtattgtccttcgatgtcaatgttttgtatgaattaacttaactcgtttcaggttaattagttgcttccgtgtgtgtgttcaccttgttttgagccctgctagtctgcttgcatcactgcaggatcaggacagagggatttgtaggtcaacttgcatcacacactctaacacacattccctcccccgaggaaaaaaaataaatgtgagattagattttgcatgacatcatatattttttggaccaagtcaaattaatattagaaaattggattatcaatatccccccctctctctctctctc

SEQ ID NO: 10058 - DNA, 1149 bp, Oryza sativa
atttccattctcacttctcagacaaagcattctacaatgtccaatttcaaatagagtgatacacaaggctctaggttgatttggttctgtgctgcacctatataatattatttctagtattgcagtttggagtttattttcttttaatattgaatcattatcatgagtggtaggctgttaaatctcatccataaaagagttgatgtgctttttcgatttcaattacttttaacaagaacctttttctatataaatacaggaacagatcctatgtcggatatgctttgagagagacatttgcatagttctgcttccatgccgccattatgttctttgcgagtaagcttctttggcaatcactgattcatgtatgtttcacatgttatgtcgtctgaagcttgcaaggtgtatatatttatgtattattgcaagttgctacatgttgggtgtgtttctgtttaactgcaagtggaattctaaagttctttttgttggccctgcagagcgtgctctgataagtgccggtcatgcccaatttgtcgagtgagtattgagaacaagctacctgtttgtgatgctatgagttcagctgattcaataagtgatacagtctagatgttcacatgtcgaccacagttctaggaatttatgttacctacttctcgagccagcgaagatgaccacagagaggaagacaaattgttttggctatggaattcaaaggaatgctagaataagtcttttgtgtcagagtagggtacaagaaaatcagaaggcttgctcgctaacccacacataaccctgagtgatatgacacaaaggaagcaaaagaagcgtgcgagttcttggaatcttttcttgcatatggtgccaacatgaaaatccacttaaatcattgaattctgaggcacaattcgctagttcggatgtttggtttcccatgtaaggaatcttaccaactgagggcacagttaagaaaaatcttgtgcagcaggaacttcagattgctccagtttcatgattcatgggtatataaatttgtgcagctcagagaccaaatgttctgaatctgcatcagtgcgcatacttagaaaaaggacaatatgctcttatctgctcaatcgtatctccaatgattaagttgaagca

SEQ ID NO: 10059 - DNA, 358 bp, Oryza sativa
aaacctgcgaaaaatacatgacatttgtaggcggcgatcaacaccacctacaagaaatcattttcacatacgacatctcaattttcataggcgcaacaaccacccgcctacgaaaatattcttcgcaaacaacaaaaaaaaaacaatccgcccaccacccccatctgccaccggcgtcgcttgctgtggccgacaccaccaccatcgcccctctgctggatctgggagggagggaggaggggagccgcaccgctgcctccggttagatctgggagggagggagggaggggggaagagagaggggaggggtcgtgccgcctcttccgctgccggcgccctcctcctccacctgctgagg

SEQ ID NO: 10060 - DNA, 1287 bp, Oryza sativa
ttagcctatgtgatgctacagtaaacatgtgttaatcatggattaattaggcttaatagattcgtctcgcattagcctccatctatgtaattagttttgtaattagtctatgttcaatactctaaattagcgtccagtcatccgatgtgacagggattgtccctgtatccaaagtgccactaaattcatatgttttaaaaatcctaaaaaaccccgatgtgtgagatatctttgtatgttttccccttttctgtgtcttacaagccgtatggtgcaaaagaagcactaaagcagagcacaagacgacacaacccggggactggctgataataaccgcttgaagagaccagcggttaaggtatcttcgtcatcaccggtgagtactgtgaatatgtgcgtgagatgaattgaatgaggccatatatcgcacacaacaacggtgtgacatcgcgatcgaatttgttaggagttaggtggcaggaatttggagcaacttggagaaaaaaaaaggtgaaagaggacacaaggatagatatggtggctattggtcagataccccatattgtcttacaattatcgttcaggtattagccggtctacgggtgtcttaaaatgacctgcccatatgtgataaaaaaatcattgtggccagtggcggagcggcctggccccctccaacaaaaatagtttcacatataatcacctatctataattaggtaattaacctaattagtgtattaataattatataattaggtcccctgcaagacttttaggctcatcctatatatagccaaatcctggctttgtcactgattgtggctcatgagttttcgatgctgcccgaagcatagagtgccgccgggcctgggccgcccatgcatatattataattggttggcctacgcatataattgtgtgaattatgctatcactgaaccagaacgtttgccacaattcagatgtgttgagttgttgaaagtatatgcatgtgacaagttatattcatgatatatatgtgtaccactcttcatgattaagagcaatagtaatgcgtcccaaaattttaccgacctcacataccacatagactaagaaccatattagctatatactccacaatgcatgttacttatagtgggtcttacctatctctctcctcacttttatctctccccctctctctcctctcacttttcccaccagtctctctctctctcgggcggaggaagcgaagcggcacctgtggcgagcagggctccacacctccacctctcctcgtcagg

SEQ ID NO: 10061 - DNA, 1501 bp, Oryza sativa
tacacctcttcaataaaaaaaatagaataggatatagtgatagtagaaaaattttaaaaaagcaagcaataatataaatgttagaaatatatgaaattcatcatttccataatgagggataaagtagataccaaatttataaatatggcatgtcttatgcatgcttactacacgtatacacgtcacatcctaatcaacatcaacttcgtaaaattaacatttataagttattttggtccttgtccgcatgaagtagacaagttcatgtaatgaaacgagcgttttacaagtttatgtactaaattgtacccacctaacaagtttgtgtatcaccaatacaatttactctttctgttagtatataaaattaatataagccctccaagtcacaaaagctagcttaatggatacgattttttttcttttctttttgcgaaacatggcaggttatattaaaaagcaaataccttttgttttactaccaggaatgccattgttgagtaagccatattcaattacccgccagcaaaggagagggattgctgaagcgtacagtatcagccaatgaaccaattgggtagtagtatatcaatccatagatacagtagaatatcaaaataagacataggcactgtactcaacaatggcatccctggtgttgaagtccacaaaataggttgtaaaatcaaaggtgtttttgattattattctgtgatgaacaattgggcattggagattattggttttgttatttagaatttattcacgaagtggttttggagatgattggatttcacaggtgaatctataggatactgctgttatttcatgttaccgatcagaccgggcagtgtgtgccggtcagaccggtggtgatcgagcggtcggaccggccagcccgcggtctgaccggccgatgctgtgtcggtttcggtttctggttgtttatttggatatccgtgattatttcatgattatgacttctagatggatactatacgtatgtaatactgttgtttgctactaatgagtcaagttggagatagcttggtctcggaatatggtttctttgtttatttcatgtgtaggtgacttgatgtctcgggagagtatttgcggtgatggaccgggagtcggcttggggataagacgacatccgtggtggtcagagatcatgcgggatacttaggctagagttgatgcacgtggttgatagggattccatatggcatacgatggaggtattgtgtgcgtatgggatgcagagtcgaatttggaaggagtccaaatttgatacgattggttatgtaaagtttcttcttatactatagggtttctaatgtgtttaggactcttagtatgagttttgttcgtggttttaggctacctacctcatgtataaatagagggggagcgtgaggcttcccggtatcgcttttgagagcaattgagttgagttttgagtaaggtttcgagtttagttgaaatttttgtaaggagt

SEQ ID NO: 10062 - DNA, 1501 bp, Oryza sativa
ggtgtactggtgttgatgagaaattggacattaggccactgccaatagtgggtttcgccacaatgccattccgcggaatggcgtcgttaaaatgccactcacaagagatgccaaacatttgttttgccatttgggccaattctctctatttccacctaattttccacccgagctgactaaaatacccctccggctgtcacaagtgagtcgttcgtgctgccgacgcccgcactgcccaagctcaccgccggcgacgtcccgcccccatggccgaagcccgccgcccgcacatcggagaaagagaaggaaaccctaagccggccaccgcgtcacgcgccacaatctcctccgtcgtcgcgcccgccggccaacgcgctgcttcctcccgctgaccaccgtgcgccgctcgtcaccatctcctccgccagcgtctccgccgcgcgccggaggctgcacgccaccatggcccaagaaggctagctccaggaggagctcgtggtaggacgggacctgcatcgtcgtctcgggctcggtcggcacggtaactgcggcggggatggagaccgacgagccggcgaccaaggcggcaggaggtgagccgaaaccctcgccagcgaccaaggcggcgggaggtgagccgcagccctcgcgctcgccctcgccctcgctagctctccggattgtggagattgtgtgtggtttgagctcaaagattgtgttcttgaatttgcagagcaagaggaggacgacgaggaggagagctccggcggtggtggcaccgagcctgaggttagcgccaccctgccgtcgtggtctcctccccatcccacatgttcaccggagaagagaaagaaactgtaggagagaggggcattttggtcagttgaagtgcaaaaaatggtaaaaatcttgtgaaatggcgaatatggcaaagcaacggtttggcataggttgaaagtggcattttaacgacgccattccgcggaatggcattgtggcaaaacccaatcttagaagtggtagaatgtccaatttctcggtgttgatggtgttattttgacctttgcgatagtgtgtagatgtgtgcaaaatacactcattcctatattttttaataatgatgaaatgaatttattcgttacaaaatattttttaaagagcttatagagtagtacatatacaattactcgcctatgaggctatgattttcatctttcaagattggcgctccgtgtgctcttcattgcactcgtcatatgcatgtttattctacctggtgaaggtaaaacaaaagcaggtcatgccgcacaaggggactgataaaatgatcgttctagaactttatccctgctggtttcagaatcgagttttcctttggacaaattttgaactagtcaaagagcacgcagctgtgtttgttgcttcaggagacagtggtccatccttcttccgtagaaaagacaccggtttcagagtattcagggtatgcataaatccgcaa

SEQ ID NO: 10063 - DNA, 1501 bp, Oryza sativa; identical to SEQ ID NO: 9843

SEQ ID NO: 10064 - DNA, 1501 bp, Oryza sativa
ctttaaatcggagccgcttcaatacttaccaataagttctactgcacatggtgagttttctctgtgataatccaaacacccgcaagcaagaacacatatcagtacaacctctatcctacaaagactttattttatactgacttggcctctcacatcgccccccgtgtagacaaccgcaccggggaagggggggggggggcttcaaccctagtcgtcatcaccaccaccctccctcctccgtctcgatgccaccagaaaccacgcacggaacgatacggtggcaacatatcccgtttgcctcctagctccgccatggagattaggtggcagtgacgatgacaagcggcgtggtggcttcactattgaactcgacgactagatctggtgctttttgagagctgaggtgtactgggtcgatggctggggcggaggtggcgcaaggtggcgacaatgacaacaatagtaggttgccatatccgatatcaatgtggctagatctgacaccccgatagtggattccacagaggttgaggagagcaaactacaacataacaacgagagcttggatgcgtcgtgactcggcttggtccatatggaggcgaggcggcaagatgcggctatagaggagggggtgcagcctgaaagatctattccctagaattgcctttgtaagaggagattggaagatctattaccctaagagtgtggtgattattttggtgatttatgacaacacatgttggaagatattaggttgagttccgacatcaagctgaaagattgaaggtagaagatggacattacagcttgatgaggagcaagtaaagatattgacgatacggggacacggggtatgagtggctatatatggcaagatcgtgaagggcaatcaagactcggctacaatggatcatgaggaggtgaagggaaagcaagaggcttggcgccgatggactcaatctggtggtgaagggcgagcaaagactttgtcacgatggatcgtgcgaggccatttgaagccatgagtaatccacatcaattatttgaagagcgcaagatggaatgccgaagatcaataggatgtaattcgttgatgaacatcaagccaaaagccaaagtggtcattgatcaagacaaatatatagtcaattttggattaatgtgcttaatgagttataggtgagaatagtcctagtagtgagatggcgttggtgttggcaactgtcaaggtaaagcaagaagatgacaagaaaacattcctagtggtatagatttcctatttgcatttgagtatacgaattccgtactattaagagtgatgcattgttgatgtgtttgtttatctctcggtactcaaagtgacccatgcaagtgttaccttgagagaaaccagagccttaaactaacctatgagtggttcagagcttggttgggttggataactgtcagggttacgggtaaggtataccctctacccttcgatatacgtcacatatcgata

SEQ ID NO: 10065 - DNA, 1501 bp, Oryza sativa
aaccggaagttctcatcattctaatatgctataaagttgtgataatttttagaaacgactattcacccccctctaggcgacatcaaggtcctttcacccatgtttatagaaacaaatcctgaccagccaccaacattcttggtcttgaataggtgagtgcacttggtcttcaaactgatggggttggccgatgtagtgatgtctagccctgtgatcatgattatatccaagagcagtcatcggcctatggttgaacaagaaagcgtttaaggtgtctgaccaaaataggctgcagctgataacattggttcatctttcttcttatcggctagagatagagaaaggcattgagatattcctatttcttcccagtgactctgcttgcttgtagctactctgttataccactcaacccatttatcggcttgggatggccatgatctaaaggtcgtagacaaatgggctaggtttggattggtctacctaaaagggattctatttgtttctgagttgatgaatatagtgggatctgtatctccaattgggcccatgaaaaagtgatttgattctttcagacttgggactgctacctagggcgctaaatgctacagattgcaagagagggagattgaattgcaagaagacgcaagaattggaaagagtttgagctgatggggcttacctctggaaactctgcagttggcgggcttgacgagctcggggaggatgccattgaagttgcattgggaatcgccactgagagcgcatgtgcggtcaccggagaacgtgggaatcgccggagagatggggaaagtgattttgcttaggtggtgaaaacggaagtggatggcgtggaaattttaagcggtggttactatttaaaagcgcgcggttaacggccaatggcggataaacacttggggggcatgtgttaatgaccaaatttggtaatgcatggatcgtatttggaggtaaagacgaagcagatttggaggggattgtggtgacggttgaaaacatattacacatcggctggagaccgtatcggctaacactagtcggatagggatagccgatacagccgatatcgacaagatgggttacaaagtcattgtcggatttgattgaagggctacaggagtattgccaggcaaggattatgttcaaagaatggcaattgtatctattaattaggatattttagtagtttccttatagatatctttggtaagagtgtgcctaagtgacttgtttgtctgttagagctataatagaagtttgagtcgtgtccatatggaaattgttggtatttcttaacgacattactataaatataattcacagtaatggcgcagaaatacttttggtatattatggttacagagttcatccgcaagcgtacggataaatcattgtagcatttcacccgagagtattccaagggtatcttatttattttatcccgtgggaagatcatgtagagagaacttgactaataatt

SEQ ID NO: 10066 - DNA, 1501 bp, Oryza sativa; identical to SEQ ID NO: 9840

SEQ ID NO: 10067 - DNA, 571 bp, Oryza sativa
atatataaatactataaattggatctgaaacgtgttgtggtgagctatggcacaaaatcctctttccatgaattgaacacataatggttagaggtcggagattaatgatatggcctatgcaaatatctaccaagattcctacacccatcatgctctgcttagggacactgcaatttgctccagtagaacttgaaatcagtacaaactgctaagtgggctaattgctatactctttcactttctacacaattttctttggtgattgacattacattttttatttgttcttcgaaagaaaaatgaacctttcagttcctttccatgctgaaatttcatacgttgagtgccagttacaccaaaagagctgaatgcgtggagccacaaggttgcaggcaggtcaatatactttggagctgtgatctgttgctctgtagatcctgtgcagtcagaggtttggtttgctttgtaaggacgaattgattttttgaaactagaaactcaagtgaatttggcacacaccattatattgttcttattttgcatctgattttgaggtgaagttcacttggtc

SEQ ID NO: 10068 - DNA, 227 bp, Oryza sativa
gcccagcaacggtgtatccggctcccgttcattttagactagacgtgttaatagtatagtgacctggccttgtcagcactcggccatggtttcgcctataaatagacatatataacagccatagcatttttcagctttagccaatgcattgcttggcctcgtcggtcatgaacatagcatatatctttttttttttatctccactcctcctttgtttataatttagg

SEQ ID NO: 10069 - DNA, 1501 bp, Oryza sativa
gtttccgtcgttacgaaggttcgcgagtgcgccggaagtattcaagaagattaattgaagaccgattattgcaaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttggactatgtatatattggttcagctagatattagatataattgcttagccatgcttagaaacattagcacactattgggataacttatgactcactattacttaatgatggcttaatgatagttcacgatggtcaattgtgattggttaattaattacttgccaactaaaacttgataatggtgggttgtgagcacatggttttgagagtcgtgctcatgacaattaaggaccggttcgcgagctactattgtgaaacattaaccatgccaaccacaagccagcgtgggcaacggctttaccttttgtatagcatgattcattgcggagcaccagactgagaagtggcggagataagcccacgggggtcgctggggagtccatgccttgtttataagggggtgattatgatccaggaaaggtgcgctgtggtggattgtcttgtgcaaggggtattgtcacagctcctttccgaggtaccgtggtggtattgaggcacatggtgacatgttgtggggctgtgtcttgtgggtacagtggtacacctctggccagagtaaaactattcgaatagccgtgcccgcggttatgggcgggttgagcaatgtttttcgtgattagtctcacacctctcacaacaattatggatgttatacctagtaataatttgcttagctcctggtttagagttagatctgtacagccgggtatggttgttcggaatggttgggcctgagcagcatgggcgtgttgttcagtgttgattaaaattaatgattaaagtactctactgttttattactcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgtctgtgggagtggagccggagcttcgctagattttattttccgctgcaggtttcttcatggtgaggactaagtgcctcttaagtaagtatttattgttttagttattttgatgaatctgtatattaaattgtcaatttgtgtacctcggctgattcctggatgaggattttatgcacaaataagttcggaaattactagtgaattttcgggcgtgacagatgcttaggctaaagatcaa

SEQ ID NO: 10070 - DNA, 1501 bp, Oryza sativa
aaattttgttaaatactttgcttaattctataattcctagatttttctgggatttatttgagctaaggaagtatttttaataaatggaattgcatttcatgaataatttaaatcgaaaaaggtttttaaaagtatcttttggctttgggccgaaagccagcccaaaacctctctctttctctctccctccccggcccagtcggcccagtccgccgcgccccttcctcctctctctcggccgctgacaggtgggtcccgcctgtcaggttcgtcttcctcgcgccgccgccgccgcccgaaccctagcgccgcgccgccgtcgtctccttccaaattcggccgcgcctttccttctccggtgaaatcaatagaggggaaatgatcctcgggatctcctccaccttttctcttttggaatcatcgtctaaatcgctttggaagttcgtgaattcgaggtcgattcggatcggtctctttcctccgaaccctaacttttccttcgcgtcgccggtcgccgtgggtcttcgccgccgcctccttgcccctttaaaagcacccccgagctctcctctatccgccgtcacctttgccttagcccgccgtcgcgtctagcgccgcctccgcgtagccctagccgccgccgtcgttgccgccgctccagccgtgcttcgccgtcgctccagtcgtcgccgtcgctcggggaagtcgccatcgtggtcgccgtcgcgtcgccgtcctcgtccaccgctccgccgccgccgaagaccgccggagcaccgccgtcaccgtcgacccgaagaccgtcgccgcttcttcctcgtcgccggcgccatccgttgctcttcgccgttgttttggtcatcggtgagttcaccgcgtcgccctctacccgttggtgtcctccgttcgcgtcgtcgcgccgtcgttcgccggcgagcatgcattgccgagccgccgccggtgttgacgtcatcgctgacgtcgtcgctgacgtcatcgggaccgtccgccgtggcccggtcgtggaccgttcgatctcggccgtccattttggatggatcgatctcggccgtccgttcccgtgaaccgttgccgtgcacccggtccaccgcaaaccctagccgctgacgcaataattcccttttccttttcaaaaataattcattattgcgtcataattcaattaaaatccatataaatgctttaatccgatttaatctttgaaaattcataactaattcattgtaactcagtttaatgtggttcaagttgcaaaagttgtataaaataaagatctacatgttaaaattatccataaattgaattaaatttatttaatcctttttaaataggctttaaatagatttaatcttgtaaagttcataataaattcatttgaagtcagaatgaggccgttcaagtctcataattcatctaaaattatgatctacatgtttgtttactttttatgtattgtttatttggtttttattagtctttt

SEQ ID NO: 10071 - DNA, 1501 bp, Oryza sativa
gatctaactctaaaccaggagctaagcaaattattactaggtataacatccataattgttgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagctgtgacaataccccttgcacaagacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcatggttaatgtttcacaatagtagctcgcgaaccggtccttaattgtcatgagcacgactctcaaaaccatgtgctcacaacccaccattatcaagttttagttggcaagtaattaattaaccaatcacaattgaccatcgtgaactatcattaagccatcattaagtaatagtgagtcataagttatcccaatagtgtgctaatgtttctaagcatggctaagcaattatatctaatatctagctgaaccaatatatacatagtccaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgcctttgcaataatcggtcttcaattaatcttcttgaatacttccggcgcactcgcgaaccttcgtaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaactttacaagattaaatctatttaaagcctatttaaaaaggattaaataaatttaattcaatttatggataattttaacatgtagatctttattttatacaacttttgcaacttgaaccacattaaactgagttacaatgaattagttatgaattttcaaagattaaatcggattaaagcatttatatggattttaattgaattatgacgcaataatgaattatttttgaaaaggaaaagggaattattgcgtcagcggctagggtttgcggtggaccgggtgcacggcaacggttcacgggaacggacggccgagatcgatccatccaaaatggacggccgagatcgaacggtccacgaccgggccacggcggacggtcccgatgacgtcagcga

SEQ ID NO: 10072 - DNA, 1501 bp, Oryza sativa
tcgtgtaatctgtaccgctgttcatcttcaatgcagctcaggatcccctccccttcgcagtttttctatttatttcttgtttggacgacataaaaaatttaaaaccgggttaaattgtgtgtatagttttttttaaaaaaaagattgaagagagagtggtaaaatttgatgcataataatttgggtagtgtgaaaagagagaataaggtgagcttaacttaactgtttagatacttatagtagaaccaacccaccgagttagagtactacttaatatgagtgtttgtatttatatggctaattatttttgacaatatacccatcaatagctatacacgaataataattatattaagatatactgaggccccgtttagttccccaaattttttttccagaaaacatcacatcaaatctttggacacatgtataaagtattaaatgtagataaatgaaaaaactaattgtacagttaggagggaatcgcgagatgaatctttggagtctaattagtgcatgattagtcataagtgctatagtaacccacatgtgctaatgacggactaattagactcaaaagatttgtctcgcggtttccaggcgagttataaaattatttttttattcgtgtccgaaaacccttccgatatccggtcaaacatccaatgtgacacccaaaaattttcttttcataaactaaacaggccctgatccaatatatctgtcccaaaaaactcaacttctagagtttgaattttgtcccataaaaaccaacttctaccatcctatctacactcagcacgtaaaacgaaaggttttattccttcaataccctttacctacctatcacacctactattttttttcaatgtccaagggcattttagtatttctctatctcaactaaaacaaccttgggatgctaggaatatgttctttttggacggagggactatatgtgttcgcagagataatttatgcatgtgttataagtgtgtcgtttgtagtcctacaatgttataagagagagaataaaaaaaacaagggagtacctatacatctttcgaaagatttttattatcatatcacacaaatttttaatctttaattaaaatccgatagatataataaaaagcaaaaagcaattaagaaacaccataatggacactaaattaccatatcctcaagaaaaagatcaaatccaatacaaattttaaaatttacatgcgaagattcacaaattacagtgtaacctacaaaagttacagcgtaaatttcataaattacactgtaacttacaagaaaatgcactgtaaatttaagtgagaacatcgagtgagagataagaaaaaatctttcaggtaagatatagcaaaatcgaaaaaacaaattactcggagagatcaaggagggttggggaggtagcatgttggggcggtggatacggggagcggatcggatcggatcagaccggccataaactttcgcttgctgtcgaaga

SEQ ID NO: 10073 - DNA, 1501 bp, Oryza sativa
  unsure (1)..(1501): unsure at all n locations
ctgatcttcaggatgtaggatcttgaacaagataactagctgaaaatcagccaagataactagctgcgagcagccggataactaatgcaacctgacgacacgcacaaggagccaaccaccgtctctatacggcagcctgaaccaaggattcgcccaatcacactctcaaagaaccaacctaagcagcctgcacacgaagtagcaggagcacagattgggtgccgatgaagcggccgctatgtaatcccacgaggaattcacaagagcaaaggggtagagatctctatctctcggtgtttgttagcacacagctgaacaaaggggtttgtattttgattctcaaaagtcttccaaatgataaaacataagggatatttatactaggaacaaccctcctagatgggaatgaaaggtcttgggagtttacaggacataggctatctcaaaggtcacaataagtgaatttccgagaagactcacgcgtctgtttggcttctgagcagtcctcaatgatttgttcataactccttattgggaagtcgaaatgacgagccatttgttggaggtgaaactagacttaattatctttgtaaccatatatattatgcatggagaaatttgactggctggatcgcacatcccttggaagttggagcatctgcgtgtaaccagtctgctcgttgtcgtaaaccatctccacttgagcaaatgtcacttcatcttctgtggaanccnnacccccattgatgtagtcattgatatttgtagtagtgaccatctcctttggtatgaaccttagcaaagcaaatatacaccatttagatagtataaaattatcatcaatactaaagttcaatttagcaagaaatgaattaaccttttgtcgtgtttttattgaatgatgttgtgcactccatctttgctcagcacaatctcttggtgatggagtcacaacatggcttagcgtagttggtccttgcaatggtggcactaatccaattgttggtttacgttcatatgatagcaagggtagtgcacgattacgttgccttggtgtagtggtggtaatctgagttaagtctctctctttaagcacaacgatatgctttaacctacaatcatacaagccaagtagcagcctttcctgatgaaaacaataagacttggagttaagcatagcgttatccttgcattgatgtgcaacaatcacattatgtgtgaatggccttggtcgggtcgtatcaccatcgcactgatcggcgaaaagcttgacgctacccctacctggcgcgccaactgtcgaaacaagatttcggcaatacaaaaaggggtggctatcaagcaggaaaagtggatgggtttagagacaagagatttatacagtttcatgccctctcaatgagaagtaataccctactcctgtccggggattgatccgccgagtatgttattgatcgtatgatctgggagaaaagttatgccgcaagaggcacccgaaccc

SEQ ID NO: 10074 - DNA, 1501 bp, Oryza sativa
aattgcacattcttgccaagttgttgcactagaaggctcatttttcaagttattacaccaaattgcacccacctgctaagttgttgcaccgtgggtgcaatttactcttcttttaatataacgtgaagtggaaaaagcacatgaattcaaacacataagagctatgttttttttatcacatgaagattttgaagacagatagatatgaaacaaaacgactttccattaagctaaaactagatgttttctttcctatagaaatagaggaattgccacctctccgaaggaatcaaactgttccactcctttgtcccaatcctaatctgaaactccaaacgattgcacgcctccaaaatttcttgaaaaaatattcgttccaaatagcgtagtgctcccttcgtcccataaaaaaccatataatattttctgatacaatgaatttgggcatacccctattgagatttactatactaggaaatggcacatctcattttaagttggttttttatgaaacggagaaagtatgtaggattaggaacccaaaagggtgtgaatgacatcatattcctatgtttaatcaacttgaagttggttgcaaaccctttcatcaatcaaaagagaaaaaaaaaaagggaaattggggtgaaaaaacaattaggcaaggaatccctctcccaagccgtaggatcacctctcgcacgaatcacgaggcgcatctctccaaagcctccggctccactccaactcctctcgcctccgcggctccgcccatttcgcgggtcgccggagcagcagcagccgccgcgccagatctcgaaccttctagaagcttccgcccgcttccacccatctcccccgagggcgcctggatcccgaaccttctaggcgtcggcggccggggaaggcgcgaggggaggcggaccacgggatctgcttcgaagcccctcgcctcctctggaaccttccgggcgcggcgcggcgggatggcggtgagtttccttcctccgcgctgcgagttacccggatcggcttagacgatgcaatttctaggcgagttaaccagggattcctcaaattgttggtggcttgctgctgctggtctcttcgaccattgaacccgcagttcctgcgagttgatgatttggttttggttcccctcctgggcatgtgtgctgcaattagaactcagaaatttgtagagatggtggaggattggtggtatttgttcaaggcaaatcttagctacagagcatgccactgtttgaccagaatgtgtgtttacctgtcacgcaagcttggtatttgtagcatttctgttcatgttgctatctaggcgtgtagaatccatgaattcagtattatttgaaagtcatttgctggcattcaggagagtttgaatttcttttttctctttctttttaaaccatgaatgatgtgtgttctcttataaccttttcacgtttcatgtcactagagtgcaaaagtgtcgcaccccgttaaa

SEQ ID NO: 10075 - DNA, 1501 bp, Oryza sativa
aaggataacataggatttaattctttgtttgaaaggttttcataggaaattttcctatagaatggaagggccctaacttgtgagaatctagctagaaaaactgagtttttcaacttctaacttttaatttattttccatattatatactggatattctcataatctaacttacaatctaaaccgtttagaatagcttctgacgacttgatattttggaaggccaggcaaggtctctgagcatatatgtgcctacgttgaccaccatgcaggacacggccaatcgtaccgtttcccgtatgtgtgcgcccataggttagttcagaatttatactaatgactaagctttgacctgatcattactagtagccaaggagctagctaattaacgtgtgctttgcatgtctacgtaacgtactaattaacgtgtgtacatggcaacatgacacgcacacacgcctatatatatatcagactactacgaccaggcctaattaatctacctaccaggtccaggtgatgagtgtacgtatacgcatgtacctatatatattagtttgtacccttccgttatacgatgtaagtcattctaccattttatattaatatgtaaaatgctaaaatgatttgaatcaaaggaagtagttaacaaagttgagattaaactcgttttctaaaattaatccactgtcaattagttgcacaataagtaccattagtgtaatggtaaattaagttgcgtgcgcgtctgtgtttggcctccatcactctcaccaggattcaaatcgtgtctataaatatataagtgtgtgtatatttaggttatgtacaatagatcgagattaggtgttaattcacgaaatatggttgtgtgtatttcagatggtgcagagacagtcggtctcgtatttttgttctcctaaaataagagtaaattgtattcattatataacacttataattgaacattcgagtgtaataacttgacaagtgagtatgtaccacttgacaacttaggtttttatttttttttgttctagcaacttggcaagtgagtgtaataactttgctctttggttaatgagtgttagctgagttttttttttcaataatgtcaatttgccatcacatgctaatccagtagatattgcctcacaatctaaattaatccataagaattacattgatcatataatttgcaccactgatttgcttcacattctcaaatctcaaccgaaatacaaaaatttctacatagtaaaatctaattgttttatttactagaatgataaaatttgagtaagcttatacaaatatgcacatgtatatccacaaaacaactattcaaaaaccgaacatgtatagaaaaaatatgcccaaactaagtaagttgttatatcacttcttaagtttgtacaaaatcttacccatcttataagttgttgcacctatatgtttatttattaacttcttggactaaattgcactcatatacgaagtttt

SEQ ID NO: 10076 - DNA, 1501 bp, Oryza sativa
gaaaaggcaaaggaacaaacgctacgggctaaggaaggaagcatctggtaaggtataagagagcactcggtagcaggctgccattttcgtatcgtcccctcctctgatacggactccgttttctgaatagtcggcgctacttgtctacatccacctgctctcatcaggaataaaaggggctttgcccacaacttatcctcaggatctaatactgcgccaccatacgtggagtttacagataattcagccttgatgcaaagtactatccaacagagttgtcacggtatcatcgtcatctacttttctgagatttgtatcaaagttgccactgtatcatcgccatctacttttgtgcgacctggggataaaaaggagagaaggaagaaatacatattgtacctcaacaggagagagaacatacttacgtacgtacatcagccagagttggaactgctaccacctgttgctatccaaaacagagaatcgttgctccaaatgcaaatgatttcatttttatgatgtcagtaatactaacaattaacagaggaacagactacagagcccacggccggcgccacagggcacatctgaacaagcgtggagcccatgtgctggacgatgcacacagccatttatttttgttcctgaaaaccatatgcacagccattaactgtaaagcacatataaatacccaaggaaacaaacaatgttgttacagatgtcattgtatagcatggacgtgttccactgttggatgaaaaagaagcagcgtaacatattactcggccgcaaaattggagcggcgcgagaagccctttcggcagcagcatgcacgagcacgacaccgagcatcggccaggccggccccagcaagagcaaagttaagctcgcccagccggcaagcaacacggaacgcacgatcccctgctcacgggtcgaattcgaagcagcagcagcagcagcagaaggagaagcttcttaattcgttcgcgtttaacaaccccatccccgtagacgacgacgaggaggagaacgatggcatggcatggcatccctgtcggcgtgcagtaacacctcactctgctgctgtcccgacgttaacctctcccctcactgacgctaagcacactggcagtcgcgtactacacgcggttagagcgagcttccattagcccccgagaaattaacaaaaagcaaaagcagaaggaaaaaaaagaaaaacgtcactcgcatcacatcacagcactagccgctctctctctctctctctctctctctctctctctctctcctcaccagattctatataagcagctcgtccaaccttgggaggcacccagcagcagccagctagctagctactcctactcagcagcagcagcagctcaggtctctccagtgttcttcgagctatacactagctctcacagatttttgctccgactcatcaagcggattgattcgatcggctgttagagagagaaaaaaggagagttggaga

SEQ ID NO: 10077 - DNA, 1141 bp, Oryza sativa
tatgggacggagggagtacatgctctctctaagtagataatacttcactttaaaaaaaaattgtgatcgctatattctattataatatatataaatatcaatcaacaaatgaatttattgaagtatattttaagattaaaatgtagatatgcatggtcttcatatttttaagatagatattttaaagattatttatcatcacattttctaaattttgttaacaattttatttaaaatgcgaagtactatcaatttgagaggagcaagtatcgattttttttcacgaacttgcaaaatgattgcacatcagtatattatattactccatctatcccaaagtaagtgtagtttgcattgtttatgtctaacgtataaccgttcattttatttaatgtttttatgattaatatttttattgttattaaatgataaaacataaatagtactttatgtgtgactaattttttaaatctttttaataaattttttaaataaaacggacggtcaaacgttagatataatatagatatttatagttatatttattttagaacggaggtagtagaagaaattgagttttgttcacaacgtaagataccaaaccgcaatcgttgccggttacaaggaaatgggatctaggcatctagcggaatagaaaacaaacagcaggagcaagttacaagtatctacgtatcactcaggtttaggtttataaagtgggtggtcctatatagaactccctttatattttaatatatgatattgttatcttttttactaacgtttaatcgttcgttttatttaaattttgtgtgtaaatataaaaatattcatatcaaacttaaagaacatttgatgataaatcaagtcacaataaaataaatgataattatataattttttaataaaataaatgatcaaacgttgtaaaaaagtcaacaacgttatatattaaaatatggatgtagcatttccagagaaaagcgcgtagactacgtggaagaccatccgtgctcctcgttgcaagtcttgtcaaaacttttttaagtagatattagcatctagtcgtagataattaattaagctgggcctgggaagcttcgaaaaaaatggctgcacttggaaagtttgcgtggttagt

SEQ ID NO: 10078 - DNA, 1313 bp, Oryza sativa
ggggcgtgggcgacgacgtcttctcttgctagttgctactgatccgtgctcgtaatcgtacgtactgcccgtttggtcgggtacatgtacatgtactagtacgtgacatcttgcaatccctaaaagacttttttttttggaagaaccaaaagatagtgaactgcatgagtggaatcctataggatagttaacttgaatctgcaaacatcttaccaccaatcgggagattcagagtttcattatatgcagatgttgttgccctttctgtcacccctacatacttaaatcttttcgcttctgtaagtgggatgcacatttatttgcaacactcaaaagtttctgtaatttgctgatggatataatatcactattataggacatcctttaaaattaataatttgcctgagaacattttcggttcgattggagagaaaaattctttaaaaagacaagaatgcccctatgaccaaaatcttttaacctatagtgctggagtgaagatgaaatatgatgcatattctaatctatttgaaaattttatctctctaacagatcgaaagtgtcctataacatattactatttgtttatgtcttttagccatcacacgtttttacaatattcactagtaaattacataatctttgagtgacctatagcaaaaattgtctttaaaaaaaagagagatatacccaatctcctgcaatgaactaaatgtagaggcacgctttacaaattttcctggaaaggtatcaacattgtcatgcaaatatctagtacattatcaaccactgactataaaggtatcaacattgtcattgcctctgactataaaaagctgaaaaaacgattatcaaccactttttgacaagtttggcttcaaattagctggatggttaggtcgcttcttcacatcgtctagcagaaagacgctagtaaaatcagttcttaatgtcccgcctctctgataccgggtccacttacatctggcagcttttataggttataaactgctctcacaaactaacacaaatcttttctgcacactttgtcctcactcgtgcgcacttgggaagaatttcctgatcggtcgcccatcccaaatctgctccaagctaagcatgcttaaccttagagttctttcgagatcggcttccggaaaagaagttgcaacttgttgatatgagtattctattaatcctattaatccctgggccgggatgtcacagcaagagaataggctggattagaggatcctttctttggagaagtgatgacccacaaaatgtcagtggaggccacttcttgattaatt

SEQ ID NO: 10079 - DNA, 1501 bp, Oryza sativa
agctgataagaacaacgataggaaaataaagggtttttagacagagagtaagacaattgacatgatggtttcagtcctactagatgcttctggacatgacggatagagctgaatacctgtccaaattcatatataataatttaaaatttttgctcaaaacataacatttaaccagttgaaaagcgtgttaaaacataacatttaacctgttaaaaagtgtgttcacgagaaataaaaaaaagtagcgtaacctgataagaacgatgacgtaatttttttttcgaccgatacagttggtatagtaatggtttgggtccgactagatgcttctagacacgacgccgtatcctctaggaggattgccgtcctcgaaaacccgtgctgagggtgtagcgcgcgtaggcctcgagcccatctcactatcaaaacgatctatcggatttcccaagtagaaacacacgtctcctgaaccaaccaggtgcacgatgcacctccccgcggtgccacacaccctctacgcctggatggtcaccaccaacaacgggggccccatctgccatgtctgcagtagaagcgaaaccccacgagaattcgaaaccatttcaaacctcccccgccagcgcaacgccgaaaacgcgaaaataagacagttcccacgtaaaaacttttcacgctatcatattaaatattaaatatgtaatattaaatatagaaaaaaagcaattacatagattttgtgtaaattacaagacaaatcttttaagcctaattacgccacgatttaacaatacagtgctacagtaaacatttgctaatagattaattagacttgataaattcgtctcacagtttacagacggaatatgtaatttattttgttattagactacgtttaatattttaaacatgtgttcgtatattcaatgtgacacgcaagatcaatatttttttttttgccaactaaacagggcctaaaccccgtttcccgctgatttcgcctcgttttgcccccaaactcgattcgaaaccatttcaaacctccccgcggcgcaacgcctaaaacgcgaaaaataaaccccgtttcccgctgatttcgcctcgttttgccccccaaactcgcgtccaccacccgccccgcccaaaaatcgcccaaaacgaaccgacgctacgcgagccaagccacccctcgcgcggcaggtcgcgaaaagttggggcaaatacacggaaagaaaccctccatagtacgcgcgcgaggggaagccgaaaaggcaaaccaaatcaccaacaaaaatagtaggccgcccccgtttctccctcgcgccgcctcgccgcggccgaaatctcaaacgcacccccccccccccgcccccccaaaattttcgctgccgcgccttctcgcctcccttaagaacgcgcctccccgagttctcctttgtctctccccgcgccattgccaatctccgacgcgttgtggaggtagttgttgtcggtggtccggcta

SEQ ID NO: 10080 - DNA, 1501 bp, Oryza sativa; identical to SEQ ID NO: 9106

SEQ ID NO: 10081 - DNA, 1501 bp, Oryza sativa; identical to SEQ ID NO: 9353

SEQ ID NO: 10082 - DNA, 1501 bp, Oryza sativa; identical to SEQ ID NO: 7524

SEQ ID NO: 10083 - DNA, 1501 bp, Oryza sativa; identical to SEQ ID NO: 9352

SEQ ID NO: 10084 - DNA, 1501 bp, Oryza sativa
cttaggttttcttaatcactcgcattaattatcaatcaccaaaaccgccacctatttgccacgtactaactagttcatagaattacattaacacgtggcaaatgaaaaaagaaccgtacagctgacatgtagaatacataataagaaaatttcttattatgagttctacataaaacacacctcgtccgactcagacgttttaacatgtggtaacgaacacgttaccggttcaccaccgcacatatctcacatatttttgttatgtgtgaaccgtggccactgtcttgagtttgtgaaggtttagttagttccaccatatagatcttacttatcatcggacaaccatgtaacatcaacgcggggtatgtggtattatcgtacaacgatggaggcagtggtacacctggtagacctatggtcgtgtctcgtgtgggcacacacaaaccactactagcgacgtgagagaacataaaggaggtggcccatggcaaccgaagttgagttgaggtaaagatgaggataagtaggaggctacaccaatggtgcctagtggctcatcggccggacctaccggcggtagcacatgcctccccagaccccagcttgaggggttaggagaaacaggatcctatttttttagcattcctgttacaacaaagtaaagcactcacacttgtaaaatcaaaggtgttttttattattattctgtgatgaataattgggcattggagattattggttttgttatttggaatttattcatgaagtggtttggagatgattggattcacaggtgatcgcaggattcattatttcatgtgaccgatcagaccgggctgtgtatgccggtcagaccggcggtaatcgagcggttggaccggccagcccgcggtctgaccggccgacactgtgtcagtttcgctttcgggttgtttgtttggatatccgtgattatttcatgattatggcttctagatggatactatacgtatgtaatactgttgtttgctactaatgagtcaagttggagatagcttggtctcggaatatggtttctttatttatttcatgtgtaggtgactcgatgtctcgggagagtatttgcggtgatggaccgggagtcggcttggggataagacgacgtccgtggtggtcagagattatgcgggatacttaggctagagttgatgcacgtggttgatggagattccatatggcatacgatggaggtattgtgtgtgtatgggatgcggagtcgaatttggaaggagtccaaatttggtacgattggttatgtaaagtttctttcttgtactaaagggttttctaaggtgtttaggactcctagtatgagtttggttcctgcctgcctcgggtataaatagagggggagcatgaggcttcccggtatcgcttttgaaagcaattgagttgagttttgagttagggttttgagtttagtcgaaatttctgtaaggagtgctgtttgtgcacttcgtaa

SEQ ID NO: 10085 - DNA, 1501 bp, Oryza sativa
gaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacggttattttcaaatttgaacggtcaaatagccgttagtgccacgtgtcgccttcccgttggaccgccgcccgccctgtcagtctgtcacgcgccgccggcgcttttcggcctgacgggccgtgccgggccgtgccgtgcgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctatactttggccccactcccaccatcataaaataaaccagcccaaattacgattacgatgacactacgctacgctaggtaagcttatacttattaaattattgtaattattgtagagacaacattgcaaacacaatccaatttcctattaatagttccacgactttgagaaaattgtgacagtatcaagtaattcatgctagcatttttataagaaaatgcagtgataactataattgtacgtatcaacatgtatcagtgatcgatcctgtatttagtggtggttatattaaataccatcaataatcatctcaataaagaagagagaggagaaaatgtgtggaacggtgaataaataatccagtgttaggattaatcaagactgatcgaggcccttatcacggcggggcccagggccaccgcaccactcgccctaccacagggctagcgcaaaccgaactcgagccaagcacccgaaaccgaattcgagccgcgctgcggatccatcacaaagcccatctacccaaaaacccaatcatatagcccacgcgcgggcttggcggcttgcccccgtttgcgaaacccgatcaacccccaccgtcgcatccagatcgtacggcccaaacgcaccaactcgaaaatcccctcctcttcctccctccctccggccctcccgagccctaaccctagctctctctccccatcaccaccggcggccatggcgctcgccatccgcgccgccgccgccgccgccggcgacatggcgccgtcatccgcctccgacccgaccctcgggttcctcaccaagcgggacacggaggtgaagctgccccgggcgacgc

SEQ ID NO: 10086 - DNA, 1501 bp, Oryza sativa
taacagttttaaaaatttccccatcggttgtccccgaattgaattcaggttattgtttcagtcgtaactgattttgaatttaattagagggtccgtcttttcctttttgtcactctgttttaacttgagtaaatttcacaaaactacatgttttatagttcaagttgcagaaaaccacacacactttaacacttgggacttaagtatatatattttaaagtgtagaatgaatggattcacccgcgatatgacgtgactgtttcacctaggacgagaacatggcatcctattatcagccatcgcacgaaattaataggatgccacgtcctcatcttagatggaacaaccacgtcatctcacggataaatccatttatcgatagtgtggttttgtgaaactaaactatcaaaatatatgtacttaagtgccaagtgtcaaaatatgtgtggttttgtgtgtggttttctgcaacttgaaccataaaatatatgtagttttgtgaaatttactcattttaacttctactttactatgttagtaaaaatataaaattctagatataatcattgtgcagattagtagcgagaagttaatttttgctgagacaaagagtacttcactatgagtagcaatataaaattttaccctgaaataattttcgtagacttataatggacaccctactgttcgttccttttctcttaccgatctaaatggcgtggttttaagaaacttacttcataagaaagctttccaaattcaccttgttaactttttaatatttatttgtgcccttaaataatactccctccatcccattttaagtgaagttttgggtttctatgtctaacatttaaccgtccgttttatttgaaaaatttataaaatatttttaaaaaataagtcatgcataaattactattaatattttatcatctaataacaacagaaatactaataattttattttaaataagacgaagagacaaacgtttaaaaaaaaatccaaaactgggagtagtaataaactctgtgtgattcataatggatcatccatcagaatatatatatagtaccgaaaagaaaattcaaataaagatgaatcatcagacttccacacaaaatgattagcagcagcatgagtggcacggcatatcccagcctcttaattaaaccccactcgtaattaaatggtgcgcgccaactatgcttaattcaacatctcaccactaaaaactcgcgatctccacttctccgcgccacaatccatctctctagcactctccacaccattcgttcctctcctcctcccctataaaaaccctcacactcatcagcaaccttctctgtactgcgaccaacgacaaacaccacaagctaagtaaggagtaagtagctttgcaagattcagcacaaatgggatcgttgggccctgctgttgtggtgagcgcgagcgcggcgaagatggccggcggcgggcagcagccgtcgacggagagga

SEQ ID NO: 10087 - DNA, 1501 bp, Oryza sativa
cgaagtcatccgggagaatggcatttgagaacacgccatctgggagaatggcaaatagtccaaaaccccttaattaaatggttttagtaaggttagggggttaaatacctggtttgttaggtgaggggttaagtaatcacctggtaataggttcgggggttacgtagatttattccttcttgtttctttaggaattaggacggttgtgtataattcaatgatgcagccatgcaggtattactcagatcaacagctataccagcttaaattttctgatccatgagaacatgtacttagcaatttctggctagtttaacacgagtctgcttcgaataaaattgcaaaatacaactcaatcaagatcaattgcaccgataaggtggcctcggcttcggccacggctgaggaggatgatgggccggtgttaacggcaggctagctaattgggcctagagaccggccagtgtcgtggctgtgatcagaacctttcaaaactcgaacacatgcattcagcattcggaatgttcatcgcatgaattcttacgcggtggtccaaataatcagctcgatctatttcgggcaaacaaagctacagagacttgcttgcagcttaattacttaattccaaataaaaactggccacaccatcaaagattattatttttagtgaaaatcagtccttgtccacctgcctcgttggagacttggaatggatcaaggatcgatcggtcgtcatcaccgagttccttttcttgaataataactacagatgcatatgcatgcatcgaatcaggacttgagaagtaaccaaatgattaggtccctgcttaataaaatagttaagagatgtggacagtataattcatttgttccgacgatatatgtatcgatcaaaatctagcgcgcgcccgtccagtggcgactggcgatgtatatatcctttgatcaattcattgatgcatagtgcaagtgtacgatgtgtgacctctgaattatttgacaacattgggttggtacgtgacaacttgttactaatatactagtatttgagtgttacacgttttgttttgttttgtaacttttgattgcttacgttttttctctcctttcccatttttcgtcttgttggcgacctcgtcacgagttgccgccaagtgagcacgagctttgccctgttgcagaccaggaccccgtcgtcgtgcgctctcgtattctcccgagcacgagcgcgcgcgcagcttggggacacgccacgcccacgcgtgaactagccatctatataacgcaaacgattcgctgcatgcttcgtactcatcatccaccacaacatctcctccaatcagcagcagcagcagcagagctgatcaccatcacttcggagcttgtcagcacaaggctaattattaagctagggctcgatcgatctgatcgtgatctgatctgatctgaccatcagcagccatgtcgtttaggtgtaagggcggcgtcgcttgggttgctc

SEQ ID NO: 10088 - DNA, 1501 bp, Oryza sativa
gaaataaatttactccatccatcccaaaatgtaagtatttttagctatgaatttggacaactgtgtgcagggtcggtcctgggtttttaggccccagggcgaaaacttatatggaggcccccatatatatacataaactaatatatatatttatagtcttataaacacaccacttaatattcgatgtgataaaattatctatatatatttagagtcttcagctgtggctgtgcctgtgcgagaggcaagagctctcaacctagcaggtagcgttgcgtctgcactctgcagcagtagctatgctgtgcagcgatcagcggcatcggccagcggcgtgatgccgtgatccagcctccaggcgagtaggcgacgcaggcagcaggtcggcaggtggcgtgatcgagggccgaggcgatgggaatcgggaacgggagttagatagatcgcttcgacttcgacgcttcgattttccttcgctcggtcgctcctcttcgtgttccgtcttcacacgatacaggcctgcgaagtagcatacatgggggtgccgtgggccatgggccatgggccatgggggcccctggattttgggggcctcgagcgcgcgcacgggctgacaccccctaggggcggccctgactgtgtccagattcatagccaaaagttgttaattatattttaggatggatgtagtatttgttaaaattatatcattagattgagatttaaatttattttcatatggttatcattttgttgctacaaaccttataatgtatgagaaattataagctaaaaattagttttggagaccataccaactttaaccattcattatattatggggtagagggagtaacagatgcatgcatgcaggcatcgaatcaataattgagaagtcaccaattgattaggttcgtgctaaatagaataatgaagacatgtgaacagtagtttatacatatgttaatccgaccatgcaataatgatcaaagtctagcccgtccagcagcgatgaatatatcctttgatcaattcatttgctgcaaccctgcaagtgtacgatgtgaccactacccgtagagagacacgttttgttttggttcgtttccttacttttcttttctctatactttcccatttttttctcttgttggtgacctcgtcacgagttgccgcacgagctttgctgggtcttgcgcttgcagagaccagggaccccgtcgtgcgcacgttcgccacgcgttaactggccatctatataacgcatgcttcctactcatcatcatccaccacaacatctgcaatcagcagcagccagcagcagcagagctcaccatcacttcggagtttgtcagtaccaaggcgaagctaatcattaagctaggggcctagggctcgatcgatctctcgtttcggagctttgtcgatcgtgatcgatctctcgaggccggagggagaccatcagccatggcgtttaggtgtaagggcggcgtcgcttggg

SEQ ID NO: 10089 - DNA, 587 bp, Oryza sativa
tccttctggatcatttttcttcaactgaggttgattgattattgcaaaaatgagcatatgacatactcaacaagccacacagcaaatatgcaagtgtacaaggataccaaaggatggcataatataggctcatttgcaaaagcagcatttagcaaatatttaagaatagtaaaacagtagagtaatcatcaattttaatcaacactgaacagcacacccatgctgctcaggcctaaccattctgaacaaccaaacccgactgcacagatctaactccaaaccaggagctaagcaaattattaccaattatagcatcaataattattgtgagaggtataagactaatcacgaaaaacattgctcaacccgcccatgaccgtgggtacggctattcgaatagttttactctggccagaggtgtaccactgtacccacaagacacagcctcaacatcatgtctaccatgcgtcgcgatactgaaaagtacccgaatagaggctgtgacaataccctctgcacaacacaactcaccacagtgcaccattcctagatcataatcacccactctataaatataaccagaggca

SEQ ID NO: 10090 - DNA, 529 bp, Oryza sativa
cctgcagccctgctcccttcatcctccttttagctttgcttaattgtgccgctatagatctagtcgctatttgtgctttactcttgtttgtgtgatagatctacttgttgtgcttcattggtggatcagacagtctgatcaacatcagactatctgatattttcggatagtctgactgtggatcagactttcgaccttatatcagttttagcttccgcataaagttttaaattagcctctaggccgaattgaccctttcaggtagatgcatatgcgcacgagtgaatttaacatgttgtgcggcaagcaaataatatggctccgatgtggctgggtgaaataatatcatgatatctataaggacccaaggcttggcactagatggtacctaagtgaggacaaaaggatatatatacacaatatgttttttaaaaaataaatctaagtagaatcatagtcacgtaagatgagttatatacacgagtgtaaaatagtaatgtgcatatatttgatatctattagtactaca

SEQ ID NO: 10091 - DNA, 210 bp, Oryza sativa
tcgggcgactcgggcggcggaaccctagccgccgccgccgcccttccccgccccttcctctgccttgccgtcgcctgagcgagcggccggcaaagccggcggctcgcgaggacggcggcggcggggctcgcggtggccatctcccgagctcctggcgcgggtggacgcaaaggcggtggccgaccggagcggcgccggcgtcgaggcgca

SEQ ID NO: 10092 - DNA, 1501 bp, Oryza sativa
ggatgggtgtggggaaggaaacatgatcaactaactattgattagaagaaatatatgctcactgtctatgcacgtactagttactaccacagacaaggtaaatctggatacaaagtatcttgcaacactgtccagatgctgtgcccaccatcttttttttttgcgaatgcgcaaaaggattgcacgtcaatatattagaggaatagagtgtttgttacacaatgcaatcggccagaccggcctacgccagggaaggaagaaaacaaagccaaaaacaaggaagaaaaagaaaaactcaaatagttggattacgacacattcaaatacccattgttgtggttcctatgtttctaagatcagcttaatgttgctatcatgaggctcactttacaaactaagctttaaaaggagatcatagacagcaaaaacgattgtgacaagcacattgcatttcacacttcaaacacaaaacccaaatcatcaatgcatacaaaagacacttaacaactgatgttcaccactaccgaaacaagctatacacaacatgaacaaacctgacataacgccggcaattgatccaagcaacacgctccttccgcttgaggccaagtagcagcttccacccacggggcaggtggtcaccaaacatagaggcatccacgaatttcctccgccgccttcggctcccccactgaccctcaagcccattcatgaaacctaatagctcggattctgcccctaatcccgccgtccgcctccgcatctcctcttcgtagggatccaccagctccgcgagcctcgccagatcgaccgccaccccattcggattcatcacctccatgtcggcgttcgagggaggcggcgtcggcagggagggcgcgggggtcacggcagcggcaatcgcgggcgtgattagggtttgcggctggggttgcggtgcaatctggggcggggatgcgaatgaggggtcctcgcccgcgaagaggcgctggaggtggaacgcgatgaggcggttctcggagtcctcgtcggcgggggcgggggcgggggcggcggcggcggaagcggtggccggggtcaggctgtgggagaggttggtggcgacgcggtggcgggagaaggtctgcttacgggagccggcgctctcattgaagacggcgcgatcgatcttcggtggcgggaggacgtcggcgtcgcggccgcggcgggggtcggcggagtagggcgaccccgccgccagcgccacgagatccgactgggacagcgcccgcatgtccaccatcggggccacctccgtccccatggcggcggacggcggcgtcggcggcggcgcgcggcgcgcgggggatttgggggcggggcgcgtgggagaggaacagatttacagatggattcagagggaggagacgagagagagagaggggaggggagtgtgatgtggtgtgctctacgctaacgccgaacgctactaggctttcagatccaacggttactgtcgctt

SEQ ID NO: 10093 - DNA, 1094 bp, Oryza sativa
gttcttgagttctttcctggcttcgcatcacgatcagaatacaaaacttattgagtttggcatgcatgaaatctgtaatatttccatcaatgaagaacgcaataccttaagctttctaatttacctttgtttgcatcaaaaaatttcttttcagtgtaccatctctccttgagtcacgcttaattttttatttgctcctcatacgagttgtttggttaatttaggctcatgcccatttccaagtctctttcagcataatcctcatttagatctttcgttcccctaatttaaatgtatgtgcagggtttagggtcctatgattttacaaaaaaacataaataaataaatttgaagtataatatcattaccatatattacggcttagatatatagcactttatagctacacttcttgtgaaattaatgatgtcgtacacacacttatttacattgtaattatcattataaattcaaacttattactataaataacatgttaatatatctaaaagagaagaaggttatagtcgtacacacacagtcacacagacttgatggcgatgctggctctgccaccggccggtcacacccggcacacgggatgcaatgcaagacaaggtgatctgatccgctggttcgtacgtccatggtttttgcacgcatgaccgtgtgctagtgctagccgcttccagcaagtctcgtatgttgtttaaagcatctgactaagtatctctgacatgttaattataagtaatcgcaacataccaaacgggtctagatcacagccactctgcaatataatgttctatcctaatcatcatttgattcagaccccgtatcgatggatcgcaggctgctcagagccgcacgcggcggccaccgcgagtggctggaggctgtacttctgggggccgctccggcgccaaaccacgtcaccgtccacgtcgccgcggccggggagccacagccacccaccgcggcggcgctgctcctggacgtggcgcgacgccgcagggagactccgcgctgcacgtcgtggcggcctccggcgacagcgaagcgttctgagctgcgcgcgcaccatctaccgcagc

SEQ ID NO: 10094 - DNA, 365 bp, Oryza sativa
aggctaaccacacaaaagaattgcaaagaggccaaagctcaagttttccaaacttccttccacggctcaaattacatgcccctgatgagtttttttttttgtgtgtgtgctctcattgctgatatcatcatggcaaaaagtgatgtcatacctaaactgcacctcaacaacaaatgacaccaactcatcaccaaaatcagtggcctccatgagattatagctcaactaaccaatcacaaactatcatcaattattgagttattctgctctccaaaccaacaaccgtacaacctaagattccaaattcctaataaatttggaagaaaaagactgaatatgcttttccaaaaaaatacaaaacatat

SEQ ID NO: 10095 - DNA, 1117 bp, Oryza sativa
ttaaattcgttcgcttttagaaatacagatccgtatttgagttgagttttaactttattcgtttttgaaaatacagaaaggctcatataagaaatctctttaaaaaaactcgcatgctaacttgtcataattttctagaaaatatatatccaagcgaattctcacaataaattttacattgaacaataataagattaaaatagccttcactcgttgcaacgcacagacattttttctagtctttgaaatatgtttgattattcattttctaaaaatatttatataaatagacaaatatattaagtatgtttaaagtagctttggttatagctcaagttgcactcttttcactagctaagtaattgtgttgatcaaagtttgataaaataaaattcaaacacaccctatattaaaaaagcagaggtattgtattgccaatatacattaatctatattgccgatggtcttatttttagtacaaatattcaccatacaacaccgccacaatctatattgacttctgttgcgaaatgacggcggtgttgctcccatgttttcccagcctcactttgatttttcccatagtccacacaactcatcaccgtctttcactggtaacaccaaaggcaacaaacaaaaaccacaatttacatgggtataaggtcattatttagcatttgttggctagcttgttgctacactcatgcccttatataggtgtgtttggcaacattttggataattttttgttggtttgtttgttcataataaaggttatggtaaataaaaataaggttgcatatctagcccctagatttcaattaccagaaaagttgcttcgttataggggtgaaagtgaatcggataatatctaatccactccactccaaatccgtccgaagtgaggatatagtaagggtttatagatattcggcggatacgaatttggctatggatacggagctagacgtggtgttggcgatatcctgcagatctggtggagggtttggtagataacccgactttctcatctcatggaaccactctatttgacccatttcacataagacagaccatctattagttgacctaataacctatctctctcacacacagg

SEQ ID NO: 10096 - DNA, 1501 bp, Oryza sativa
tcatattccaagctttggaccaccggaggcaagtagcagctgggagagaaaacaggtccactcagagacgatggatgtagaaagcgaataaattcagtggaagatcgatatgtgtacaattaatagctagatagatcaagcattagctctatttgttagctgttggtcgaatttaattaaacttggaaaattgcattacttaattcctcgtttaatttcctcagtgtattttctcaaggatcataaaattttctctttatatgtgctttctgatttgtttcaatatagcattccacacaatttatatattccatggatgatacccgaaaaaagagaaggggacttaattaattaaccttatatatttcacgtgtctcttaaagtttatgagtggcagctagcacaactaatctcttaaatattcttgctgccttcactttctccccttaattactccaaaatccaaatcaatgatggagatttgtttgtgtgagagagagaaagagaagaggaccacttcaacctctactgctccatatattttctttctgtcagcccatacttttctgaatatttactctccatctctctctcacaaaaggagcaataagctagcacaactaaacctgcaatctgctgatcgaaaaagaaaataaagaaaaactgggtttaatttcttcattgcagaggtaggaaggaggagatcaatcaaacctagtactaccagtatatgcaacctaactagctagctagagctagctagaaagatagattgaatttaatttgttggtgggagcatgcacgcatgaagatcgatatatgatgttgatgcatatcaataatcttccatccatccatattcaatacactatacaccgtacatgtatgtatatagttagtcacattagtttatatatagcctcatatatttttaagcaagcagatatatatagaatcagtccaactccatggaggggcagagacaaaaaaaaagttactacaccaagaattgaattaattatgtatatatattgccaatctatatatattaattaattaattcctagccacccatgcacccaacatgtataggtatatccagtactatctagctagcttaatatttcttgttgttgcatgtgtctaactagctagctagcttgcacttgcacatgcatataattaattagttgcatgaaatcttgacatctgcaggttgtagctatatcagttagcaacaattaagcaggtgttgtagctgacttttctgagtgacaatcaaactagctagcacacatttcatcactttcacatatatactatactagactagagctatatacagtagtagtaccatggtttaattatttgtagccttatagagagagagaagagaagaagagagagagatcagtgtgaggcaccgacgaagacgaagacgaagacgacgacgacgacaagcacacaacaaatttgcacacacgcgcgcgagcatcgatga

SEQ ID NO: 10097 - DNA, 1501 bp, Oryza sativa
cccatggatgaaatgagaaaacgtgacaaacttaagttaactgttaaacatagttattccattggaggccagaagaaaatccctctttaagttaattatcatcatttatacaaaaaggaggatggaacatttgggaatacataataaactgataaacatagatgcattactttcatgctatttgttttggattaagtttatcctgaataaaaaaaaaagttgaactgaagcatggcatgttacccaattggtcgacatcttaaccctaaaagtctataattatgggaccatgtctctttgcatttattaacagtaagtgtgtacgtcatcttagtatggatctgttaagcttccattttcattgaattttccatttacttactacttccactatcaaagtcctccaaaaggaaagaatgagaaaaatgtgaccttatggaatgtcaccttgggactaacaaggcccagatagactcctagtacctggactaacaagtcaggcatagattgaacacgctctcctagaactcctcatgcaaaattagtgctcagcgaataactagtaaagcaaatttacgagttgaaatgcaaaacacaataaaatgcccaaattggaaattcacctggaggaatgccgtgcctcggcatgttcatttctttgcctggctgcttgcaaaggattgactaccaaataagtcaatcgtcaacttagctgcatgtgggctatgcaatcatgtccttggagatgctgatcatacttccactgcccttcttactatgcttacgtcgaacccaacccccccccccccaccaccaccacaaccgtatgtcctgtttgaaatacgaaatgttcttccattattgtatatactttataacttgacataatcacatcactaggcctcccttctgttctcacatgtaaacgggtttctttcaagtattttgaatttttttgatggaataagccttgtggtctttggtccttgtggtccttctcttgcttttaggttgtttttcccccttttaggacagcatcctttcagttttgcttttagcatctttcggttttgcttttagcatccctaggacagcatctagcatctcctttatgctttattcagtttggatgctctctaggacagcattgcgttcaaattttagactagtgtgggcagcaattagctagcagccatccagccagctatggctatatatatgtatccaacctccctcgggaaggtatggcttttgtgttttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcagcagcagcaccggttgctcctccttcccctttcccttccccttctccacgcagcagccccccggaggtgagcca

SEQ ID NO: 10098 - DNA, 1501 bp, Oryza sativa
tccgccgcagagcaccgggagaccggtgcgtgcgaggacgcgtgacgcgggactccgggcaccctccttcctccccttcctcggcccgaggccggagagctcgctcccgagccgtcggccgctcgtcactgcgcccgtctcggcttggtaatgccaccctccgttctcccttcttgctcgtcctctccctccctagctcgcgtggtagctcggctagccccccgaacacgcatggacactgccccaggtctcgccgccgaaccgccgctcgtcgcccttgcaccgcgcgctagctcgccggccgccatgctctgtcccggaggccgtctctcgtcgccagccaacctcggtgccgctccgtccaatccgacgccgggaatggattccttgaaccccggagatgctcccatccctttgaatcgaaccctcgtcgtctcgtcgtgttttccccttttttgctctccggtgattgccgccgccgcaatccgccatcgtcggcttctctcgcgtcgattcctctcgccgccacgcccccggggatccctttgacctccccctggctgccccaaggccgtcggccttctcctttgtctccgcgccgtgtcgccgcttccgccgctgcataacgccgccgtgcgtgcgccgccggtgaccatcgggtcccgcgtcaccgcgtgcgcgtcgcaacaccataccggttcggctaaacccaagcccgcgcacccttcgctctcctcgcgcgcggccacgtcggcatgccggcgagattggccgccgccgccggccgtcgtcgcgcgtcctcttcctgatccgagccgtggaatgagttccccttctcctcctcctgccgccagtgctagctgccccttccggctcgccgccgttcgccggatcccgccgcacgccgtgagccgtcggatcaacctgcccggcctcctctgcctccccatccgacgtgacttccacgtggacgccacctcagtcccgggcccgcttgattgggtcaagtcgcgcccagtcagcctcctccctccgtcttccctcccgtgcgcgcggtccacggcaagccgtgcggctgcacgtgggcccgccgccatccgtccacccggcgcgccgcgcctgaaccgcgtgcatccgaaaccctagcgcccacctccgcgtgcaccctccccaccgtgaacccaaccactgccatgtgggtcccgcgcggtggaccgcgcccaccccgacgggccaccctctctccccgcgcgccccttgggccgccctcctcgcggccgtgccggcccattaggctcgcccgagctgcgcaagtccctcgggccgcgccaatgccacccgagacaagtctgattgacatccctccatccttttctttttccagggatttaataaatcctttttcctttgtcccataaatcaattccttattccaaaattccacaaatcatttcctttggtcccgcgcgtcagtgactgtcaataatattcttgagaatat

SEQ ID NO: 10099 - DNA, 1501 bp, Oryza sativa
ttccatttgattaatcggctcccagagcctttttcattttcttggactcccagagtccagctgcccagcagcacaacaatccgcttccacttgggaagcctagtctatgatgcccgcagacatcccgaatcacacagattcgtttctgaccacttaggtcgtccatctgccacataggctgattctggttacgattcccacaccacaacaacttttcacaaagcacaggcaaacaaatctacgcaacgggaaccacctcacatccgcccatgaccgtgggcacggctgctcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgtgcacaaatcaaactccaaccaccttgatcggtaagtgagcaagcttctcgtccttgccttaccaggaacccggtttgtccgaccccgccccggcgttcccaactattggcatgcgaggtttccctgaaccgtctagttacttagccagggtgtcccattccaccttgtggttgcactttggttatgttcggtgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgtcaaggaatcagggtagtatgacctacggaaattagtgcgactactgggtaggtccgtcgatttggcatgcaacccgaggccaagcaagttaagtgtgtgattctaaaaatgcaagttgcaaacaaaataataatgatttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattattagtgccattgaaaagatctcaattttacggaattactggaagtggaacggagtcaatcggatgagcggttgagaagacatgaattttggaagtttaattggagtttctggaataggagaaatggtttatggaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatggaggga

SEQ ID NO: 10100 - DNA, 1501 bp, Oryza sativa
agctggttgagcatgaagtgtactagatttgtttgattcagctggttccgagctaagccagataactacttgccaaatagagtatatataactatctgattgatactctcaatgcctgtataaacatgagtatttaatttggtcattagcatccagctttgcttgcatctactctaagactttgcaaccgatatatgcgacaaaattatcagttgaccgacttaatctcttcagctcatttatttatttatttctcctactctgcagcataatcggagttgattatctaattgggtagctgctgggcattcatagtatgattagctcaagtacatcactacatctgcaaatggtaattgtctaagcaatagtgcccatggcatcattgcattacaataataaccagtttgatttgttcaagcaagaagaaattggtgtgtgtaagcatgtgaatttgcattacccatggtttaattcgatttatatttacctcctgcagcaggaccgacgaccggccggttcttaaccttttctgaagaagaacagttctgttaacgtcaacagattcagcaactctgtagatgaaatggtaaaggtgattacaagtgctttaattaattaattaattttttttactggcgtcaagtttcgagtggactgtatctcactctttttcttacctgctcgatcgtagttatttaattagtcactcatggggcctcatggtttcacattaatctgatcctcaactgtaatataccaatatatactacacttatcaaaggagtgatcaaagcatgacacagtgagcaaaaaaaaaaagcatgacacagtgatcagacataaaccttggatcagcatgcgcaactaagctactggttcaaagatcaatacacggtggattgaagaatcattctttcaacctctctcacttgtaattattttggatatgtaaagttaatgtacatggattattagtatctaaagctgtgaaatagttgtacgtacgtacgtacgtacgtgcagtaacagaatttagactgatgcaattgatttcacaaaccatgggagatggtgacgtgcacgacagcttgatttcttgatctgattatataattagggtagtctaatcacgctcccacatgtatctaatctatactacgtagtactatctaacacgcggagactaaggaacatttcctccccgttgaccacaaacgaacacaagatccatgcatccgggccgttggatcgtatgaatcaacggctaagattatccacgcgccaagcacgaaaagtcagcgcatgtacgacgggcaatgagaaaagtcataggccgttgatccctgatcggacggtccaggatcaacctggaaagatcccacgcctagtcaccatctatatatacgtggagactggagagagattagctttgtgattagtaagcaacttaacacaagatagtcctagttctagctagataggtttgaagagctagcca

SEQ ID NO: 10101 - DNA, 1501 bp, Oryza sativa
tcaaatctgtaaatctaggttatttccgaggatttgaaagccttacgctagatacaaattttgcttgattttgtctactctattaggaaacttttggctttggcgatcaaataggtaaaaatgggactccactatttaggttcaatttccaattaatgctatgagggggaatgtcttgtcataactatttatcctctggatgcccaaacttgtaaattttggttagtatgtagctaactccttgaatagctagttcctatgcactcttgttttctatgacccgtctatatttccaatttccaaacaaagtatacacaacagaattcaccaggggtatttagagtagctgtgaaaattaaagccagaaacttgtcgcgctgggtcctactatccggcggtgattaatgcgtattgtgcttggaaggagccctggaggaccaacaagctccgggtgggtggaatcagaaccctttggcacgggcaaggcagctgtgaattgtatcttcaggctgcattttcccatgctaagtgatgagacaaataatattagtattaactgcagttactcaggatcacttctatagttttatggagtttagtctgatgttgggcttaggaagacagctcctgtctgatatgaatcttttggtctttattaaatctgagacacaaaagtagactttcctatgactagaagtattaatctttgatcttgggctccagctatgtgttatttaatgataagaactaaatattcgtggtctgcatattatatctaagaatgcaactctttagttcttagtctaattataatttctggtgcacatagtacatggctgctagcatcttctttgcctttgttatttatattcctctgttctccatatatgttattgaaatttgtagttgacaatagggttaagataccactgtctcttcctgaaaaattccgaaaaccaaaagcatatcaaactttaattttgaaaaaaatgttccattttttttcaacatggtttggcttgactttgcgttcaggttcaacaagtaatgtatcaccctcatcttaggcctgtcagcaaacatatgttgtacttgatggcctttattccccgtgtatattcctttgactgctaagaatcaccttgtatgctctcctgctttactccagcatctgcattttgtaccttcatatattagttcagtagtcagtacctcactttgttatttccttaatacaggagaagatccatatgagtttgttgtgctatgaaaaggggcaaaaactgcgcagcaagaaattatgggcaaaattaacaatagaagaaacagtatattctttcagtcctgactcctgagttgatttaggtattccatcttgaattcattactgcctgaatagcttcttcattaaaataaaatctatcattgaggtatcttttgattctgaatctttgatttgtataggaacatcacatatagtgagaaggtggcacattttcca

SEQ ID NO: 10102 - DNA, 1501 bp, Oryza sativa
accgagaaagccaatgtctgctacctttatttattttcctttttttctttctccctttcctttccctccatgtgcttttgtttgccgtctctctctctctctctcttctcatcactggaattgtcacactaatgtctcattttacctgtaactttatgatcagataatgtttatggaagagctaaagaaaatggctacaaattaaagtgggtgagaagattgaaaaatcttcagagcatgcatttgggcagttataataatgcctgaatcagttcatgcagtagatcaaagcaagtggttaccggttgtaactgccgatgtctgatatttcaacgaacatttttgttttaccaacatatcatagcaattggaatctactagcggtagtcggagaagaagatttggtcacttgttgatctgaaaaaacaatggctcaaaggatataccaccgcgctttcgcattcctcttttcaattggaagctgctcgtctctcggttcattctttatggtacgagtatgaagcgatatcagatcagactggaggatttttcacaatttctttttactctttttgataagaaagatagtaacattgttcaagcatgatgtgtgttgggtttgtgcccatgctcatcttcactagcaggatgatactgatgacgatgcactaccaatgcaacgtgaagaggagttagtacatacaacaactacaagtgagatgatcactgatcagatgtggtggatcaaattatcagacagacagctttcacactaggtgagcactccactgcctgcctccggccctatccgagctgcttttcattctttggatttgattggtgccgccttttttcgctattgaatcgcactgcgagatgcaccatgatacgaatcaagtcaaatttctggcccaaacaaagacattgccacgctaaccgaactgttcaaacgatggtatcttttttattgatgcctctctaaactccacttatgagagctgagtacttgcaatccctaatttaagagcgctgagagcttgatatttcagatctttaaaaaaaaggtgcctgatatttctccattaccttccatgatctccaccatcagcttcgtgacaaaagaaacattcgcagaagtggtcaaaatatactggaaatattgtatatgattatcttgtttgcaaacaaaaaaaaatactgtcacattttgcattgccgacttgcttctgaatgtcccattgaataaatggccttttagataatgactgttgaataaatgtgtgatcatgcatgatatagtgcagtacccttttttttgtgtatgttttggaggtgggggctaaaacagtcagtgtgtatatcctgtatctgtcacacctctttttttttaagaaaaagaaaaaaaagtgccatcaagtaaaatgtctataaatagtccattacaagaacaatgctgcggcgatataggtggaagaggtactgatcatctgaaacaccataa

SEQ ID NO: 10103 - DNA, 318 bp, Oryza sativa
gtgggaatctatacccagtccaattagacaatttcctgccatggctaacaaagctcctttcaaccatatagaaacctgtaaaggcattggtatttggtaagagtgttaacttgcaaggggtgattggttgggagaggtttagaagcatagcataaaagccactatccatgtctcttagcttctttcaataggtaggcttgaacttctcaaaaagttgtatggagatatttggctggacactattgaattgtcactctgaattgcattgatttgattgtatcattattttgaattggttctttcatatcctatttcagg

SEQ ID NO: 10104 - DNA, 156 bp, Oryza sativa
gccgccgccaccgcccccacggcgaacggcggcaccacatcgccgccaccggactgggcaaagaacccgagttatcagcaggcattggcagatagaggattgatacactgatacagagggagctagctagcgaagcttacgctgctgccgccgcca

SEQ ID NO: 10105 - DNA, 464 bp, Oryza sativa
aaaaatattcagacactcccgggctctggcggagggacgaccaatgtcaacgcgctgcgctaatcacgcgcggtcagacgttgactaccatgaaaatgccacgccagctgacacgtcacccacaggcaagtaggcccactggactttatcagtgggccgagatatgggccttcgtcgaccgacagagatagtgggccaagaaaaagtaagtagccagagttatgggcttaatggaattatgggccgtgtaggcgatgaggcccactagagcccacaaaaagcccaagaggaaggccccgtgtccccgtctcgtcttccccttccttcctctcgttccccttcgctttgccctcgtgcgacccaaccaatcaggcggcgctaatcctcgccgccgccgccgccgcctgccatggccgcccgccgcggcccgcacgtaatcaagctgcacgactccgccccggcgc

SEQ ID NO: 10106 - DNA, 1501 bp, Oryza sativa
  unsure (1)..(1501): unsure at all n locations
cacatttaaagtattaaacgtagactaataactccccgcaaaaaaagtagactaataacaaaaacaaattacagattccacctgtaaactgtgagatgaatttattaagactaattaatccgccattagcaaatatttactataggatcacattgtcaagtcatggcgtaattaggctcaaaagatttatctcgtaatttacatacaaattgtgcaattggtttttttcccatatttaatgccccatgcatatgtccaaacatttgatatgacgtttttggccaaaaatttttgggatctaaacaagacctaagttatgatgataaacaaattattttttattcagtcatgatattatttatagatccaaaaagcagaattagtaattagaggtaccatacaggcaatatcacatcaggaggtgcatcaacagctgggccttgatcggccggaggtggcacaagttcgacaaccccattaggtgcggcatagaaaacggttttaactcctgcgtcagcatctaccgctcctgcatcaccaactaccgcagctaaactacgctcaggctcctcctcgagcctggtgagatagaaaaatggaagcaagttaaacgatgcacaaactacaacgaactcgcccacaatcgcaacatcaacaacattcaaatcgccaaaggattgagaatggattcacttacttggctacgagttcttgccatgtacactccatattcgccatcctcacccaagtgggatgcagtgcgacggcggcgcctacatgcggtgtgccgacggtgagctccttccgcaacgagctgtctccatgaccaaattgatttcttcgctgatgagcaaacatgctggagagtggaggaagagagagacagccaagcaccccctctggatctcgatcccctttctatgtaactgcagggcaatttcgtctggtcacttggcagagaagcgaaattcctatcgaaaatgcataaaatggtgaaaatggtaaagcggcgagtgtcacgcgcttcatcttggcattttaacgaatcgtttttaagatggcattccggtaaaatcacgttttaaacgtagccacttgtccattttccccgtgctttgcggtcgagagatgcaaagtggacattttcctatttccattagcccaccgttgtaaatccgctccaattgactctaccaacccacccgtgctctctcctgccgtgctcgtcgacagcaatcagaactcggaagccgaccgggaagtcgccgcgccgccatcgtgctcgccgccggtcgccgtctcggaggaggtaaagatcccgccgccgccctccctcccctccgggtggtcggcgccgtgctccactaccccggccggcgcaggtcncntnaccacccnnnggccccccacccccccccctcctccaaaacccccaacactatccctctccccgccgtgctccacacttccggccgcgttgcttcccacatccaccgccctc

SEQ ID NO: 10107 - DNA, 1501 bp, Oryza sativa
agtgacataaatttataaaatcttaaaaatagatattaattaatatatactgtatgtacaacatacactatttttgtgagcaacatataaagcaaaaactagtccataggaaattgctttattatttttgaaatattggattttgcttggaatacatttatttttcaattggtccagtttatttaggtttaacatgcaaaaatgtgaaaacaaaaaataaatcatgaattttgaggaaaaaaataaaactgagaattataaagtcaaatggtggttgtcttcctcagaaaaataacagtgacatggctgttccatatggtggttgtgttgatgtgttctcccaagaaacaaccaccatttggcactataaattaatattgaaaaatctgtttggagaggcctcttgattttgccttaactagcgacgtctaaacacggataaacgtggagaagtccagctactacatggtactacatgcatgctttttttttactatacatgtacgtcattttcctcttctaacaaagttttctctcaaattacttatccgatctataatccgattacaccactgtgttcgttacaattaaatcttcacaacaagatcttacatgattagattacgatgaaaaaatatttatatttgtaaattacttttattatatatgtaagttacttttatcatatatataagttacttttagagttggctaaattacttcttagacatataaaagtaaatttaacagagtctaaaagtagggataaaaatatgactttatctagaaattaaatttaatcagcactgatcaacacacataagtttaacaatttttaaaagtaacttcaatgttaattggaagtaacttttgcatggttcaaaagtaattatctataaatctgtttaatcatcgattgtttttttcctttcatttttgtttttcatgtagaatgagaaaagaagatactattgtatttttcaagttgaaaggagatactagatggagtacaaactagctaccactaactgtgtagtcacatccaattaaaaaagacattcattaaagttattttctttttgttataagttacttctataatatatgtaaattacttttaggcttcattgaatttacttttacatgtgtaagaagtaatttagtgaaatctaaaagtaatttagatatattataaaagtaatttataatttttcatcaaaatataatcatgtgagatcttgttataaagatttaattgctacaaacacaacggtgcaatcggatcatagatatgattagtagtttaagagaaaattgtatttaaattatatgtggataatatctctcatagatgaagtggtagctggtttagacaaactagctgtggagtcacgtccaattaatatacagtggtttctccttgtatgtcaagtttcccattgcatatactgctccttccaataagaaattaggtaaatccctggaggataagtatccactt

SEQ ID NO: 10108 - DNA, 258 bp, Oryza sativa
ttctaaaaagaggagcagaagcgtcacgctacaaccgccccctcagccccaagagatgtccccagcaaggtcttcgccgcccatcaattatggcggcgaagatcatcgggtcgtcgtgctccaagcggacgagcgtcgagagcaatggttaaattacatgaacaactagctagacatccgcttcctcctcgggatcacaccaccgccgatcagatcaaattctgtagatgccgctcaattgattggtcgatagcataa

SEQ ID NO: 10109 - DNA, 564 bp, Oryza sativa
ccccccacccgcagctcctccccctgctgccgccgccttgtgggcaccgtccgtctcgctttcgacgccagcgtcaccgccatcaccgctgtcgcgtcgccacctcgcactgccgaccttgctgagaagagagagagagagatgaggaagggagagaagaagggaaaagagagaggaagctggcgtggccacgctaacatgtggggcccatgtgggtcccacgctgacttagccgccacgtcggacaaaaccagggtcaaaaccaccgaagaacctaaagtgaacggttttgttagttgagggacgcctgatatctggttttttgcgattgtgggacgattttgtaactcgatgacaagttgagggaccttcggtgtactttttcctaaaatttaccccatacgttccaaaatactactgtaaatatatttaggttatttagcaaaaataatattaatattaatatatgaattttatattgcttaggacctttcccagcttttgattggttgaaaatgttttgctttctatggttggaatgtgccccggaaatatttatattat

SEQ ID NO: 10110 - DNA, 1437 bp, Oryza sativa
atcaattaccggtagccaattcggatttaattactaagaagatagccgaatattatatttaattatagaccaagttaagtcgtccaatattctaggatttcgttccgacgattagctcacaatagaaatttctaacctattaattgttacgattgctcgggtaggttagattaaaaacttatgaccacaaaatatttatacccgcaaaatagtttaaatcgaaattgggtttgccgtagttcgcagatagtaaagctaataaaaaggaatcgactttcgcattcgacttttactcggatttaagtgaaacttgaacctaaattcatctaacttcataagctttacaatgatatataattcactatttaacaagatataattatgattataacttaactaatatcaaataattagatgatagttaacctaaatagtgtgccaatgaataaaaaaaatggatattgtacagtagcgtaattatctttaacacgtcttgtcgctgtagcaactaaataaattagttataatcaatccttcaaattaatgggtgtataggaaaatattagtgccatttactagtctgtgtccaaatataactaaatccatgacttataaattatttacataaagtttagcctcatattttgtaactaaaatataaacacacttagatgaaccttcaacttgtctgaggagaataataacttagctagttgtaagtggaccacttaaagttagttggaataatgtcatatgaagtggaatatatatagttcggttgacatccattagttaacaaaacagagccatcttaatcacatatatcgtatagcttctagtaaatagcaactattcagtaaatgatccaatgattaaatattgttgcacccacatacattgtacatcccaatttagatgtatggtatatcaaaaacctacccttttgggtatagtaagctaatgagtctatgacaaacatctatagtggataaaatactaattatagatcttgacctaatataattgtaaattaggattattcattgaaaaattatgtgatgaaatagccgtaaccataatatgattgacctagacaattctaacatacaaagcaagggtaattgttaacctttataatttattttgacaagtaaaatatgtacataattaaaataaagcctccaccaataaaataataatacaaatgattcacagtaattatttgaccaatccaaatccatccggcaacagaacctctagtgtataaccgttctatttagatagatgcatgaataaccatttgctagactaaaccacatagtagccagatacgtatctcattcatactacgttggttagctcctatatagaccaccatgacaacagaaagattaagaaaccttaacccctagcgtgattggaatccattggtagaca

SEQ ID NO: 10111 - DNA, 1501 bp, Oryza sativa
aaaaagtggatacttatcctccagggatttacctaatttcttattggaaggagcagtatatgcaatgggaaacttgacatacaaggagaaaccactgtatattaattggacgtgactccacagctagtttgtctaaaccagctaccacttcatctatgagagatattatccacatataatttaaatacaattttctcttaaactactaatcatatctatgatccgattgcaccgttgtgtttgtagcaattaaatctttataacaagatctcacatgattatattttgatgaaaaattataaattacttttataatatatctaaattacttttagatttcactaaattacttcttacacatgtaaaagtaaattcaatgaagcctaaaagtaatttacatatattatagaagtaacttataacaaaaagaaaataactttaatgaatgtcttttttaattggatgtgactacacagttagtggtagctagtttgtactccatctagtatctcctttcaacttgaaaaatacaatagtatcttcttttctcattctacatgaaaaacaaaaatgaaaggaaaaaaacaatcgatgattaaacagatttatagataattacttttgaaccatgcaaaagttacttccaattaacattgaagttacttttaaaaattgttaaacttatgtgtgttgatcagtgctgattaaatttaatttctagataaagtcatatttttatccctacttttagactctgttaaatttacttttatatgtctaagaagtaatttagccaactctaaaagtaacttatatatatgataaaagtaacttacatatataataaaagtaatttacaaatataaatattttttcatcgtaatctaatcatgtaagatcttgttgtgaagatttaattgtaacgaacacagtggtgtaatcggattatagatcggataagtaatttgagagaaaactttgttagaagaggaaaatgacgtacatgtatagtaaaaaaaaagcatgcatgtagtaccatgtagtagctggacttctccacgtttatccgtgtttagacgtcgctagttaaggcaaaatcaagaggcctctccaaacagatttttcaatattaatttatagtgccaaatggtggttgtttcttgggagaacacatcaacacaaccaccatatggaacagccatgtcactgttatttttctgaggaagacaaccaccatttgactttataattctcagttttatttttttcctcaaaattcatgatttattttttgttttcacatttttgcatgttaaacctaaataaactggaccaattgaaaaataaatgtattccaagcaaaatccaatatttcaaaaataataaagcaatttcctatggactagtttttgctttatatgttgctcacaaaaatagtgtatgttgtacatacagtatatattaattaatatctatttttaagattttataaatttatgtc

SEQ ID NO: 10112 - DNA, 1501 bp, Oryza sativa
ataaccgccatatagatatggggtatccataatctctacaacaattttttcaagattcttatcgaatagactattcaatataagtggaggaaaaaaaattatttctttcctgtgtctttaagttgatgcttttattctaatatgtaacctttcaaaagttttgacaatttgtaaattttgtaggactttggcccccaattcgagaaagcgatagatgaagattatgtacgggcacgcaaaacaagaaagccattaataaatgattagttaagttttaatttttttaaacttgaaaaattgatttatctaatattttaaaacaagttctatatagaaagttttatcatgaaatgtaccatttggcaattcatttaaaaagcatgttaatgaaaattgagttaaaaattgtatcttaatgtggagattatgcgtaccacatacccacacggcatgattatccgactagttataggggataacttatatctatggaatatgtaacggatcatgacttgggtattatgttttcctgtatattatggagcggcctaaagttctggtttgataagattgtaaagtagatttaggaaaccgataccatattggttaaggtttctatcttgtaatcctgccccccatcctatataaagtgggcaggaggccctctagggggcatgagacaactagatcgtcagatctataattcactcggcggattcaaatccccaaacaggagtagggtattacctctcattgagagggcctgaacctgtctaaatccttgtctccgcattcatccacttttaggtctcgtgcgctacccccttttcatattgcctaaaatttgtttcgacagttggcgcgccaggtaggggtgcgtcgagtttcccgtcgaaaagtgtgatggaatcaatttttccgtgtcgtcgatgttgccgagcaacaatatcagcctcctcccagtgcaaatccgagcccacacggtgcgagttcggatccacgcctacaccgggaaccactcagcgaccacgtgacatgctgaagctcataggcctggatcggtcactggcttgctgctacctgcaactcagtacacaggagatttggccatgctgcatgccgagtgagaaagcacacgcgtgcacgttgccttttgcatgtcacctgttgattgttctcgccgggattcgtgccgaacattggcctgagtgcacatctcttgaccgtttcgtaattttccatatttagattgatttctaatctcaaattaatctcttgctattttttttttgttgttgttcgcatataattacgcggcactattgaggcgatcaatgctggtcatggactcgaggcgtctcagcttttcggtcgatcggccgtgagtctactccgccggcttgtcctcaccaccgccattgctgatagcaacaacgacttcaccgccggcctgcctccatcgccgccgactggtgtccttgcctatacgtttggttggtca

SEQ ID NO: 10113 - DNA, 1501 bp, Oryza sativa
actttagataaaattgagaaacaacaagaactgtagcaatccgaaaacgatgttgacgctcccctgtgcgcgcgatgcctcatctgcccacttacgtcacaccaccctcatccgttcccgcttgtaggcttcgctttatcgcacgacggtggtatgaaaatccccacataacagtttttatcatttttatgaattaagactttgagatcctcattgccatcggtctctgcagctgttcttaaaatgttaaaggcatggacagcatggtgcaagaatagaaagaaatcaagaatttggttatatgttctatgaaggtcctgttattttctgattaagcgtcgaaacaaattttcggcaatatgaaaagggggtagcgcacgagacctaaaagtggatggatgcggagacaaagatttagacaggttcaggccctctcaatgagaggtaataccctactcctgtttggggatttgaatctgccgagtgaattatagatctgacgatctagttgtctcatgccccctagagggcctcctgcccaccttatataggatggggggcaggattacaagatagaaaccttaaccaatatggtatcggtttcctaaatctactttacaatcttatcaaaccagaactttaggccgttccataatatacagggaaacataatacccaagtcatgatccgttacatattccatagatataagttatcccctataactagtcggataatcatgccgtgtgggtatgtggtacccataatctccacagtagcccctgagaccttcacagtcgaaaagataatcttctctcgaaccagattactccaaagccaagtacttcaatcatctttgccatgatctcccgagaacttttaccaaatctaaagactgtggagggctgaaaaataaagttggtgcatcgactagatgcaccttataggtgtagcccccgactatgtggttagcttgaacaaactaagcatatagtcaaggaataaataatccaaccaacagagtggtcttgataattgtaatcaaccaagtgacttgatatcaatgtatagcatatgcggtgtaaatcctagaataatatgattcaagtgatataccgtctgctttgtaaaatatgatgcgtgcaacctaaagttgactacatcattgaaaattcacacgcaaaacagctataaagaagcttttatgttgtgaataaagaaatttccaaagtattgggcatacaccatgcgcacactgctttaacagatgtgcttaagtctctaaaagacacatggtttcaccacacctggaaatatacggtatatgtggtgtaaaatccgagtaaataaactcataaaggatttaccaactgcctggaaaatgaccaagatatataattagcctaagccataatattggtcaataaaaatgcacacttacgtggcaaaaagcaacgatattgtatccaatcaattgcttaaaaatccaaacaacaccttg

SEQ ID NO: 10114 - DNA, 1501 bp, Oryza sativa
tcccgactagcacaagtattcggttgataacccttacggggaataataaatagtccagtcttcgagcatagaaaataatctcagaacaaaatccaacttgaaggtatgatccttgtgtttgagttgataagcccctgagcatataacttatccttctattgtagtcacatttgtccattgatagtaactgacgcagtcggcatggagacgaaatgaccaacatgaagatgatatcacccatcaaagcagtcggcggcggcggaggcaggccggcaataaagacgtagacgcgcatcaacagcgatgatgaaatccactaatcatgaggatgaagaaaatagtcggcgacagcaaacgcaaccgacatgatgaagatgacgatgtcaatgatccagtcaatagtagtattgcggccgatgataatgacgaagacactcatcagtgtttgcatagtaggtcaaccatgacggtgaaataacaagctggcaatgacgaaagcaactggaggcgaagacgtagtcactcattagcaacggcagagatgtcagggccgatgaagtagaggtgctggtgatgatgtcagtgacaataatccatcaaactgttgagaagatatcaaagcttgagtagtttccttgatgcgagtgtgtgcataaagaagattgatgcaacgctccttgatttatgaagatggcagtagaacttggtattatagctgttgcagatgcttcatttggaggaaaataaatgatgttgtccaactcgttgaatctgagttaattggttgataactccaaactcccgaacatgtagattaaatcttgaacttgatacttgagaattttggagtagattgtggcggcgtggagaagccaaaattgccggtgtaataattagagtcgctgaaattaaatgttggctctaaagcgaagacgaagataataactcctagagttgactcgttgattgattgattgcttcatcttgccataaagcttgtcgaattttgagagtcttgtatttgtgtagccctcgactctttggttagttgggaaacaactgaacatagagtcgagatctgtagcttcttgtcgtcgagtactcattgcttgagtaaagatgcatgttgaagatgtccgggtagaaatattgaagattgtaacacctcttgttgtaataaaataacacggcatcatatttggtgacgcatgccgagatgtcgaagctcttgtagacgtcgtggttggtgaagtagcaaaacttgcgaagcagcggcaatagagtttgtcggtgccgaagataatgaagatgaagtcgctccaccatgatgacaaagttgcatagccgtgatgaagtgaatacaagtcggtggcaacataaacaaaccggtagcgaaaacgcgtagttgtgaagataaaaacaccagtcggcggtggcataaccagtcggcgatggaagaagtagaatgatgacgaaaacgaagacgtccatcagtagtggt

SEQ ID NO: 10115 - DNA, 1501 bp, Oryza sativa
gcctatgagcttcagcatgtcacgtggtcgctgagtggttcccggtgtaggcgtggatccgaactcgcaccgtgtgggctcggatttgcactgggaggaggctgatattgttgctcggcaacatcgacgacacggaaaaattgattccatcacacttttcgacgggaaactcgacgcacccctacctggcgcgccaactgtcgaaacaaattttaggcaatatgaaaagggggtagcgcacgagacctaaaagtggatgaatgcggagacaaggatttagacaggttcaggccctctcaatgagaggtaataccctactcctgtttggggatttgaatccgccgagtgaattatagatctgacgatctagttgtctcatgccccctagagggcctcctgcccactttatataggatggggggcaggattacaagatagaaaccttaaccaatatggtatcggtttcctaaatctactttacaatcttatcaaaccagaactttaggccgctccataatatacaggaaaacataatacccaagtcatgatccgttacatattccatagatataagttatcccctataactagtcggataatcatgccgtgtgggtatgtggtacgcataatctccacattaagatacaatttttaactcaattttcattaacatgctttttaaatgaattgccaaatggtacatttcatgataaaactttctatatagaacttgttttaaaatattagataaatcaatttttcaagtttaaaaaaattaaaacttaactaatcatttattaatggctttcttgttttgcgtgcccgtacataatcttcatctatcgctttctcgaattgggggccaaagtcctacaaaatttacaaattgtcaaaacttttgaaaggttacatattagaataaaagcatcaacttaaagacacaggaaagaaataattttttttcctccacttatattgaatagtctattcgataagaatcttgaaaaaattgttgtagagattatggataccccatatctatatggcggttatattccagctaggtacagggtaccgaataaagatagaatatcttcatgagggctcgggttagattctaaacttgtatgtcaaggaaatacccgggatcctagtcggttacgattgtattttatctgtaattccatgttcctttgggatatggactgtattttgtaaagcggaccccttcccctatataaggaggggtccggatgcctctcggggcgcggttttttcctagatcatacaatcaataatacactcggcggaatcatcccaggacaggagtagggtattacttcttgaataagaaggcctgaacctgtataaaattctttgtctccaaacccatccactttcctagcttgatagccacccccttttagtattgccgaaaccttgtttcgacagttggcgcgccaagaaggggcagcgtcaagtttttgccgactaagtgcga

SEQ ID NO: 10116 - DNA, 1501 bp, Oryza sativa
tccaaatgtcacaaaacttgcaaatagttaactggaatgtgcgggggttgaattccgctgtgcggtgcaacacagtgcatgagctcatgctggacacgaaatgcaacatggcatgttttcaggaaacaaaactccaaaacatggatgattcactcgccaggttcctaggaggatacaaactggatcgcttcgacttcaaaccagctagagggacaaagggaggaatcctgctactttgggatagtgacacattaaatgtgcaaaacgtccgagtcggtcgcttctctatctcagcagatgtcacagtcatccaattaaacactaccttcatgctaaccggagtatatgggcctacaaggcaccggctaaaagatgccttccttcggcatataagaagactcaagccaaactcgggagagagctggctgctcctgggagatttcaacatgatttacagggctagagacaagagcaatgagaacattaaccttgcgcgtatgacccgcttccgcttagcccttgaccattgtgagctaaaagaaatccacttacagaacagaaagttcacttggagtaatgagaggcgacggccgatcatggtgaaactggaccgatgcttttgtaatgaggcttgggacctagctttcccccagcacatcctaaatgctctaccgtcaggcccttctgaccactgttcgctactcctttacaatacttcaggaccacggaaaccatgtcccttcaagttcgagagtttttggacaaggataccaggattcaaggacgttgttgcggtggcttggagcaagcagacaactcacacagaacccatgcatcggttaaatcataagctgcaaattaccggaaaaagtctgcgagagtggtccaggggaatctgcactgaggcgaaaatccaattccacatggcgcttgacgtcatccagcggctagactccgcataggagcaaagagagctcacaacgctagagcaccggctgagagcaggacttaaacgccgcctacttggcctggcaacgcttgaacgcgcaaggaagaggcaagcttcccgcgtaatgcacatcaaggagggagatgcaaatacaaaatttttccacctcaaagtcaatgctcgaagaagaaagaattacatccaaagacttcgcagtggaggtggctgggcggtgagccaccaagacaaagatgatgttatcttcgaacatttttctaggatgatgaggaggccagaaccgagaacatgcgatattaactggcaagccttgcatgccccaacgacggacctctcgcatctggacgatcctttcacggaacaggagattcatcgggcaatcaaggagatgccagctgacaaggcaccagggccagatggctacacagggaacttctttaaagtttgctgggacattatcaagggggacattatggcggtcttcgaatcgcttaataatctgagatgtgcgaacatgaaccttctgaactcagc

SEQ ID NO: 10117 - DNA, 1501 bp, Oryza sativa
aaatatatttccatgaggattcatgtttatgttgcatccagacggtggtctcttttgatgctaattaacaagcacacttctactaagtatattaaaatattgttgaagctttcatctcagcagtggccaaaaacaataatcgttaagttgagcaatccccaactaagctcgacatgccagggcagtgtacatttgagaaaactcgtcgccgagccaatgctagggcttacatatcctgggcatcgtcgtagcgacgtagcgtgcttgcggtgtgtgctcgtcatagctaacgaccggatcacttgaaggctgcatcgtgttgcagcggagggcctctggtgcacgatgcttgagcaagacggtgatccaccggcttcgtataggaaaaacagtggcaatcgaactcgctgcactgccgctgaaattgctagttcgatcgtagttaagcatagaatcacccagcaaagggatccgaggcggctgaatagtttccagtgcctcccatacctagttagcagagcgagctaggaggagactacatcgatttttacctcctaaaaggagtactgcaccagtaggagactaacagctctcaaagtggcacgccatgaaaattcgatcgagtgtctttatttatagatagcattacgtctcgagtgaataactattactagctagtatgtacctcagccctgagtggtcatcattacgattcgatatggtggagaaaaacgtcccatcgtttcacttattcgggcatatttaccaacgaaaaataatttgtaaataaaacttttatatgcgtgttcttagggtcttaaagcgaaggctggaaaataaacttcgatgaaaaaactccaaaatcaactctaaatttaaggttaaaaatttaaattttggctgataaacaaaagcataagcgaaaagatgaggttgtttaccgtaagttttgatacaaccactgctttgattctctgttattactactacatgctcacttgcagtttacaggaatagaaaaggcgaggctctctgtttatgttggcccagggttggtgtctgtcaacagttggcccagactctattatctctgttaacattttcattttctgatgagtttaactgcaagcacttaatgatgatctaacagatatcaacatgtgtcagcacttccctagtgatagtgacaccaatagatgtgtagttaatctggataatttatttaactttgcatacatatgagttcattagatactaactttgcatcgtgaacggccatcacagatgtgctcactggtgacagaccgaaaaaaatccacgttgaagattggtcctcaccgccgtacccgttacctgtggcaggctaaatatgcggcccaacacgggtcatctgtgatgggccacaagcacaccggatgatatgaaagaggatagtgcccaacaaagaggactatagtcatttttacggggtcctgttaacagactatcaatgatataagtg

SEQ ID NO: 10118 - DNA, 1501 bp, Oryza sativa
gccgctgctgctgaggagatccgtcccgccccgccccgccaccggctcgcgccgacgaccgccgtctcgcgcctccgccgccgccgccgggtggcgcggcgggcgtgtccccgccgacatgtggctgttctggcgcagcaggaaccgcttctccctcgaagagctccggtgcgtgccccccccctacctacctgccctccctccccgtcccgttaggtcttcgtggggagccgccgcgcgcagatctgcgccgcgctgtaggctgtagccggaatcagcgcgcaatttcgtttcggttgcgtccaactaaaacctcgtctccgcccgattccaatccaatcgcttcttaattttgtgctaagtaggccttcatgtctgtgttatctcttgttgtcgacttctctatgaactgtacaactattaagcttggtttagaattgaggagtcatggaagtggtaaaccaaccagaaccgaggcatatgtaaatctacagtacaagagaggggattcttcttcctctcctgtcccctgatggcatgatgtaatgtcctcaactgcttaatactgtttgcatttgctgttgttgagtacaaagtttgtaatacggaggagataaattggagaacaactgtttttgagattggatatgcaggattagtcatgatcaaagtagttcaccttggaagtattatttacttctgtgggggtttgtctgtgcgatatatattaaaatcaagaatcacatgagctgtgatggttgagcagcataattacactaagaaggttgcacaagctacaacgtgcatttttataccataaccttgtggaaatatcactttgtggtttgtgcctgcttccttgcaattagaagcacacagcacaaaaggggcattttaactaatataaactttttattatagtttatttgctagtaaaaaaagaaaatgcctgcctgttaagaaccctcaatttgtaagttcattattattctaatgaatgataaagtaatccatagctgtttgggacacatatttccatcgtgaaccatctttccttaatttagtttgtagtaagtgttgaaataccccaggtatttttgtgtgtgtgtgtgtgtttaggggggggggggggggggaggcataaacaacgcaaagccacgaggcatgatttttcttgtgtttagttacaattgttatgctcaatttaattttgatatttgttcaaagttacatttctcattccttttctaatgtttgctaaatcaaaagttgttgcatactcatatgttaatgctctatgtaagtttcatccttggtttttattcctatacttgttgcatatcttatgctgagacaggtcctttgctgcaggtatctaacagatcagctacagaaggttcatattgtttatgaagctaataaggtatagttgatgttcctggttatcgccagaatttttgtgacaattttaagttgattggcctgacgatctttcttttga

SEQ ID NO: 10119 - DNA, 1501 bp, Oryza sativa
ggctgattctagactttttaagatgttttggcccatagtattgaagccctattaacaggggtatatatagcaaaaccctagtcaaacctcagctgcgcagccacgcgcccacgccactggttcctctcctcttcctccggctctccgctgcaggcacgccgcacgccgccaccgccagccgttcgcctgttccagacgcgccgcgcgcgcgccgccgcctcctctcgcgtgcgcggtgcgccgccgcctcctcctgctgccgtcgacgcgggcgcggcgccagcagccgccgtcgcgcggccgggagctgtcgcggccgcgccgccgggagccgccgtcgccgggaggacgccatccgccgggagcctctgtcgccgcgccgccgggagcacgccatccgccatcggccgaccatggcttcggcctccccccgcgtaagctacgatgcaaggtgagaaaatgcttcaatcccttatcccttctctgtactcgatagacgcctacctctagttcttctccgtcgagttattagtcttccatagctacgtcgttgactcactaacccacgtccggcggtccacgcgaagggacgccgccatggatttggacttgccaccacgtgatacaacgttgggcctactgccggatcctccgtcgtgctgggtgctgcccctgcggtcgttgcattgcgtgcagccccagcggtcgtcgggtcgggtgctgacaaatctcgcaagtccaatgcaaatgcccttcgcaggtctcctccttcgaaaaggaccacagccaagccgaaaagtcgtcttgcagttgaaggagctcctgctccgaaaagccatcttgcaggttctggagctccttctgctttgactactccaaacgcgtcatcttctgcgggcgggtgtgaagatgattcatgactagaactatggccagttgaactttctgaattgtgtatagacatgttctccgcttaagcaggcgaggttggtgcagtacaatcagcagcagcaagctaccattttcttttggactccagtcagtattctaaaatcaaaataaatcagatttttgttcagtacatgctacatagtaatctaatgatgttccacaacagtagttgagaccgtgataaatatccaactattgtgcatataatagtttgctgaaaagagatcataattttagactgttgttaggtacccatggttaaattagcacaactgatcttggaaaacatacaggtcattcatagttgtggccatggcaactcgatacatgaaatcaatattcttatgcatgcatggtaatgaaaggtagctgcttgtaaatgcaatttagaacaaatcttctaagcatggcattcagcacacaatccacaatacatggaggaaagagtacttgccggatcttgaagggagagagtattgccggatcttgtggggggttaagggcagggacacgcggcagcggatcttgcatggaggagaggagcagcttc

SEQ ID NO: 10120 - DNA, 304 bp, Oryza sativa
atccaacgatccaaattaatctgatgagtcgtatcggacggcgtcgacgcctccctcccaatcgcgcccctcccacaccccctccccatgcacctcctcctcccagtcccagatcgtgctcctcccacggccctcccagaaaccgcacctccctcccacgcctccctccgccgtctccgccgctgacgccggaaaccgccccaatctcctcccccttttcattcacacaccctcctcacgcccacatccatcccgtcacccgcccactcgccgtcgcacgagcctccccgtcgtcgatcccctc

SEQ ID NO: 10121 - DNA, 1501 bp, Oryza sativa
accccgtcgacgactaccgccgcactgaagcctttccccttacaacatcgtcgacgcctcccgccacaccggagccgggtaccccatcgacaaggaccctgcaccgtcgccgtgcctagccgatgggaagacgtcgacgtccagtagcacgaggtacgcaaaattattttgccgtctcaagatcagatgttcgtgtgtactgtctaaatgaaagccattagatgttatacatcatgaggattgatttgctgtccaaatctctattaagaattttctgtgtgcaatatgattgaggtcactattaacgagaacggttgatgctgttgctagtttgctactgcatatggcattgtttctgtgttttttaggcgcacctttaaattaatcatgctatgttgattctcaaataaatttgtgcctcaagttccataatcatcataactggaagagattccttcagattaagggttggaaatctattatcctttaagaacacaataatgttctctgctcttgttttaattcttttctttcacccgaaggggttctgggagctagatgatggacatctgcaatgcaatatccctttcagtgctcaattaatggtcagtacatatttcttcctttttcttgcctttttatggaactcttgctttactgtttttttcttacataatcaaaattgagaataaaattcctgtgatatgaatatgtcccacaagtctgacatgtaacaaattttggtacatttagtttacaccctgttgtttccatacaagctgtcttgtggatgactgcctatctacgacaggtgcagaagaagaaaactgtcttggttcttcctgctgttcatgactatgcaacaatctctcatgagatttctgtgtacacagggtaagaaatctttgtgcaactatctcccatgaggttatatatatatgggtgctaatatttagtgagtgctaagtagtactgtaatataaattggttacttgtgatagttatcatttgttgtcaacacttgcataatggtgcaaaatttggatttccttggctgaaattttctgacgacaatcaagacagtagtagatacactcttgacgtataatcgtggtctgctcaaactgttgattccagtgtgtactatcttcaaactgtgcagcatttgtttatttttttaatgactgttgctaatttattcacatgcttacagcttctgtatttattattgtagtaccctcgtgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 10122 - DNA, 285 bp, Oryza sativa
ctatcctctcctctcctccccgcagcaacggctgggcgtaggcggcgacggcggcgcggctacggtgcgcagattcggtagccagccgccctctcccccgcgggatctcgttcccctcccctccccttccttcttccctccccgaatccggcagaggggaggggcatcggtggcggtgcggccggaggggagcgaggaggccgtcgggagtgcagatccggcggcggcccgccctccccccacgggattcggctcccctcccctccccttccttccgtccccaga

SEQ ID NO: 10123 - DNA, 1501 bp, Oryza sativa
tgcattcaatccgtgccgttggaaaaataattttgatgttgttgcatttgatctttggcgttggaaaaaacaatgaaaaaaaaaacaatacgcaagcaaaaaaatggaaaaaaactatagtcccggttagtaacaccaattaggactaaagatgatagcaacaaccatatggcgttactatctttagttagtctcgggtagtgttactaactgggaacactaaccgggagttcaagagtaaagatatctctttagtcccggattcagggtcccggtttgcaacctgagactaaaggggttgcaaattaaaccggcactaaaaaccacttctccagcagtgatatcaatttatgtagccacactgtaccaccaaaatggttgaggaatttttccgaaggaaaaaataagtagcagatgctttctaagggaaaaaaatgaataaccgacttaattaccatcaatcaatcaataatagtcgcggctttgaccagtggccggagacggagctcattcatatcctctccctctgtaaccgtaaagaaagtcgtttaggatagcgacacggtctccaaaacacaactttgacttttttttataaaaatatttattgaaaagtgatatatgtatacttttatgaaagtatttttcaagacaaatctattcatataatttttatattttcaaactcaacaacttgaaagttattaatgatttatattttcaaggtttgacttaaacactgtgctaaacgatttactttatgagtatggagggagtatatggaaaaccacgtacgaatgctaaattaagttacataggcatgcatgacttaataaccactaaatcagggatgtttccttgctaacggaaatgatcgagtagctgactttgctatcgattgatcaataatcacagctccaacttgaaaaggctaatgcatggtacggtgtttcatgaggagaaatgaactgttgccaacttgccatcaattgatcaataaccacgactttcaactcgagaaaactaaattaagttaattatataccaataatcaaaatttaattgtatacattattctaggagaaatggatgattgtgtataaaaaaaacgtgaactttcgatgctatataaccaattttgcctatttaaaaatagaattatgatcgagaattgacggaagtgctaaaaatgggaacatggtgaactttaggtgctattaaagtgaaccggtatctttcggtgctataaaaccaaaaatgtgaactttcgatgctatataaccaattttgccttttaaacatattgtacccacaaattacagctgtagtatgcatagaaatatatatcgtgtacaaattaaattgtatgcatggaaaaaaaattaggagtccaacactattcagtttcaaatagaaaaccataattatatttatagaaaaaaaccaattgtgaaaaatccaactctacctttatatttatagaaaaaaaccagttgtgaaa

SEQ ID NO: 10124 - DNA, 1501 bp, Oryza sativa
tctgcacctctttgctttatctcaaggttgtttcaaaaataggtttaggttaatgatgtctaattaccttatgttatccaattatttataacaaaacaaaactcacatcttatacaataatttgagttgtattaaaaaaagataagttaatttgcattatctcggaggacttgggaggggaaaacatagtattatgcgcaaaatggataacaatgtcacgcgcgattatgagctaaagggaggtgactggataagtaatcaatgattaaattagatggatgagtagcttctttatccaacggctgataactatgtactaactaggtgaaaccccgtgcattgctgcgggaatttagtacgataacaataaaaaaaataacgtgtaagatagctagataacatcagattaagtaaattaatgtggtttatgataatttaaatataaatagtatgtagaatgatgattcaaacgtaaaaagtaaggtggtatgactttatggaagaagaaaagtagggagatagtttggaccgtagattaatcatctaaaggctaaaaacaattgatgtgatatgacttaattagaggaaaaaaggagaaagataatttggactatagattaatcatttaagcactaactaagtgaggatgaactatataagtatataggatatcataaaacataataaaaatatacattgaaacattatgtgaattatgttggatgataatttcatatgtttgtatttgaaaagctcttaaattataaaaactataaagatatagtatgcttgcatgatgtttaaatgtgatgattgttagtggatgatatgtggcatcttgttaattagtggatggtgatgtggcgatgatgatgtggcatctttgcatgttaagtttaaggagttagtgtaggataattttataataagataggatacgatccgatggcttagaattattgatgatgtggcttcttgcatggtttgttttataggagtaaatgccttttagtgggtgccaactatataggaagataggattagcagagcttgataaaaggtagaaattggattttattcataatcctttttttctataaatacaattatggtttttatatgaaactgaatagtgttggagtcttaattttttgtccatgcatacaatttaatttgtacacaatattatatattttaaaaatagaaggctctttatgtttctatgcgtacagtggtaatttgtgtctacgatatatttaaaaataaaattgttggatggtatacaattatcgaccaatctacacctcaataatttaggcccactatgatttaatggtaaaaaaaatcattcttaagttaattaatatgagattttctagtctctcgggtgaacttaatttgtggctcatatcattgaagagctagttatctttataacataatagatacataaggaatacgactaacggacatcgatctaagcctagagaaattctcctcc

SEQ ID NO: 10125 - DNA, 1501 bp, Oryza sativa
taccttcctgacaacggtccagatgaccccctccgtgcaaggtggtgtggtaaaggagcccatgtagcgatagtacacggtatcctttcccttggctacatttggatccgccccaccaacgaccatcttctctttaccttcttggtttgatatcgcaattatataaggctccatctgcatgcaacaagaagttcagcatagcaagaatatacatgtgtaataatctgtttgtgatggttaaagaaacaatatatctatcttggtcatcagttgctccaaactatcacattaaaatagacatgacaaaccattgatgatattatcagtgcttcctttgttctacaatataagacatattagttttctatgtcgtctctaataagttaaaacaattagtatatcatcaataacggtgaattattcaacatcatgtgtagttcttcaaatatgaacctaataacaacaaatactagcttgacaataaaaatatatattgctagtttagttgttactgtaaaaagttacagattttgatttttcttagaagcattagccatgtgtgcaaactatgtgaattatgtatttaacagaccttttgcagaaactcgtccggggtggtgccgatggtgtagaggatgccaatgacggcggcctggttctgggcattgaggtgcaccatatgtagctccatgtcatacctccggccatcgatggtgtgctccgacggcgtatgccagtgcatttgccggagctggtacgccgtgccatttatctttaggctaccagcgtcgccgtcaaacctaaccatgatgtcgtggccacggttgacgacggaggcgttggcgttcttgtaggtgtagttgaggttgccgaggccgggagccaaggtgaggtcgaggaggccgaggttgattggcgactgcatcttaccgctgctgcaggtggcccattccggtttcaggctgccccagttctgcggccccctgggcgagccagggatgtagctgtagccgtcgtcctcggctccggccaccggggcagtggccgagagcaggagtgcgatggcggcagcggcgccggcgaggaggaggaggcggcgagctgaactcatgttgctactgtttggctggctggtagagctagggtatataggggtatttatacaggggccagcaaggtagctagctacgtgttcgttcatgcatgtcaagttggaactattattgtacgtgctatgcgtacgtacagcatggatggagcacaagcggcacaacgtacttactggttgcgtctctgatcactcttaatctcttattataattaagcagatacgtacgtacacggcgttaagatagacagaactaggtgtacttaatttaattggtttttctcagttatcttcagatatgtgtgcccagtgctagacagaggtgtgtccgtgtgtatagtacgtacgtgcgtgtgcctggatgcttgaatgtgttaagccgcaactgttgat

SEQ ID NO: 10126 - DNA, 1501 bp, Oryza sativa
tctcaactagaattgaagcagatcagaaagcgctcatacaaacaggttaattatcagccgtctgtaaaaaataattaccagcagataagaaagcgctcatccacggcagattgatccactgcctcgcaaacttcggtcgtcgggatcgaagaagacgagggagagagggaggagaagcggcgggatccgcgagtagaccgcagccaccaacgtccccatcgctgcagtcacgccacgccatcaccgtagccgtagccatagccgttaccgagggcggcggatccagcactcccgagggcggcgccaccggatccgctgcccgccgtcgccgctcagtcccaccgccaccacctgccgcttccgaggtcgagggcggcggatccgcaagctgccgccactagctccagaggtcggtggcgggtgcatccgcccgctgcccgccaccgcccactgccgcccgccgccgccgctcccgaggttggggtcggtggatccgcgcgtcgatgtcgccaccgaggacggaggcggcgcagtggggggagagaggcggcgcggtgggggggggggagagagaaggtacggatgattggaaagcggaggcagcgcggtggggagagaggcggcggcagcgcagtgaatgggagcgaggcgacgtgcctggtctagggttagggtctaggcgcggtgaattgaagtgcgaggcgaggcttttttccgtggatattttccagcatttttcttttcgtttgtaggtacaaaacattgctgacagataatcaatcactaagttttgctgacatataattggtttctacttataatattgctgacagatattttgatcaaaaaatatttagatttgctgacatataacatgtcatattacatagtattgccaacatataatttaccaaaaacctttactaccaaatagtctaacaataattttttatttttaccggcaatataatttaccaaaaacctttactaccaaatagtctaacaataattgtttatttttaccgacagatgtccgttggcaatcttgtgtcatggtgtagtgtagctagttgtatacatacaatgctttactttgctatatatcgatcgatcaacagttgcggcttaacacattcaagcatccaggcacacgcacgtacgtactatacacacggacacacctctgtctagcactgggcacacatatctgaagataactgagaaaaaccaattaaattaagtacacctagttctgtctatcttaacgccgtgtacgtacgtatctgcttaattataataagagattaagagtgatcagagacgcaaccagtaagtacgttgtgccgcttgtgctccatccatgctgtacgtacgcatagcacgtacaataatagttccaacttgacatgcatgaacgaacacgtagctagctaccttgctggcccctgtataaatacccctatataccctagctctaccagccagccaaacagtagcaaca

SEQ ID NO: 10127 - DNA, 1501 bp, Oryza sativa
cagtgtgtttatcattttcgagttgaagccgtgattatttatagacttatcggtctataaatatcgcgatggcaagtcgccaagtcggctattcatctatcctcacaaaatatatcattaatatagtgatagagttgtggctacatacacaacctaatttaacattctcgagttgtcctataaccatgatgagctccagccatcggttaaagccacaattttttcaacgatccatggcaagtaatcaattatgcattaatttccccttagaaaatatccccattgtggtggtacaattgtggttatacatagctaagtataatttcactcccaaggttcaaatatgaatatctatcgtgttcacatggttgactttcagtaagaattttgtacgagtctaaaaaaaaacaattttgtaagggtcattcaactagggtgtgtttagttcacgttaaaattgaaagtttggttgaaattaaaacgatatgacggaaaagttgaaagtttgtgtgtgtaagaaaattttgatgtgatggaaaagttgaaagtttgaaaaaaaaagtttggaactaaactcggcctagaattttaagggtactactgcttacatgattttttttttatttagagtagctactgcttctgcgttcatctcatacatatgatctctgaccacctccatattccatagcctggttgcaacatgggtaagatccgagacaaacataggtggatcattggactgcgggcacagcggcatcattttaaagtgcctgtcaagtagtcgagagcacagacccaaatttgtaaaaaaaaaacaaacaaaggtatagttggttcacattataaaccagctacaatttaatgataatttgtatatcagtgttggttcatgttatgaacaggccctacgccagatccttacacctctgacgggatacctgtgacgggcaaacgaattggtcagtagtgaccattacctttgacgggttatacgggatgccgtcaccggtgaggcatctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcaga

SEQ ID NO: 10128 - DNA, 1501 bp, Oryza sativa
gaaggttgattctaaggatgccattgaatatgtcaaggaacatatcatatatagatttggaataccccaaacaataaccacatatcaaggatatatctttgtgtccgatgagtttattcaatttgctaaaagtatgggcataaagttattaaattcttctccttactatgcacaaagccaatggacaggcaaaagcatccaacaaaagtttgatcaagttggtgaaaggaagattgccgaacaacctaaaaagtggcatactatattagctaagtctttatggtcttatcggatggcatgtcatggatctatacaagttccactttatcaactagtttatgggcatgaagatgttctaccatgggaaactaacatcagctcaaggagaattattttacaagatcggttaacaactgatgattatcataatttgatggttgaggagccagaagatttggtataagctagattatgtggaatggaaaaagttaaaggagacaaagaaagaattgtaaggcattataataaaaggttgtgccaaagtctttcgtggaagaaaaacttgtttggaagatgatattattgataggaataagagataacaactttgaaaagtggtcaccaaattgggaaggaactttcgggatccataaatatgtgctaaaaggggcttatatgcttaagggtcttgatgaagaagtttttggaaaaacacttaatggaaaatttttgaagaaatattacccaagtgtatgtgttaactcataattggttgattataatgatgtatgataatagtcgatgtttgaacatcgctttttagatgtccgatatataatatcgcccttagactaaaattttgtgaaatatcgcaagtgtgagataagcaagagtaaaatcggcttagtagctgatggatatattacatgaaaatgtttaaagttgcggtatcaaaaaatatttacggagctaaactattacatcagccaaaaagttctaaacttaacttaatgctacatccgttaagtttgatctattaagtcgtgatttgaatctttaactctggcctactttttgattgccaataagggtagaatcgggggtttcagccgatcttacctgatatagatgttttaatatgtttagttaatctaatcatgcttttcatgctatatttgccattatatatatgtatcacttaagataaataaatttggtgtacatcgagtatatttctgtgacatcttggcccaatcaggatgaggtctgtgtggcccatgtgagctgtgtgcgcatgtttagtactaccttgctagtttagcaagggtggaacaaactcataaggccttttcccttcaaccataccactctcgagttaacctttttacacgaagcgaggacgaaagtataagtggggtggtatgtgtaagtgggtctgcccgtcggatgggctggctacgcggttctggagggagggttgttacaaattctctagattgat

SEQ ID NO: 10129 - DNA, 1501 bp, Oryza sativa
ctagagtaacctaagggttggcaagctggggtaaaagtcgaaaactcttaagcgcagagagacggtctgggcggcagggaaaacggcaaaaataactaagggtgaaagtaaaagtgaaagcaatgggagggggtatatatagctcacccgcaaggcgattcgcctaccacccaatcaaaacccgccacgtaagccaggagtgtatggaacagtaatttcccatcagtgcgggccgaaacagtgaatggccgaagattgcaaacggtcggcccaataagcccaacactgttcacaagcatgaaaaccaagacaaccaaatcgaaatattattttatgcagaatagaagacaggtttcggtaggaacatcggccgaaatgaggcgccccgcggtataccaacatggtgtgcacgatctcggccgaaactccctactcacccttgcccgtgaggggcttgttggaggtacaccacggggcccttcggccggaaccaccgaaaccaagagcttaggcgacaagcccggaccggagacaaatggcgaaggtcaggaagacaaccacaacgggcgaagggcgcatggcgaaagccgtagctaggaatacgtcaacttcgccaagcggagaccatgtcggagggccgcatgggcaaagatgaagaggcaaaagcctcggcacagaggcacgggtttcgccaaggtaccgaacctcatcgccaggaggcccagcggaccgccgagccctcgggagacttcagcaaatagatgggccaagccatttatggcccaatatctatacatgtaaaagacattgtgtgcccctaataatgtccttatcataagggtaaccatggaaattcccctgtaaaacctaaaccctaaaaggggagcctgtaataggattataaatagccccctaagaccatgtaatgggggggatccaaaaaaattttcactaagtaatacaattgttcttacttccaaccactgttgagagaaccacgcctttcgacgtgacgcagttgtctattcgacaacagatataaacatatctaatctctaagtccatactgtctcggttaggtccgatctatacagtttgtctataatttagataagattgatttagagattatatgattgtttgcctttacagccgatacgacatacttagggtttgttcatattcttttgtgactatacctgatagcatcggctaggttaaagacgataggtcataagctttctagcttatcgactatcatttacagatttaactgttttattctgttcttgttggttgcaggataaaaaccaactgcatgcattgaactcgaaagcaagatttggacatgcactagagtgaagcaactctttcaggccagtgtgtttttttccatcaacactatccatggctgcccccgagctccaccgtgcttacgctctgagagagaatagacgctctgagagaagagaaagagagcagagagaagagaggagaaaga

SEQ ID NO: 10130 - DNA, 1501 bp, Oryza sativa
tcttcacccctctccccttctctctcccttcgcttctctcttatctttgctctcttttgttggcaacattttgtgacaagtcgacaagtacgatcgcagcacctaaacgccttgcggtgatcctagagtcgtcaaccacttcgatctagccaaagggccaaattaagatgggttttggagaaaaacagctaaatcggttagcggagccgatttagagatcaaaatcagcctctaggccgatttagatcgatatgaggataactacccgtctcgtgggcgaaacggaaggtttccagtacaaacctacaaagaggtatcgcactctcgcagcggtggcggacggtttacggtgcaaaccgacaaagatggactaaactagggtaaatagaaaacatagtaaaagaacgattcaagtagattgtattcgggggttttacaatgaaccggccttgtcccttaaataggggttggtcttgccctctacaggcccttctccatgttcaactcgggatagaaactaaaggaaacacgaaacatgccttcccgagcaaggaaacccgagacccgacgaaaacagactcagactcggaccctgccggtctgaccgcccacatacctacggtcagaccggttctactagccggtcagaccgcccatatacgtgcggtttgaccggccctgtgaaggaaacccggtactttccaaactttggcaattttcccctatttcgtccataggtgccaaatttgggtgtaaacatctttctcctctcttctctctgctctctttctcttctctcagagcgtctattctctctcagagcgtaagcacggtggagctcgggggcagccatggatagtgttgatggaaaaaaacacactggcctgaaagagttgcttcactctagtgcatgtccaaatcttgctttcgagttcaatgcatgcagttggtttttatcctgcaaccaacaagaacagaataaaacagttaaatctgtaaatgatagtcgataagctagaaagcttatgacctatcgtctttaacctagccgatgctatcaggtatagtcacaaaagaatatgaacaaaccctaagtatgtcgtatcggctgtaaaggcaaacaatcatataatctctaaatcaatcttatctaaattatagacaaactgtatagatcggacctaaccgagacagtatggacttagagattagatatgtttatatctgttgtcgaatagacaactgcgtcacgtcgaaaggcgtggttctctcaacagtggttggaagtaagaacaattgtattacttagtgaaaatttttttggatcccccccattacatggtcttagggggctatttataatcctattacaggctccccttttagggtttaggttttacaggggaatttccatggttacccttatgataaggacattattaggggcacacaatgtcttttacatgtatagatattgggccataaatggcttggcccatct

SEQ ID NO: 10131 - DNA, 486 bp, Oryza sativa
ggtagtagttacttgtgaagattacatgtcatgccaaattgcttagcaacaggttttattccacgtggtggttatctgaatttatagatcaaattgtgggatatccgatgcattgtttattgtcctcaaagatcatatattgctaaataggaaataaggtaagaactaaaattccttaggagtttgaaccagaaagcttctaaaattcctcagggtctagtcagtggaccactggacccctattaggccatttttaaactcaattcccatccaggcagtgtagcaattctctgttattcttgtttaacgtgtctttctgctttagcttgttttgtctgtcataatcaataccagttgttcttctcaccagggactcagacttacactatttttagtttctacccaatatgaccttaagaacatatgtgctgggtctgtggttttcttcaaaatttatatatgttccatatttgtttatgctgtagg

SEQ ID NO: 10132 - DNA, 657 bp, Oryza sativa
aaaatcgatttatgagatatttataaaatacaccattttacagttttaaaaaatacattaataaaaatcaaaataaaatctgtaacttaatcaggtttaactgttcagagagtttagcaactactcccttcgtctaaaaaaaataaatctagtactgaatgtgacatactgtagtacaataaatttaaatagagatatgttcagattcataatattatgatgtgtcacatttagtaagttggttttttataggacggatagtttgtggctggtttttcagcaacattggggggagttgggacaaagaagtcaataattcaccgcaacactgccaccggtaaatccagagagagagagagacaggacacagctgaggagagagaaaccactgcaacccaaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaa

SEQ ID NO: 10133 - DNA, 1057 bp, Oryza sativa
ccataaaagtaaaacatccaacatagtggtaggatttatttctaaccatttctacgagtgctgatgtatatttgtatgcagaatgcaacccaccaaagttgagatgaaatatacatgaaggatgagaatataacttccatagccaagcctatggagtgttgagcccatttatcttggccaattttcattggaacatatagtgggacccacatgtcagaacaccagagaaagggctagctggatgggctagccagggttcgagcaactggcccaatccaatccagcttcggcatgatggttgtactcctcatcttatgacggttatgagcgttaataccagtggaaaccgtcatcaggaagacacatggcaaagggagaaggaagatgctatttggattctatggagaatattccttagcatctccactctctcaagtcacctccacactataaatacccctctcctcaccctcattcacagacacttgaagcatgagctgaattataagatgctctattgtactttattatatactagattagggagagagtagaggagaagaagtcggaggagttctggagttgtcggtaatccccttcctatttctttgtgctttgttaattactctgattataatagaaatatcttttaagtaatttagttttgcttggtgagaattatctcttggttagttcctaattagcgtgtgggatcatcgttcactatagtccattataatatagtgattgctttaagtggagtacaaaacactagaagtagctattaaattgcttaagacgcgggggtctagggtagttggatttttcgggtggttggctccgcaatcccaacggtaaggtgtgaaggtgaagtgtagaaggtgggtgacagccctcaatatgagtgaaatcctccctgtccgggtgcgtggtaaaatgatatctgggagcagcgagctggccagtgctcgaagtaccgcattaggattaaagttgagatttctatagacactatttcttatcggtgaaacctctctatcctttccttatccatagc

SEQ ID NO: 10134 - DNA, 1501 bp, Oryza sativa
attggaagaggagactaaaagttcatatacatgtatacaatttaggattaatggaaattcgtaattaaaagtagatgttatagtccatatctctactattataaaaattgaagatgtttttgccagtgttttggtacgtcatccgtatttgagtcggtttctaatttcgttcattttttgaattacagatccgtgtttgagttggattttaagtttgtttccttttggaagtataaaaggagcgtacaagaaatgttttgaaaaatctctcatgctaacttgagatgaaatatggactactaattgcagcttatgattttctaaaaaaatatccaatcgagttttcactgtgaattttaccctaactaaacggtataacaataataaaattaaaatagcatttacccattgcaacgcacgggcatttttctagtataaatataatttagaaataactaaaattcaaaattaaaaaaggaatattgaaagaagagtatagagtgcatatagaaatataatttataaatatctaaaattcggaattaagaaaataaggaatattagaagaagagcatagagtccatataggactaaaattcgaaattcaataaaatgttgaaagaaaatactagagtccatataggtatacaatttagaagtaactgaaattataaattaaaaaataaataatgttgaaagatgagtttagagtccgcataaaaatacaattagaaataataaaaattcaatttttttttcaaaaaaagaatatggaaagaagagcctagagtctatatagaaatataattcacaagtaacgaaaatctgaaattaaaaaataagaaatattagaagaggagtctagaggccatataggagtataattgagaaataagtcaaataactgaaattctaaatttaaaataagaaatataggaataaaatttataaataatagaaatttagaattaaaaaaaataaaaatattggaagataagtctaaagtccatatagaaatacaatttataaataactaaacttcgatattaaaaataactgataactatacgtatatacaaatacaatatgaatattacacatcagtagtttttgtaaatttagtgtaaattttaaaattatattgttattttaatagtaaataagaaaatatctattatgtaagagaagatgcaatctgtgcggattactatactaattaaaaaaataataaaactagtgagacctccatgtcacagcaaatttctttatcctctaccttttcttttccccttcctctctcttcaaggtgcagcggcgtcgaactcaagatgcaacacgcaaccacctcctttctcaaaaaaaaaaaaccttctccacagtctccaagctatgcggcacgctggcgcgtaggtaggtactacactacacacgactacagtccaatctggcccgagagaagtaaaagcccacagcggcctaaccgatatgttatcctttcacg

SEQ ID NO: 10135 - DNA, 1501 bp, Oryza sativa
aaaatagatggtaatttatcaaaaaccatatcattcctgctcaaccacagagcccaacatatggcagaggctactacaagaatcagtttactctttttcttgtctaccccaaaagccaaccataaaaaatatgagatatgctagcagaaagaccaaaagtgaactgaattactctccatatgaactttgcataatgacaatccatgaagaggtgttgaatagtctcatttttcatatagaaacaacattttaaattaccattccaattccgtctcgccaaattgtccttggttaacacaacccctttaagcaagtaccacataaagatcttcatcttaagcggcatcttaagcttccaaatactcttatcctctcaatataaccattattaattagagctagatacattaacctaatcgagaacatgacattctgatgataattccatctaaagcaatcagaagaaagattcaactggatatgtacaatagaagcacataattcatgccaataaacacgattctgaccaactaaggcttcctaaaagaaatattaagcggaacaaatcccatgatattagcaatagaagaaattttgattcggacaatagtatataaagatggatatttatctttgaaggccaagtttcctaaccatttatcttcccaaaacctttttgttccccattatgcagttaataaagaaattttctaaggtattgggttcacaccacgcgcatatcgccaagacaaattaaatatgcttaagttcctacaagacacatggcttttccacactcgaaaatatatggcatatgtggtataaaatcgagtaaataatacccataaacagatttaccaactgcctaaagttgaccaaaatcatacaatcagtctaaagctatagtattggtgttcgaataagaatgcacacatatgtggcctaaagcaatgatattatatataatcaattgctttatataaaccaaacagtgccttaacttgtataaaagttaatagaccagctatatatataaagctttactgttttccatcttttaaattgcattgtaccaactcataaaaagttgtgtaacagctgaataaaatgattttcaagatattaagcacttgaacacgcgtacattgccaagaacaaatatgcctaagtccctaaagacacgtgacatgccacacttgagaaatatgggctgcatactcttaaagggcttcggcccaaaaagaaaattcaccgatacccttaaaaaaaatcaccgtgattactgtgcatcatcttctccgccgcttcatttccaaaaatcccccttcgcgctccttttcacaaccaccaccgccggagctaggactagggttccccactcatccaatcaccaaaaagaaaacccaaattagccctcgagcagatctgcacctccgcaccaacaacctcctcaaatttcttccacaagaaactctaatccgaagcttctcatatccaccca

SEQ ID NO: 10136 - DNA, 1501 bp, Oryza sativa
caaatcccatgatattagcaatagaagaaattttgattcggacaatagtatataaagatggatatttatctttgaaggccaagtttcctaaccatttatcttcccaaaacctttttgttccccattatgcagttaataaagaaattttctaaggtattgggttcacaccacgcgcatatcgccaagacaaattaaatatgcttaagttcctacaagacacatggcttttccacactcgaaaatatatggcatatgtggtataaaatcgagtaaataatacccataaacagatttaccaactgcctaaagttgaccaaaatcatacaatcagtctaaagctatagtattggtgttcgaataagaatgcacacatatgtggcctaaagcaatgatattatatataatcaattgctttatataaaccaaacagtgccttaacttgtataaaagttaatagaccagctatatatataaagctttactgttttccatcttttaaattgcattgtaccaactcataaaaagttgtgtaacagctgaataaaatgattttcaagatattaagcacttgaacacgcgtacattgccaagaacaaatatgcctaagtccctaaagacacgtgacatgccacacttgagaaatatgggctgcatactcttaaagggcttcggcccaaaaagaaaattcaccgatacccttaaaaaaaatcaccgtgattactgtgcatcatcttctccgccgcttcatttccaaaaatcccccttcgcgctccttttcacaaccaccaccgccggagctaggactagggttccccactcatccaatcaccaaaaagaaaacccaaattagccctcgagcagatctgcacctccgcaccaacaacctcctcaaatttcttccacaagaaactctaatccgaagcttctcatatccacccatggcggaagagcgagaaatctcgttcgaacaatgggcgacgtttgatgtgaaggaatccacattgaaggagacggtgaagaagggcgtgctgccggcaaaaaaatcatcgggtggcaatcggcctacagtgaggaattctcgacaccgaacattggagaaattgtggtatttactaccttcttctatagtggtttcaatctcccaacttccactttcttctgtggtcttttggatttttatggaattaggatttatcacctaaaccctaacaccattctatacgtcaccgtatttgtccacctgtgtgaagcctttttgggcattcggccccattttaatttgttccgctgcatattttacctcaaagcacaccccaccaaagaaaacccctacgtagttggtggctctagctttcagccatgcggaaatatccacaagcactacttcaattttcctttgagaacctccaacaagggctagcatttgaattggttttacatctcgaacccagttccatgcctccctgcttttgtcggcctccctccagtccatggtccccat

SEQ ID NO: 10137 - DNA, 1501 bp, Oryza sativa
cgatcccatgtcaccgacacatgtgtccaaacatttgatgtgacggaatttttgaaagtttgaagagaactaaacactgtctgaaatagaagtcattaaatgtaaagaaaaccgtgatacatcgaataatcaaataaaggggtggctaaggaataagaggtagcgactgaaatcgcttttaaaatctataaaattgttcgatcttttgaagtcctaaaataatgagacagctatttaacaaaatataaaaaaactcatatgtaaaagaagataattttatatggacggtagccgcgcaattgcgcgggccaccctgctagttaacttaatgagtaatagaaaaataaccttcacgttcgctctcacaacataaaaattaccacgttaatccgagaaaaatcagaaaaatagaaaaaagtcaaaaggaaaaggattgttaaaacgcgtgataaacttactcatgcatgggcataagtcataacatggaaacggacaagagtcctttttgaaaaatgtggtgtccgtatagatatatagatgtggtgtccatatagaacacctgtgcatggaaggaatctttagggaaaaaaataagcaccgttgctatattcatatacaacacaaattactagcgatttagtacctatatatatgtgttggctcattgcctttttgaacagtatattacatctcataagtaggtaggcgcaagcaaatcgtaaatacaaagcacttcaaaggagaaattctcttaataatcggacaaaaagaaaaaattgagtctatttagaatataaatagctgaaattcaaaattaaaaataaggatatttgaaagaagactatagtctatacagatatacaatttaaaactaattaaaattcggaattaataaataaaaaaattaaaactagaggttagagttcatatagcactagaatttagaaattaaaaaattcaaattaaaaatataagtaatattggaagaagagtctagggtccgtatagaatataatttagaaataactaaaatatagaattaaaaataagaaatattgaaagaagggtttagaattcaatagaaatacaatttataaataatggaagtacaaaataataaaaaaagaaatattggaagaaaagtctggagtccatatagaatataatttagaaatcactaaaatatataaaaaagtaaggaatattgaaagaagagtttatagttcaatagaaatataatttatatataatggatatccaaaattgtcggagacactccggacccatcattatatatgcaagatgaagtgaatcacttcaagtcatctaacacacataatgaaacatccgacgtctcgagagaaggatattggcgacatgggtggtcctttagcctgctagtcaacttcagcctgagatgtacccgtcaaaccacacgaaagcggcgaccagatatgttacacattccgacttgacaaaaatggctaaagatatatcacat

SEQ ID NO: 10138 - DNA, 707 bp, Oryza sativa
cccgcgaaccggtccttaattgccatgggcgcgaccatcaaaaccatgcacccacagcccaccatttaatatattttaattaaccaacaccggagcggtgggcattaaccaacatcatttctacaatctgatatctatgcattaatgttgtcccccattgtgtgctagttgaactaagcaaggctaagcaatccctagtccaacctctagtcatgttatatcccaagctaagaaaggaacatcgtaccaaaatagcatggctataacagtaggtaaacattccatggtaatattataaaacaatgcagtatttgaacggaaacaaaagagcatttgcaatataggatcaacatgttcaagtgacaagcatgacttgccttgcactgctgctggaggaacctcggtgactatttcaaagtacaacggagcgtcaggagagccggaatctaagcgacatacaaagcaaacaatacaaacaggctataagactactgaaacagagaacaaaactatttttaatggattctacacatttttcttgatttactgagacttgaataggcttaaatggagctcggatgaattagatatgaattttagaagattcactgtgtttttactataaacagaaaaatccttaattgaattattgcgcaataaataaatcccgggagagagaggggcggcgccgacatgcgggccccaca

SEQ ID NO: 10139 - DNA, 1304 bp, Oryza sativa
acaagacacatctttctcacgtgcaaccacgtgccacataccaccccggtatacagacgaaagacgtgacatagtttccaacccatcctagccttagacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaatccaattccacaatactccaacaatttcacagtgtccaggtgatgagaatatcccaaagtctagagttgtaaaaccacctaatgttgtctaatttaattgcgaagcatctacctaaatttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataatttcacaaactgggatccaatatgttcaaagaatgatgtgacttgccttgctcgctttcccaaacgtcggcttcaacctccacgaagagcggatcttccgaagctgcagcgtctacacgaccaacggaaaagaaaagggcttttactctaataaactccatataacaagcaggaacaaagcacaaaaatgggttcttgacttcttaaggaaaaattagagacttgaacggtccaattccgaattcgaagtttatatgctctttaaatgaatatttacgaatttcttcatttaaattttaatttaaaaatatatttattgcgtcagccgggagagggcgcgcggaccgggtccacgggagtgggacccacgcggcagtctcacggtccacggtggaccgggtgcacccggctcacaccggccggcgccgtgcgccccacgcgtcagccgcacccgagggcgcgggcggctgacggccgggccccacgcggcagccgctaggcgcgcccggaggcggcca

SEQ ID NO: 10140 - DNA, 1369 bp, Oryza sativa
ctatataaacgctccccgagctccccacctccgtttccgccactcaccgccctctctcctcgccggaatcgagctcgcgccgtcgctctctctctccgccgtcgccgccgagctccggtccgctgccgtcgtcgccccggaccacctcccacctcggcgccgcctccttcggcttcgccgcatcctcgccgacctcgtccacccctccgtttcgctcgccgaccaccggagcgccgtcgaccccgtccacccgagccgcgccgccgccttcctccgctcaggtcgccgtttccgtcgtcgccgtcgccctcggggtgagccgcggaccgccgcctcctttcccccttccctctcctctctcggccgctgctccgtcgtgccggtggtcgccggcggcgaccatcggggcgcgggcgctgcctcctgccggccgcgccgacgtggccgcctccgggcgcgcctagcggctgccgcgtggggcccggccgtcagccgcccgcgccctcgggtgcggctgacgcgtggggcgcacggcgccggccggtgtgagccgggtgcacccggtccaccgtggaccgtgagactgccgcgtgggtcccactcccgtggacccggtccgcgcgccctctcccggctgacgcaataaatatatttttaaattaaaatttaaatgaagaaattcgtaaatattcatttaaagagcatataaacttcgaattcggaattggaccgttcaagtctctaatttttccttaagaagtcaagaacccatttttgtgctttgttcctgcttgttatatggagtttattagagtaaaagcccttttcttttccgttggtcgtgtagacgctgcagcttcggaagatccgctcttcgtggaggttgaagccgacgtttgggaaagcgagcaaggcaagtcacatcattctttgaacatattggatcccagtttgtgaaattatgttgatttaaattattgcattatcgctttatttaaattcccgcgttatcactgttttatttagccatgcctatttacctttgttatgaccatattattattgttattgttattattattaccttgttcaccctagcttaaacaaaacctcaactagtggacactctactcgtggtatccctagtttaaatttaggtagatgcttcgcaattaaattagacaacattaggtggttttacaactctagactttgggatattctcatcacctggacactgtgaaattgttggagtattgtggaattggattcaccccgccccctctattcaaaatccccaaaaatggttttaggctgggctcggggtgcatggttttgatggtagcacctcggccatataaggaccggt

SEQ ID NO: 10141 - DNA, 1501 bp, Oryza sativa
gtggtgatgagcagagggtttctaagcctttctacccccaactgatttctccccacgaatggcacagatataaacgagtgggaagctccagagtcgaacaaaattgtagcagggatggaatgaacgaggaacgtaccaacgatgacgtctggagttgtcagcacgtcctcggccgtcacgtgattcacacgaccccgaatgacgtccttaccaccgttgttggggcggggaggcgcttggccttgctgacgccttggcttcgggcatttatccgcaaagtgcccgggctcgaagcagttgaagcacagacgctgctgaccttgagcgtccctgtggccttgaccaggctgcacagttggcgtaggaggacggggcgcacgagtcccctgctgaccctgctgctgctgcggctgtgggacgcgcaccacgaattgaggtcgaggcgcggagcgaggctgctgctgctgctgctgctgcgaggaggatccccctggatagggattggtgtagcggaccctttggttagcaccctgttgattgcggaaattcgccaagcggcgcttgtgcgactctagttccttgtgcttggcttccaagcggatgctcttgtccaccagtcgttgaaaatccggatagtccccagagactagacggacggacagctctgggtccattcctaccaggaacttctcttgcttctcctcgtcttcccgcacatcctccggggcgtaaccggccagattgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaagtggtcccaccatagagatgcgggcccctgcagttggtgggcggcgaagatgactttctcctcatcgctgcactgcaccgtgtctaactttttccccacggcatgcaaccaatccaacgcatccacggggttgttggagctagagaaggtaggtggacggatgcggaggaactcggcgagtttagagtgttggggaggtggtagtggggcattaagttgtggcggattttggaggtggtggaggaaagcagtcatcatgttggcttgctgggcgaggatttgggtgagaatggcgttggtgtctggtggtggtggtggaggtggaggaggaggttgaggtgggttgccctggtggttgtggttgctgccttcgggttggttgccatcaccggtagcagcatttctcctggtcatcaccatctgaaaaccccacacagaaccagcaaacagagagagctgacaattaaagctaaccacccacgactaccataattcttgaatttattactgctattaaattggttcattaaggttcaagttgcttaggcaaataaaataagacaggctccgacacagttatgccacacaccggc

SEQ ID NO: 10142 - DNA, 1501 bp, Oryza sativa
ctagtttaaatttaggtagatgcttcgcaatttaattagacaacattaggtggttttataactttagacttgggaaattctcatatcacctggacactgtgaaattgttggagtattgtggaattggattcaccccgccccctctattcaaaatccccaaaaatggttttaggctgggctcggggtgcatggttttgatagtagcacctcggccatataaggaccggtcttgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtagaatctattcgaatagccgcgccctcggttatgggcaagccgagcaatgtacccaagttagtgctttaattcttaaaacctgcttaacaactaaaaggtggaatggatggcctgggttggcttaggacgagctgggacccagggttgggttgccagttcggtctgaatcatcgtaggccttgggttaaggcaggttcgtgtgggttcacggccttgattaataatattgtatagttttagaatcgtgcttacaaaatggctttgagcaactaaatgtctttaaatgctgtttactgcaaccctaacccttcatattataattcccttgtactcccttgcatttattctgcacttgtgggtgtgtcttgttgagtacggtggttgtactcagtcttgctcaaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtattaagttaactatttacgcttccgcttgttaaactctgaattgtatcaacttatggtgtaccttgcctcctgggacaaggattaatgcacgcacgtaaggaacgcccgttgggttaattccggtcgtgacaagttggtatcagagccacccttgaccctaggacgagccgtagatcccaagccttagcaatattttcaaaaataaaaatccttggttatttgtgaaaatcctctagtctctctctgtcttgctgcttcatttatcgccaaaatctgacctttgaaaatgttgcttttctttttgtttttgtttgtaga

SEQ ID NO: 10143 - DNA, 1501 bp, Oryza sativa; identical to SEQ ID NO: 1084

SEQ ID NO: 10144 - DNA, 1501 bp, Oryza sativa
cgcgtcgcgccgccgcttcggtcgacgccgacccgcgccgttgcctccctcagctccgctaggacgaggaggacctcggccgccgcccctcttcgccggaaatccgccggagctcctccttcctcggtcgccgatcgaggccgagcccgtccgccccatcccgagcgacgcccgtcgccagagctccgtcgcgacgtcttcctgaggagccccgccgccaccgttccttgccgtcggccgccccttcgccgtcgtgcatctcggtgagcactccacttcctctcccttttcctccccttcgtcggccgcctcccgggtgtcctcacgacgtgctgccgccgccggtggtcgtccgaccgggtcgctgccgccgcgctccgcgctccgtgcccgcgccgttgctggtggtgccgggcagacggttgccgcctaccccttgccgcgccgccgcgcgccgtcgtttggctaggccggctttgtgccgtgccttgccccagccgcgccgcccggctgtccccagccgtccgatcggccttggccgatctgggccgtccacgtggtggacgcgcacccgaggccacgtgtggacttggtccaccgtgcgccgcccctttgtgccgctaacgtgcggggcccgcctgtcggcgctggttccccttgctgacgtcagcaaatgccttttcctttgagaaattaatcatttaatacgcaataaattcgttaataactctagaaattctcttaatggctcaaaacctctaaaattcatatctaattcattcgaactccgaattgagccattcaacttgcaaaattcatctaaaattgagctcaacatgtttgtttactttttatgtactatttccttggtttttattagagtttttcctcgttttgcgtgccagcgtgtagaatccgtcgtttcggaagtccgcggtcgcgaggaaaagagttcggaagattgtttgaagaagcaaggcaagtcacacattccccttgagcatgttgatcccaatttacaaatgttttactgtttgcaaataaatatgcatattttgctaattacatggggtcagggtattacctatctgctcgcttgtgccatgtttacttgatatctgttctttgtcaactttgggtaatgaatcgactagctcatgttacttatgtgacctagctagaactatatgcttagccatgcttaattaccactagctcagttgatgggataattacagtattagacctttttagtatcagaatgagctgtgtgctcaagacatctggccatgcttcatggtcataattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagacgacacatccaggcaagggtgggcgtga

SEQ ID NO: 10145 - DNA, 1501 bp, Oryza sativa
ctgatgacacgtctaaatcgtggcacgtaaaaatcatagaaaccaatgtaattgtttttttctaagggagtattgttttcgatttataaatcgcatgaggataaatatatacctaataacaccactaaaaagacatatagatgacggtactataagtgtcgaaacagttaaaaccatcacaagtacaacttttcccacctaagcggggggtggaaaaatacagaatcagcacatttcaggaattataggtaccgattttaaacaaaactgatacctatactataaatattgggtttttttaaaaaataaatgacaccagaaaaacttagacgagccaaacgcgtcccgtccttgtccatactcgctccccaccctacacaaaatctctctcactctcactctcccccgcccctcctctccctccgccccctcatgcttcgctcgccatctcctcctctccctctcgcctccctcttgtagcggatacggcagcggtagcggcatcggcgacggattttttttcctacaacttgtgagtcaatgtcctacatggtaattagttatttgatacccgacgtattattttattattttataaaagacaagtttatccttgagaacaaccacagccaccacctcctcatcattgccacggccaccgccatagccatgctactccttctgctcctactgactatcgtgctccacctttggagccaccgctgccgtcccactctcttgttattgccgccaccggacagctagctctgcagatactcccatcatgcggtccgccgcggcacgggcgggttccgcccatccagtcttggccgcggcgccacctcgcaggtcaacctcgccatctttccctgacatgtcgctcaccgctatgagattccttaaccgggctaggcggctcgccgtcatatgcgacatggcatgcacgacgccgcgtcgtacggctgaggcgatcgctttgattgacactaagaacctcgctgcgcatctcgtgcacatctcagtaataattatcctatcctatgcatgaaatgagtcagaggctcacaatagctccaccactagtgtctattgccgctagtgtctctaatatgttgtctcgtggaaaattttaaattttttttacaatcgataatttttatctcaaacaaatattaacgtgcaagtattttaattgtttgcattttatactatttaacggtttcttttacccataacgaagcacgtgtattttgctagtaataataaaataaaatattacttgtctgtaaagttggtacgtgtatgtcaaaaatagtttgttttcagcgaaattcaatcttgtggttaccacaatatagagcacaatgccacttgactgtaattatctaaagtctcaagcacgtacactatgtactaccagtaaaaatatctagactgcagctccctcttttttcctctctcttcccgtctttctccgcctctctccctcctcactttctcc

SEQ ID NO: 10146 - DNA, 1341 bp, Oryza sativa
caaggggctaattgcaattttggccgcccataaagagcttgcggccgtacttttttcatctgggtccctgggcggcaaaggacccagatgaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcttatcgcagtctgggtcgtagaaacattatatggacttaaactaggagaattatgtaacatgaagaaatagtagtacaatttgaacatgatacaactatttgcattgcggttacatagattgtcacatcctgattttcgtttcaggatttataaattgtttaataaattaataatagaatttatattaaatgttcattaatttacaagtgaagttaaatgtgggaaataaaatttcctaaatataaagcatggatggatttaatttttattaaattctccatggttaattatactctctggaattttctcggatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaattctcgcctccccgttgctctttttctccaattttgttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctccactttcgtttgccccctctcccgtcctctgccgtgctccgtagctccgtcgccaccgccgccaagcaaaccgccgccgccggccatctccggtgc

SEQ ID NO: 10147 - DNA, 1501 bp, Oryza sativa
gcgtggccaaactactatgccactctaggacaggtggcgtggtaacaaatgccccgtgacgatcattgcctttggcaaggtcaagcgggtgctgacgtggcagggggctgaggctgggcttgccacgccaggcttggtggcgtaataccgccatgccatcccgcctagcatggctagggaatagccgccgatgtcgtccctttctgccttcttcctctcttcttctcctctccgttgctctctctctctctctccccgcatgaagcaaccaatgccccctcctcaaatccctcgaaatccattcaaaatccgatattcttactccgattttaagcccttttgagtaggagcccatcccataggtatatttccttttttaggttttttctcgtgtttgcatttagttatttccatccttctaaattgcagtgaaaacatgtaacaaggaatcgaatatacttgaaccattcatatcttcaacacataaatcaagtccatcaaaaccattctaaaatggattcatccaaaccattcattactatgtagttttctaataataccatagatattttatccgatctttatccgtttagtaccaattttctaaatacaaacttgttatattcatcataaaccacaatagtcatgaaattaataaaacaataatcctaacacatgaaattttcttatcgaacacttgaaattatttcttaaaaggcatgaaataaatagggctagctgcattgtcaagccaatgagccggacatttcagctgccacgccatggaccctgacgtggcaataagttctacgttggcgctgcttgactttgtccacgccaactactgccatggggcacctttgccacgttaagaccgatggcatgacagagtaatttggccatgcaggttatactggtgtgaaaaaaaaggtttatttttaaaaataagttcatatgaagtctattattaaaattatttattaaaaagtaaaaaaaaaacacatacacacgccctagctcactccagctgatccaaaatactactccacccaaacaaaccaaaaaaaaaactcaagttcgcagaagatccaaaccttaaacatgacacacaagttcatacgcctgcttggcagtagaccagtccaaatccaaccctgtcccccaaattaacaaaccccagaaatgcccccaaaagacaacaaagcactcaccacccccccaaccctaatcagcatttgattttgatccatcctcatcaacccccactattaatcctcttccccttccccccgctctccgtccatgttcaccccgcccccatgccccgcaatcccatccaggttcatccgcctcccgtcttctttttttttaattcatccgcaaccactgcgaacttgcgaaggccgcgggtacaagaaaagaagagaaaaataaaaaggagccgcattataagtaggtagtggtggtggtggaggaggaggagagcaaatcgaggtagcca

SEQ ID NO: 10148 - DNA, 1501 bp, Oryza sativa
tggatatttctacgaatatttatactacttaaaaaatacgcaggagggatggtgaaccaatctagacgtactgacaccgcaccccgcgcctccccctctcacgaccccaccagcgcctcctctcacgcccgcacccgtgccctaaaaacggcccgcccctgccgccacgcccacaccgccgcccctatcatgcctgccgctgccgctccgccgcccctctcacgcctgctgccgctgctccgccgcccctctcacgccgccgcccttcgtgccgctcgggaggagttgcggcggggtcgagcccctcatcgccgactacccttctccgctcgcagccgccgtcgtagcgtgcgtcgtcgtcaccagacaccagcgatcaccattccctctgtgtcgcctcgccgtccgtccatactacacctctgccgccgagcagccgccgtcgtagcgtgcgtcgtcgtcaccagcgatcactattccttcagtgccgcctcgccgtccgtctgtactccacctctgccgccgggactcagggccgctggccaccatctcattgtcaactcccccgaacagatctccccagccgcggtcgctggttcttttgctgcaaaactaaaatggtcgggagaacaccgatgcactttattttttatgacctatacttgcctgctcttttctgctcactggggatcaataggaaatgaatttcagaccgatactagcctactgttttaagtctctgcatatgctgaatctgaaagtaccagcctgctcttttctgctcgttggggatcaataggaaatggatttcagaccgatactagcctactgttaaaagtctctgcatatgctgaatctgaaagtaccacttatagtcattatagaaccaaacaggttggagcttgcatgctcagttgtgaacagatgtatttaggtgccagtcttgcccctggctgtgatgcacaatagcagggttaatcttgctaaaaagtaattttcttgaattgtatatctgttcagattaatgagccgagcaaatttctgttgcagatttggcctggtgaaccttatgcagttttctgttgcagtgttgctgcaatctgacactaggtgagttgtatctgctattccttttcctggctatttccaagttgcagtattgcaagatgataactttgttttaccatgttttctttgccacttaacaaacctaaactggtgagtctgttaatagcaaggtattctacacaatttggtccaatatggttctgtagcccttcatatatatgaagatttctaaggatgtaattatgacctaattaatttacttgtagatatagaaatttactgtcatcagatgcatacccattttaagatgtttgaacttatctcaatgtttgcctgccgctgttttttccaataaactgttgcatacaagtatattacaacatacaccagtgaaaatacacagtaaatgacatacaagtaatagtgatgactt

SEQ ID NO: 10149 - DNA, 299 bp, Oryza sativa
aactgttacgaaagattgatatacaaacatcattatttaatggttaaaccacgtgcctccacaaggataataagttactgacctacagaaggtttctctacactaaatttttcgtggctgttctgcttttatttttctatttgtgttgtttggctttcgttcttttcttgatgaagagtcgtcagagaagcaggttatttatagtaattcgatccatgctgttgcctgtaaatctttcagtttcatcatatttttgaatcattcatatgttttgctgtattttatttatcatatacagg

SEQ ID NO: 10150 - DNA, 1501 bp, Oryza sativa
tattattttgtttgcaacttgcattagtggaatcacacacttaacttgcttggcctcggtttgcgtgccagaccgacggacctacccagtagtcacactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaagtgcaaccacaaggtggaatgggacaccctggctaagtaactagacggttcagggaaacctcgcatgccaatagttgggaacgccggggcggggtcggacaaaccgggttcctggtaaggcaagaacgagaagcttgctcacttaccgatcaaggtggttggagtttgatttgtgcacgcctaaaaaggcctatgtttatgagaggatttgatccttctatgtggcatgaggtaaccctgggtcggctggggaaaggctttgtcgcgaacctctgacaccggccagtgtctagagtaagttcgtgtcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattgctaaatgagttgttgaaaagcatctcttaaagtcgaatcgagacgcaagtctcttttcgcccaaacatagaaagaaataaatcacttagtgatttcaaaatgtcttcaaataaaagatttgcaaaacaaccttgcctctcttccaagcttgcattaaacacctaagttcccgtgacttgctgagtgcgaaagtactcacccttgctctatataaatatatacatagttcctccgccctgaagagaagataaggtgaagtgaagattagggtttcgtcctggttcccagccgtcgcctgtggtgttgggtgttagttcgttggttccgctgctgctgctgttgttggtgtttcctcgtccgtgtcgtcggttgcattctcgggttgttctgagctgcaacctaagttaaggtaaataagtcct

SEQ ID NO: 10151 - DNA, 1501 bp, Oryza sativa
cgtggctgccacgtcggcgccacctcgacgcgaccgggtcaaaagctgacctcggtcagccgcctccctccgtcccccaccctcgcgcgcggtccacggagagccgacacgctgcgcgtgggcccaccgcacaccgcgtccacccgcgcgccgcgcgtggaccgccttcccccgaaccctagcgccgccctcgcgtgcgcccatcccaccgtgggccgtatcaccgacaagtgggccccacccgggaccccgcgtggtgggctcggtccaccggaccgccccctctccctcccgcgcgccctaatgggccgcctgtttgcgcccgcgtcggcccaatggcttggccgagcctccttcgacccttgggccgcgccaatgccaccgaaacaagtctagtttacatccctccttcaattctctttccagaaaggggtttaataaattattaaatcctttcttctttgattagaaaatccttaaaccttagaaaatccatatcttcccaaccgctcatccgattgactccgttccacttccagtaattccgtaaaattgagatctatttaatggcactaataattagtctaaataggatctttcctttggtcttttgtttaggttttcgattgtttgcgtatagttgcggttatcggattttcgtcgatcgcgggttttcttgaagattcgtgaagcttcgtgaagaccttgagcaaggcaagtcaccctttgatcaattgcccctataattgaaaagtcattattattttgtttgcaacttgcattagtggaatcacacacttaacttgcttggcctcggtttgcgtgccagaccgacggacctacccagtagtcacactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaagtgcaaccacaaggtggaatgggacaccctggctaagtaactagacggttcagggaaacctcgcatgccaatagttgggaacgccggggcggggtcggacaaaccgggttcctggtaaggcaagaacgagaagcttgctcacttaccgatcaaggtggttggagtttgatttgtgcacgcctaaaaaggcctatgtttatgagaggatttgatccttctatgtggcatgaggtaaccctgggtcggctggggaaaggctttgtcgcgaacctctgacaccggccagtgtctagagtaagttcgtgtcttgtgggtaaagtgtacccctctgcagaggttaactaactgttcgaacag

SEQ ID NO: 10152 - DNA, 1501 bp, Oryza sativa
gtttgggcgaaaagagacttgcgtctcgattcgactttaagagatgcttttcaacaactcatttagcaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactctagacactggccggtgtcagaggttcgcgacaaagcctttccccagccgacccagggttacctcatgccacatagaaggatcaaatcctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattccactaatgcaagttgcaaacaaaataataatgacttttcaattataggggcaattgatcaaagggtgacttgccttgctcaaggtcttcacgaagcttcacgaatcttcaagaaaacccgcgatcgacgaaaatccgataaccgcaactatacgcaaacaatcgaaaacctaaacaaaagaccaaaggaaagatcctatttagactaattattagtgccattaaatagatctcaattttacggaattactggaagtggaacggagtcaatcggatgagcggttgggaagatatggattttctaaggtttaaggattttctaatcaaagaagaaaggatttaataatttattaaacccctttctggaaagagaattgaaggaggga

SEQ ID NO: 10153 - DNA, 1501 bp, Oryza sativa
gtagcggttagataactccaattagaaagacatttatttatatccgttatgtaatgaaatactccacgtaggttgttacgccacgagtagcgacaaatttctccaacactactgggcaatgcttaatggaagacgactctaacacttttctatatataacaaaaacaacatatttcttatccactatcctttcctacgtggtgttcgtttagtgacgtgtacgtttactattggaggaatagtacgattttgaaatggaatattactagattcctacatcatattagattcttttcgaggccactttgttaccatctctctagtactaacatataacgtgaaagtatataccatatttctcaatcgagttctctaatacacgattttaagggttttctggggctaatcttttttttttctcttaactcttcgatttttttacgtccaaatgagtaataataaatgacgtgtaataacactttttttcctctaaaaaggcaaaataaaaaaaagaaaagaaaaagaaatagcgacgaaaacacaacacaaacgaaacgctctcgagccagagtcaccccctcttctttcttacctcccccaaaccctagccatcccgatccatccactcctcgagatttcggcggaatgcctccgccgccgccgcggtctcctcgctccctttccagctagggctctccctgcccacaccctcccccgcccgcgagatttgcgcgcccccgcccagcgccgattcgagctgctcctgctttgctgtttcggtgggggaggccatgaacaacagcgcgttcagcgaggagatactcgccgagaagctcgccaagctcaacaacacgcagcaatgcatcgagagtatcctttacccacccagctttcctcgtgctaaatcttcgcgagaatttgggtgtttctttaggggtgtgtgtcgatgtttcgtgtaaagttgcaatttttttttacacttcatatcttgcgccctttcacgattactgttgggaatcaagtctcccttcttcatttttccctcctgagactgtgtatcatacttgtatcatactatcgtgttatgtttgtcaatagctagcaacttccttcaactttaagtggatatatctacgagttgcagatgtgcgggtagcacgcaagaaagcatcttgtagcttgaacaagtgcgggttcttgtgtgtcctttttacaccattggtagagagggttcttgtgttgttagtagctctctgattgctatactgtttattagtaaacctaccgaaaataggtacatgttgacttagaatcctgtgacatatttaggtggcgcaaatccatggttttgtttgtctgaacatgtctttccatgatctaatttgttcccttgactttaattcttcgcgactactagctctttcgcattggtgcatataccatcggaagaatgcagagcaaattgtccagacatgggcgaagcagtttcacagctctggaa

SEQ ID NO: 10154 - DNA, 1501 bp, Oryza sativa; identical to SEQ ID NO: 6290

SEQ ID NO: 10155 - DNA, 271 bp, Oryza sativa
attgattgctcaaaaaatatatattataagacaagtagtttcatttgtaaaccatcgctccagagtatagaatccttatacgcaaaagaagttattaatcatccttcaacccacaaaagtcatgcagttgccaaaatggaaagttaaaaaatagaagatgttgcagtcgaccaatcaaaataaatatgatggtaaggatgggcatatagcaagtagacataagttttccccacaaaaataataataatagagaagatcactgaagttcaaa

SEQ ID NO: 10156 - DNA, 1501 bp, Oryza sativa
tccccaaagtatcagaatataaaaaatattaatatttaaggaggtaaaagcaacatggagtaagaattgtactgtagtcaatgaatatgtagtagcagagaaatgcaaggaaactaaaagtacatatgcaaaacacatcagcacacccttattgtttttggttacgtccaaacattacacttgtatgtaaaaccccaaatttcaagataataagatcacttgtgtacctcaaactcagcttttggacggataataaagtatttgtccacaatcctctgatccccaagagacaagtaatatcttattccacattgcctaactttaatccaatcatcaatttttatttcctcggaagcaaaaggtggcctaaggtacatctcaataaagctgaaaatacataagaaagaaactatcacaaattgaaggggcatattccccacaaaaaaaatgaaaatggacatatccacacacataagcttgataaaagtataaggggattgaatatcaaccaatcagatctagaagtatatatgaacattcatgaagaaatgtattaagtgatatatatgactcacttctcagtttctccttcattttgattaaaaaaatacaaattatgtccatctggtaactacaaagacataagcaaagttaaagaagaaaagaaggtgaaaatagtcggtgcaaaaaacaagcattagtaacagcatatcttgattgtcaactcttatgcagaacctcctttgttggaatactaaaaactaaaataaagtaaaatagagcctcattcaacgctaatttctggggcaaactatgctgacacgaagtgacctcatacattttggagccatttcaaataataaaaacacatgcttccatttcaaaaaatataaatgtagatttcaagaaactacaaatcatatatccctgttcaaagctttggcatattttgcattaagtgtggttgcttgctgacttgttgcattaaataaactacagccatgaaacaaacataaagcttaaacagttgaaaaggagacaaagcttcagttagatacataatatgttgtctaccgaccggaaaccaatgctgacctcgtttttgcatttaagcttgtagtatggttctcggaatgagcagacaaagctgttgtcgattctaatctgcactagcaagtagcaactcaaataaaaaagaatcaaatggtacctacagactataaaaaggcaaaaaaggtacaagatgtatacttgagcatgatgcaagtctggctcaatatgctttctaaacaagggaaatatgctatcaatcagatagtccaacgagcaagaatctccaatatcatgctggactttagacagaaggctaaaatgaacaccaccaacctgaagttcatgggtgaaattattgagataaaataactgttctataatgaaaaatatttagggcaattataatttttaccacagcaacacgaatatcaagcagtgacctcagtgt

SEQ ID NO: 10157 - DNA, 1501 bp, Oryza sativa; identical to SEQ ID NO: 4821

SEQ ID NO: 10158 - DNA, 1501 bp, Oryza sativa
cttgttccggatacattccacatggattcatagtcatgagtctattttctatgctcaaagactggaccaattattattccccgtaagggctatcaaccgaatacttgcgccagtcgggattcaattattatatttattttggagaatcccataagggataatcattcagatcataagctattcatatgagctacacttggtctatattacccggaagatttattactcgggagcatgttacacgcgtcatcctttaaagggtgtcgaaggcatattttttggcctaggcctaatatgtctgcagcccatattttcaggtgtggcctgtcacgttcttttagggacttaggcacattttgcttaggccaaagtgcgcgtgatcaagtgcccaataccttaaaatccttttataccgcagttactcaactttttaggagttggtacgatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgtatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcggtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccatatagtcgggggctacacctattaggtgcatctagtcgatgcacctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcacagttatccgactggctataggggataacttatatctatggaatatgtaacagattatgacttgggtattacgtttccttgtatattatggaacggcctaaagtcctggtttgataagattgtaaagtagacttaggaaaccgataccgtattggttaaggtttctatcttgtaaccctgccccccaacctatataaggagggcagggagccccctctaggggca

SEQ ID NO: 10159 - DNA, 1501 bp, Oryza sativa
caagaggagaagaaggggaggtggtgcaggtcagctggaaagatggcgtggaaacgatggctcctgacgagataagttgtggcagcagctcgatgaaggtcatgttctgcggcgatatcggcgttgcagcgacgactcttcggtgagataagctacaacggcttggcaaatgttttggtatgcaatgacgaaaacttggcagcagaggtcctccgatgagataagcttcggcggctcggcggaggtgggcgatggggcaacaaggtgtcgtttgcattgtggggtgttggttgtcgtgtgatgtggtgtcggtgtagcagcgacgacttttggtgagataagctatggcagctcgacggaggtggttctctgcagcgacgacggcatggtggcgatagagtcgttagcaccacggatgagtaggttgttcagacagcatgagacccttgcttggcaactataaggtgattggcggactagttttgttgcctttgtttgatctttggtggaatagagaagcttctgtggtggttgctgtgacagcaagggggtgtggaagggcgggctagctccgcatctacttcaagtttgaaaaagattagagctagtcttctagtttttttttcttttcggttgttcttttccatgtttctcgattatgagttttagagtgtatgcactcgtgtaaacctttggctatatatattcactttgaatatagagaccggattttatccattatcaaaaaaatgtaggagcagtagtgcagtaccggctgaaccgttcattggtcggtatggggaatatatatatatagtatatggagtagtctttttgttcatgtgcagctcacatcacatgctttggatgacaaaataatgcttgcttaggataggaagaaggaccgatcaccaacatgactccttgaaatcctttggaaactgcacaacattatacccccaccatggcgcactctcagaatccaaggcaccacaatgcatttgactagtgatgaaaacggtcgaagacaacattattgctagtacattactgctagtacattactcctttttatagaaacagtttcggtatagttaggaatttttatactatttataaatttaactatttattagcgttgacttaagcatgttactgataaaacatttttttttaaaaaaaagggacttttacgcatggttataaacagaaaagctaaaaacatatagtactacttttacagaaatggtaacatttttatctctacatcatggtttattgtctatatttaccaatttaatgatgacaatattaatgaaaatgattagaatcgggcgtccggcgtggggggagccggatcgggcgctcccccgcgcgcccctcctcctacgtgcacacctattggacccacttatttctctctcccccttttccataaaagatgtttcacctagtgtacttacaatgtttcactaataaatctaatattgcagtgaattaa

SEQ ID NO: 10160 - DNA, 1501 bp, Oryza sativa
agggttttccatgttaaatgtcgtgtcttttgtgattgatctatcgttatttatcgtttatttgctgatcatttcctaacaggcgcgatagacgacgtaccaaccattgctatcctggcagtggaagaagacgatggtctcgtcggcccagctcggctagctgccgtcatggacggcaagtgatcgccaggacccgtaagcggtgcagaagacgtagatgtcagtgcgaaggtcctggacctcacctgtaggtgacatgggaccggggatatcttgactagaggtttggggcagccgcggtcacccacgtggcctgaccccctcgggggggtcgggcccgagggtgaagaggccgcccctccctctatctctccgaggggtcgggccgctcccgtttcgtccccgagggctggggcgccccgaccccctgagggtttggcgccacgtgaatgggttaggtgagcacagcggcgctcacctaaccgcgtttattgcgggttggacgagcgcatcacgccgcatttaatgcagtatagcgcaggcttatccggtccgtgacaggtcgcagtgtgtgaccggtcacagaccggtcagatcgcgggttaaggggcaacaggcggcctgacacacgcctccaggcactcgtccctagtcggagccggcgtggggactcctggagttggcacatcagccccagccagatacattccaggcttcatcgcaatcattgcaaggaagccattgtatgaagaagggcagacgtgtagcatgctaaactgacacgtggtggacaagaatgaccggtctgtgactggtcatacgccggttgcgtcattggcaaacaaccgtgcttccacgttgcacctgcttcagacggagtggaggttggtatgacccatcccatcggagggtcattcaaacagcagccattgcaaatctccgcccattaatgagggaggacagggctatcccggtgtcagacaaaagtacgagccaaatcttgatcaaagtaggatgggtccccacccaaaagaagggtaggtagaaatggtatatgtggtatccccttgagatataaaaggaggaccatgcctaccaagaaaaatgggagggagaagatctgagctcgtagaagggacggaaaaaaaaagagtagggagagggtctctagagttcaaacgctctttctctccagttctttgtaactccttcatacacagatccaccagaacacaggattagggtattacgcttctcagcggcccgaacctgtctacatcgcccgcgtcttgtgaatttgctctctcgcgaaccattccacagatcaagggcttagaacctcacttagcgccccaggccgaaccggcaaaggggggcccacgcggtctcccggtgaggagccccacgctctgtcatctggcgcgccaggtaggggcgcgcctgtgtttttctaagccctcgtcctctttcgtgtgcgccaagcttctcccgctcagcccaa

SEQ ID NO: 10161 - DNA, 1501 bp, Oryza sativa
atattgaaaataaatgttattatgatatcatggaaaaaagctgaaaaaggagggttactcgtaacagaatttactttgtgtaactagggtataaattgaggttagtaatcttcattttatcgtaatataatatagaattcaacctgtgatgggtaatgaataccctaaacaaaaataaatacttacctgaaagctaggaaattaaaatggcgcgaacatgcaagccaaagtaatatggtgccttcttctctttttagtgaaaattcagtttatcatacatgacaattacaagatatgcacatttgtaatataatgtaacgagaatgatatatatcctgtagttacagtattatattacacacaatgttatactaactcgggacatggttgaaagtgaaaccagagcgtccactattatttttttctgttcatgaaactatggaagtgactttcacgtgccatatatatatgttgcttcaagttaataacgttaagttatacatttgctttcttaccccttttctttttttttgagggaatttgtagccttttttcttcaaagaacttctccgtcatattcttagcatttttttatttgcttagagttgttctagttatatatcatgtaatgtggtagctagatatattgatatatcatattaattaacagttttcatggacgattatctggataaagcttacaaatctatctccagccttgagatgttggttatctagtaggagatatgatatggatgcatggtgaaaattttataagaccgtgaaaaatcgctacgtctgatttaatttggttcttgatttaatatatattcaccatgaactgaatagtgagttggagtactggccacgcggtactagttttataaatttgagaggtgaaaactatacactatatgtatacaacacttgcttcagaccggacaaatatctattgccatatacccctctgtgtttatgtctagcttcttttctttttttttcttttactttcttatattcttgcataatgctatctattacaatgacatgagcaaacttttttttaatatatatatataacggaaaaagagcagactaattatgccgagaccaggagtacgcatgctagctaagtgctttttatttattttttttaaggagaacgacggcaggagatctgccagaatttaaattaggggaggtgctttttattaccttgatgttattgataacagaaacttgtgctctttcatgcatgccatacactgagatggaattcaatttacatatgtgatatcatgttcactcgaactgtcaactaaaatgtacttgtagcccatgatctttaaaaaaattgtttaagcagctatttttatttctttatttgttccaacttccaaagagatggtacaatgcaagacccaaggtacagtgaacaattaattaattatgcaatacaattttggatacttatatatagtcgcactatcgcgagatacca

SEQ ID NO: 10162 - DNA, 1501 bp, Oryza sativa
cctccgtccccgcggaaggataggtggacggggacgagagcagcggcttcgaggcgagcctctcctcctcctcctcgccgccgccgccgaggtcgtcggggtcggagggggaggtggtggcgtcgtggagagggagagccatggcggagagggtggggggcttaggggcaaaccctagcagtgggtaggcatgaggagatggcgacgagacgtggaggagatggagatggcgtggtcgcctcgtcggcgactcgtggaaggagaggaggcgtggggatgggggagatggaaggatgaccgttggatttggatcggacgggtgaatcaagcggggcggtgatctattccattgtcttccattgggcatttgtaattttaccgctagttttctcaaatttgcgatgatatcacttgaacgatggttctagacttctagtgttattttttaatcttttactagcgacagtcttaaaataacgattcaaatcagtggtaaatttacagttttctctttcattggtttcggttgatcgctggtatcaaactggattaggactattacccatcttagagcctgaaccagtataaaaatccacaactcccatctttttacgactacgtataacttggtatcaatgtctcgcatactatacaaataccattatggtacaacccatcgataataggatgttctactctatataattaaatttgttgaaacaacacgactcaagtttaatggtgcttttaagttgtcttaacattttatctaactaggtgatttcacgcgctttgctacggcaactactaagcaatttttaatatatttttttcgatgatcgagctaggagtaaaaggaaaagaaaataatgaaacatgagggtttatcaatacttatcataaaacaaacaaatgatagacatatttgttaaaatattgtgaaaatgatgtgagggctgatgattagatatacattacagatggccaaaaggcccgaggcccgatggcccggcccatggcacggcattttggcctggcccaagcacgacccggcctgaccgccgggccatgcctgccccccccccccccccaccggcatgttgggtcggcccggcacgatgggccggcagctaggcccgacacacagagaaaaggtagtaaaaatagacatatatatgccactttctaaagaatagggatatatatatatatatatatatatatatatatatatatatatatatatatatatacatacataattgtaattctagagtactaattgcccaatcaatcatatctcattcaaatttctccctattttaccctcaaccatcttcccactctcacataaacaccatttaataaggggcaccatagtctttcttctgaaaccttaatatatgctaaacaatatagaattgcaactattttgggacggaggtagtatatcacagcccaaagaggagggagggaaaatagacttattgaaaaaaaggca

SEQ ID NO: 10163 - DNA, 1501 bp, Oryza sativa
ctacctcatttcaattgagtttcgatatggcattttattgtatattccaatatggtgcacatggcatttttttcttacaggcaacattgcttatgtgatttttctgctctaatgatttcctgcttttggaatttactactgatctatccttttgaattgagattttgctttcatggacatgtttataaagtgatgattatatttattcattataggatcacttgccagtataatttcattaagataccatcttttgaccatgcaatgttttgtgcaaccctttttggaagaggaggatatatatgccatgtagaacttacatattattttttgcaaagcaattgctatgttaaaagattgcaacaattgatgaagagaagtatgcgatgatgttgcaaataaagaaccacctttttatgattgtggttatagcaccgtttcagttctctgatccactccattgtatgtttacagtattttgttcattgtatggttgctaattttgccgaaatgcacatgattgtacaaatagttcatagacagatcaatcggagcaattcatatttgaatctttatggaaatcctgatgtatgtgccagtttgttttcactgaatgttgacaactatgtatatatcgagcatgcagtgtagcgcgtgatgattgctagtacttatcatataccaagtgtaatcctatcttaccataaagttgatgtccactaactcataaatcttaacatgcaaccataccacatcgtcatccacttgcaataattatatatttaaccttatgcaagcatacaacatcatctataatttatttatttaattctacaaatcaacatgcaagttatagatggccataaggcccgcccggcacggcccgacccaagcacggctaggcacgacccaccagccatcgggccagcacgacccggtagtcacttcatgccgggccatgctagcccatgggctgcacctccggcccaggcacaacccaccaacagtcgggccatgccgtgccggcccaaaggcacgggtggcccattgtgcctttttttcaataagtctattttccctccctcctctttgggctgtgatatactacctccgtcccaaaatagttgcaattctatattgtttagcatatattaaggtttcagaagaaagactatggtgccccttattaaatggtgtttatgtgagagtgggaagatggttgagggtaaaatagggagaaatttgaatgagatatgattgattgggcaattagtactctagaattacaattatgtatgtatatatatatatatatatatatatatatatatatatatatatatatatatatatccctattctttagaaagtggcatatatatgtctatttttactaccttttctctgtgtgtcgggcctagctgccggcccatcgtgccgggccgacccaacatgccggtggggggggggggggggcaggcatggcccggcggtcaggccg

SEQ ID NO: 10164 - DNA, 1501 bp, Oryza sativa
accagaaatacaagcacataaatctataaacgagtagcatacatttttccacacaccaatgcattgtacatcgctacatatatatttgtccaatactcaccccagaaataaacaagtgtggtcatttttaagtattgcttccatacatcgtcaaaactaataaatttctattgcatcatggtatatctttagaagccataaagttcatctaaatttgaggcatgtcatctttagatgatataaatatatataatgtgcctggtttatagttagttctagactccattatcaaaagttctacaagatgagtatacgttaattacatttagaataactttagatgcatatgtcctctatatctatatatacttcccctttaatttctccatatttatttatctatcaccatttggctagatgtagaaatcaaacggcctgatgcgtcacgagcttttgcgtgtttacatattattgatgcaattaagagcaaaagaggtgatcatcaagaggacggcccatggtttcactccacctacatatgcggcgaccatacaatgcagggctgaattcaagtcattttttgtctctttctaacttagtgtttctgttgagtgtttgacacatgcagtgagatgatatttgtccgtatccagccaagtcaattggctcttttcttttcttgcaatttttctttctttaggctgtttttgacacacgaaacgataggatgtattagcacataattaattatgtattagtaaaaaacttaaaaattacattaatatatttttaaagcaatttttctataaaaaatacaatgtttaaccgtttgggaagtgtgcatacaaaaagaagaaagtgtgagttggcaatatagacataagaatacaaccttaaaatcgtcaactagttgggtgggcggctaaaaaggtagcctccagctacgaatgctctcgaactttcctcgactggtagtatacgtacaaagaaacatatatagacaaagataatagcgtaagccatgtatagtattactctagtagtgcaattaaatatatttattatttctttttggaatgaatcaattaattagaaggcatgaatgctatactatgtctttgctcacggctggcactgagatttcgcacgtttcccacgagtttccaaagcacctctctctttaattctcaatttctcatatagtaaatgaattggatcaggcaaataaaatcgtcgttcgatccaagcgtggattagatttttttttaaaaaaatggtttgatttcttttcatcgtttctaccgatcgatgtgctgtacgttctcccattggtaaagcgaacgacgaagatgatgaagaaaacagaagcaagatatatactgtatatagatgcatgcatgagacaaaataatttattaattaaagtgataatatttcagcaatgtgtactaatttatatgtacacgtatgatactggattattggtggtaattaacaaaga

SEQ ID NO: 10165 - DNA, 774 bp, Oryza sativa
gtgggggaggaggggtgtcatggtgtgctgcttcttgtgagcttgcagttgtgctgtgctgttccaggttgcatgctgcaatgtatagtaggagtaggaggaggagcagcagtgtgtgtgctgtgctgtgctgtgctgtggctgcctcctcctttagccgaggagaggggattatcttaaagattccagcttttgttattaatctcctcttttctggcccattgttccccccttcccttccccaccaccccctatttctgtgggaaatgccgggggcctcgtgatttcatctttttcttcctcctagcaagcactctcttgttcttgttcttcttcccctttttggagagtggcgatgtggcggggctggatctgtcgaatccgtaggtgtttctttgatcctgaatcgcggaaagttttttttttccctttctgtttttttttgggttctctctttgttcgaaaggttcaggtgggtttctgctcgatttgaccggctggttcatcggtgccgctttgtttttatctcttctttttttttggttggattcttgatcccctcgagttgtttgtttgtgtgaatgaaatcggagtgactgtggaacaaaccctagttgttatgttggtaacatggtaatgctaatggggaaatttttctctccttttttttcagatgaggaattattgaccgccctgctgaagtactgaatttgggggtggagggattttgttcaccttgctgtccgattccgcgcttgattgtttctgataaac

SEQ ID NO: 10166 - DNA, 1501 bp, Oryza sativa
caaagtagaaatacaattaaaaatagctgaaattcggaatttaaaatatgcaatatggaaagaggagtccatataggaacccaatacgtgattaatcaaaattcgaaataaaaataaaataaaatccaaaattagaaaaggaaaggagagtccaaatagaaatacaatttaaaaatagctgaaattcggaattaaaaataagcaatattgaaagaagtttccatataagaacccaatacgagattaatcaaaattcaaaataaaaataaaataagatccaaaattagaaaaggaaataagagtccaactaggaatacgatttaaaaatagctgaaattcggaattaaaaataaggaatattaaaagaagagtccatataagaacccaatacgagattaagtaaaattcggaataaaaataaataaatctaaaattagaaaaagaaaataaaagaagagttcaagtaggaatacaatttaaaattagctgaaattcggaattaaaaataagcatactgaaaaaagaatccatataagaacccaatacgagattaattaaaatttagaataaaaaataaaataatatccaaagttagaaaacaataaaagagagttcaagtaggaatacaattttgaaacaactgaaattgaaaataaaaaataaaaacattaaaataacacaatacggtattaaataattttttaaaaaaattctaaaaattagaaaaataaaaataagatttaaattagtaatacaatttataaataactaaattttttgataaaaataaatattattaaaataaaaaaccatctaaaacacatgacgagatatattaagtaacatgcctataaaggagtagagtggtgacggttgatatgacatataaaaattgttaataaaacaccaaatagaatcataatgacgattaaaaggagagacgtcagggaggctgtgaagcaataaaatttagaataaaaaataaattaatatccaaagttagaaaacaataaaagagagttcaagtaggaatacaattttgaaacaactgaaattgaaaataaaaaataaaaacattaaaataacacaatacggtattaaataattttttaaaaaaaattctaaaattagaacaagaaaaataagatttcaattaggaatacaatttataaataactaaaatttttgataaaaataaagattattaaaataaaaaaccatctaaaacacatgacgagatatattaagtaacatctaaaaccgtgaagcaaacaagtaaggcggttgccgggacttgtagaaagtaaaaaaaaaaattttagaatcacaatgacaataaagagtaggtggcggaccggctgtagatcggggacatagtgacatcgtttgatggcacttctaaaaattattaaaaataaaactacaagtccaatttttaaaggttcggaacttctgaaaagtaaaaaaaccaatgataatcatattcgattttaaaatcaaa

SEQ ID NO: 10167 - DNA, 1501 bp, Oryza sativa
atagtgttttattctttttatttatttttttatcaaaaatataatcaactaagatcttattgtaaagatttaattgcaacagatataatagtgtaatcggattgtagatttaataaatatttttaggagaaaactagtttgaatctactaatgcatgcatagcttttttttttctacatacatacacacttatatattagagtgaagtactaaggagaaaagtaagagagagagagagaaatgtgcaaccatgcagtaggctgagagaaaaaaaataagacaacagctagacatatactccctccttctctaaatgtttgacgccgttgactttttttaaacatgtttaaccgttcgtattattcaaaaacttttgtgaaatgtgcaaaactatatgtatacataaaagtatatttaacaataaatcaaatgataggaaaagaattaataattatttaaattttttgaataagacgaacggtcaaatatttttaaaaaagtcaacatcttcaaacattttaggatggagagagtagtatgtaggtcgtgagcagatcacgtccgattttgtttggtgcgtcggacgtccgaccgcaagcattttccttctttttttgcaagttaaaaacttctgaacttatttcttcaaaatcagtttgaaacctcccagtttttttttcagctcagctttgattgattgagctatgactgataaaccgtagaaatataaaagaagcaatagaaaataattgatgaatcaattttttatatgtgttattagcggattgggttggaaaagaagtttattatgaaaaaaaatactctaaaatatatttttaaaatggaaatgtacgaattgccccctgaactatcgcggtcgtataaattaccctctgaactcgaaaaacaaatattttgcaccctcaactactaaaaccggacaaataaccccctctactcaatctctggagtggtttttgatctacgtggcatacacgtggcaggcaagtcagcactcctttaaaaaaattcggtggggcccacctgtgcacccctcctctctctctcctcacatattcatcccctcccctcgctaaagcacgcagcggcggtggtgggcgcggctacgacggtggctggctgggcgagcagcggcgacggcgggcgcggctgggcgggcggaggcgactggctagccaagcggctgcgacggcgggcgcggctggacgggcagaggcggctacggcggcggctggctgggtggaggactctcctctgccgccgcactcttccgtcgccctctctcctcctccgccgccacgctcttctgtcgtcccctcgcctcctccgccgccgcgctcgccttctccgagacgcgacagcggcagcacacgggcgcaggatgatggcgacggatgacggcgcgcaggtggggctcaaggcgacaacgacgacgggcgacggacgagggcacgcgatgcgggcggggcccgaggggaga

SEQ ID NO: 10168 - DNA, 1501 bp, Oryza sativa
taggttagtttttctgtgggatggagggagggtggtatacgtcgcactcaccatcgtccgtcggtggcctttgtcgcgtcggccgcgtgttacagacttacaggctcgtttttaaccggagcgcgacactggtaggctaccggtgcagcacagcagcggcagctgcactctggcgccgtgcacgtggaatcccggcctcccgactcgcggcaacccaccgcgcgcggcggcgtgttggcgggggggcatctcgaagcttcgggcccatgcatctccccaatctgccgctcaccacgtggttaaaaagcttccggccggtgggtgcacagccgtcggatgcgggatcgggcggtgggggagacgcgcgaggttgcgtacaaacctccggattacaccgaggttagcagcagcatcagattcggggggacaatttttttttttttgctttaaagtctcgtcgcttcgtcagcctcgccgcgcgatggacggcgccgtcggcgagcccccgtccatggctgacgctacgtactactactactaacctacggagtagatttttgcggagccatcgtttcgcttatctacgaaataaacgaaacgatatatttacaaacgaaaaataatttgtgaataaaatttttatatacgtattcttagcaattactcccgctgtcaggtggatgtgaaatatcttattactacgaatctaaacgaagagtatgaacaaattcgtatagtagtaggatgtgacacatccaatcaaaatcacttatattataggatagatggagtaaaagaaaaggctgaaaaataaactttgataaaaaaatctcaaaatctgcttcaaatttaaagttaaaaatttaaattttgacagataaatataaatataagtgaaaagatgatgcccttgaattttcgatggactggctttttggacagcattttggtgcacgacatcggctgcaatttcatgggctccaaccgaaattcggcggcagttgagacctgtgtcctcggcggttgatgacagttgagaaagttctcaccatcgcactgactcagatatggactagatctagggccagatatgaccttttctctggagtatcaagcttttgaccctcgaaatacgatgcctcggtattcgtcatatcagcttctctcttcttcgcacaacgctagtactccacgttgcccacataaaagtactctactctattactagttgcttggatgcttagctacactctgtaaaaacttctctttagagagcaaatcattagagcagattcaatagtagactataagccaactataaatatattttaaaaaaaataaagaaagtttgagaagagcaatgggctacagatatgtagccagctgcagcgcggacttcaagacataatgtgtgtatgacagatgggactaggtattaatagaatagtaagtaactattatatgaattggctagagatgatttggagctagtagttagcta

SEQ ID NO: 10169 - DNA, 1501 bp, Oryza sativa
catgcagccagtgacacggttcaatttcatataggaaaacactgtcctagtgcctaatcagtcaaccaaacatgctttgctacacgagtgattctcagtaccaagcagcatttttacctgatcggcgaggtggagcctccgggctgtcacgcttccaagtcctacctctcccttcgcagaacaaatggaatagaccaaatttacagtttatccatcaggtaaatcagcggcaaagccataattaaccaatcaaacagcacgacgaagctgcagcctgcagcaacctccaactcccctcaatttacctgcacttctcggatacgctcctggattaaccctcgaaaccctactcctcccttccacataaaaaaaaacaacaaccaaccaaatcccccatgagaggcaagctacaaatgacagccccgattaaccaaacaatgagcaatcccgtggaaatgcggggtactaccggaggcgccggagctcctgcgggcggcgccggggtcggcggagagcaggatgggcgagccgatgccgacgcgcgagcggaagtgcgggagtgcgagggctcctccctccatcgttcgctcggggttttggctggggatggcgtctcgagcgcgagtggggagcggagcggagatgaggcgaggaggaagacgaggagtggtgatagagaagtatcgtagcgataaaattgggccgggcttatcttcgtggaggcccatatactctcctcgtggaggacacgaatttatttagggcccatcaaatttatgggccggattttgaaaagctgatccagcttttcacgggatgggccgcaaattgtaggaatcagagcaatgcgtggaattaatcacgttcaatcctcttaatcatttttatatgggattaattgaacaagccctaaaatgttaagaacgcaaataatcatcggtgtaaacggcaaagtataacaagacaccgttaagcacatactctataagtgtataacattatcaaattgcaagtttctttttctcatgatccttgttatcattcaaggagtaaaaaacatagaggtatgttacagttactgagacctacttttaagagcagatacaggctataagtcagctgcaaatatattttaaaaagataaataaggggagagaagagcagtgggctacagatttgtagccagctatagtatggactccaagatgcagtgtgtgtatgataggtgggaccagttattgatagtgtagtatgtaactattatatgaataagctattaaattggctatagataaattggagttagtagttagctatactattaaacttgctctaatattacagttcttatttttggcataactttatccgcttaggcttttaagcccaatttttttgattttgtacttttatatcgcttgcttttaagctagcttaccgttttggaaaagctctgaatgaaacggctactagtttaggctacaagttaaaactattttta

SEQ ID NO: 10170 - DNA, 1501 bp, Oryza sativa
gtccgatgagctgacgtcattcggacggcggccgccaccggccacggtggcggtcacctcccggagcatcagccggaggcatctcctgtacccgccgacggccatctcgacgagctcgacggacctcgccttctccacctccgactcccgcagcgtctgctccatccgcgccacctcgccggctctcctccaggcctcgccgtcgcgcacgccggtgaagcccacgccgccgtcgcgtggcctgaccatgtctccggcggcggcgtcggcggcggcggatttcttgatcaccatcacgtcggtcaccgcgccgctgatccggaacgaggcatcgaggagcaacccgcttggtatgtcccagacgctgacctcgccgtcctccgtgcacgtgacgaggttcttgctcccgttcgccatgccgacgccgacgagggcggcgttggtgttgccgcttgcgtgccatgacgagctcgtgatggcggcggggcttagggacgcgacgtggacgcggccgtcggagccgccggcgaagaggcgggcggcgaggtggtccagggtcagcgagaacgcggtgcatgggagcgtgagggtgcgcaggtggctaccgtccttgagcgtccagaccttgcacgtgccgtccatggaggccgtggccacgacggcgtcgcacccgccgcgcccgcacgcgacgcaggtcaccggcgcggcgtgcgccggcacgcggtagagcgagaggtcggcggagacgctggcgtcgtcggcgtcggcgtcgacgtcgaggacggagaggagcacgaacacggctacctcgccgtcgtagccgccggagacgaggagcgagccgtcgtcgctgagctcgaggcacgacacgggggcgctgccgccgtgggcgcggaaggagcgcgcgacgtcgcccgacgggagcgcgatggcgtggacgcgccctgacaggccgccggcgaggaggtgggagtgggagccgccgcgcggcgccgcgacgagcggcgcgaccggctcggggaccggcagcgaccgcgcgggcgcccgcgaccaccagtggaggaggagcacggagccggcgcccgtgacggggcagacgtgggacgcggcgacgaagggcgccgcggcgcccggggcagcgacgacggcgaggccgtgccgcgacgtgttcaccggcgccgggaactcggccacgacgtggcccgacaccgcgtcgtaggccgtgaccggccggccatggcaggccgcgaggatgagctcgccgtcgccggccagctgctgggaggaggaggaggaggaagaggacgccgccattagcacgcggcgaccccgccgtgctgcgtgtcgcgggttcgccggtgcaaactgaagaagggaaaaaaaaaggagtgtgaagtgacctgtttggctctgattatttgcgcttttataagtataaaaatagttttaacttgtagcctaaactagtagccgtttcattcagagcttttccaaaacggta

SEQ ID NO: 10171 - DNA, 1501 bp, Oryza sativa
tacgattaatctggacagatgaatgtttaaattcgtagtaatagaatgtgtcatatccggtactaggttggttttttataggacggaagaagtatgtaatgttgttactctctccgttttatattattagtcgttttatttttttctaatcaaaattgtttaagttggatcaaattaatagaaaaaaatatagcaatattttcaatattaaacaaatacattattaaaatatatttaattttatatttgatgaatctaatttggtgttataggtgttgctaaaattttatataaacttgattacaaattgaaataatttaactagacaaagttaaatcgaactatactataaaccaaaagtgagtatattttaagaatgaggaaatagttcaaaatgccaattcactcacataatcagattaattccgcaactgttactatcattcagctcatgcacgtctcttttctttgtcttgtgtgtaacgaccaggagtaagcgacgaatgaagtgcaactgttgaagaagatggagagtgagaagtggaaaacaagtactcgtgaactcgtccacgcaatcatcaggtagcaagtcaccatgggattcctacctcacacgtgagcgctaggaactgaagcggcacgcgtttcaccgtatttatagcgctttagcgcttagttttggataaaaaaaagctatatacatttcttctttaagataaaaaccgccatgcgtatatttcttttttttaaagttgattgcaactttcaactcagatttatcaaggatttgaaaatttttcaactaatatttgaaaactttcaaggtttgaaactctaattgaaaaattttcaagtcaatatttgaaccctttaaacttaaatttaaaaatttttgaactaagaagatgttgaaactttcaagtctgatttgaaaactttcaattcgaatttgaaaactttcaaaccaagatttgaaaactttcaagtcaggatttgaaaactttcaaatcgaatttaaaaactttcatctccaaattcaaaacattcaactcaaatttgaaaattttcatctcaaaattttaaaacttttaattcaaaatcttaaaaacttttaactcaaattctaaaaaaaaaatctaggaaaaaatcggcagaaaaaacgagaaaaaaacgcgtggagaggcgcagacgcgccagccacgcggcgtgcgcgccagcaaggtaactggtgcatcttcgccaattagcttttccgaagtcaccaagacacaattgggacctggaattattggcttctctagttctctttccaacttccaagtagtggcagatcagttttatacgagaaattcagagatgctttctcagcattcttgtagtacaaattcttgtgaaatttatgtttttctccttcttctgaatatctgtgctagccatctgtaggtagatgattatcagcgtgcaagaaatatgtcaggtagagtttatcccaacaaaaatt

SEQ ID NO: 10172 - DNA, 845 bp, Oryza sativa
gagttaattaaggctacacctggttctcgaccagaggtgtagcgatactcccactacctttatttatagtggtcgagttaaggctacacctgaatatggtcatgtaagatctggtcatgtaagagcaacgaccatgtaacgaccggcttacacgaccatcatgtaaaggaagggagtgcttgaacctttaagcacatgcattagtttgaatattgtttctcctgcttattatgctcttatgtgttatggttctgatgcttctactattgatacaatagggaaagtcatataccgtttaaaaatatttatcgtgcttaaaatattatattttataatgtccaaattttctattaatgtgttacatgtttcactttcacatgtaagattctattgaaattgttggttcgcctatgaactgtttcgctaagtggtttacgctacattttttttttcacaggtggtgatcatagcatgatattggtcaaattccgctatgtactttgcctacaccatatattctctggcatcatagaagacagaaaatccatgtatgtttctttactaaaagttttccaaccttgaattattgagaaactcaaagctaccgctgaacaattgtgctctgtttgtagcaatactttattctgggtgtaacatataatctaaactggttttggggtcaactttatgttattaattggtttgtacttggcagattctttgcattggcttactgcattcttttaagtgctaagcatgtaatctaccattaatgggattcatataattatacatcttatttcaatttcagttccacacagggataccacttttgcatagaagaa

SEQ ID NO: 10173 - DNA, 1501 bp, Oryza sativa
tttacttttctatgttctaccacaaataaagactcttgatctaggagtatgactgatgatcttcttgagtccgtatttttggctttgcaatatatatgatgcaggtatgtcacaatttgtccctaccgaactccacatatcagccttagaataggggtaaattctggcacattttgccttggtgaagatccaaaaagaaaatatatattcttgagagataagagagaaagtcaatatgaggaaaagagctggtttgcgaaaattcattaaaatcccataagtctgacagagaagcaagaaggactggaatcgaggtcattccatctatcaattgcttaagatggtaagatagccactaataaggttcacaggtgcaagtatggttgtgaatgatttatattcctgatttatatcttgaagaaattcattctacaataacctttactcaaggacgagcaaagagctaagtgtgggggcttttgttggcgactgttaaatgccgattctatactgccaacatctgcataaagttcagataataaaacatccaacatagtgataggtgcttaattaatctcacatattccacaagtgttagtgtatatttgtatgcaggtgataaaccctgaggttaggagaaaatttagagtaaagtgaggagaattatgtatccatacaaggatgggttgtgaacttcatcaaaacactagagaatcagccaaaaataccaaagaatggatagaggaggaccaggggaggacatgggccaaagccaaggccagatgggcccagcccaggtttggtcgaaccaccatcctcaccgtttgatgtggggtttggcgtggatgtcccagatgcatccttgatgacggttggagggcactttggaaatttccccttcaccaaccgtcacacctacctctatgtaaagacatcactccctcacttcactcacacacttccaagcttgagctgaattatatgaggctctattggactatattgtatactagaataggaagagagtagagtagaagaagtcagaagaatttcggagttgtcggtaatcttctctcatttcttttattctgtttttactctgaattcaatataatattcttcctcagtaatttagatttatctcgtgagaattatctcttggttagttcgtaaatagcatacgggatcattgttcactatagtccatttatttatagtgattgctttagtttttgatttgcactagagtagttattaattgcgtagacgcagtgtctaggtaattaatttccagtggttgctgcgtatcccgcagtacgtttgaggtaggtatagaggtggtgacagccctcaagagcacttaagtcctccctgtccgggtatgtagtagagcgacatatgggaacaacggattgccagtgcttgtagtattgcattaggattaaagttaagctttccctaggcactatttctcagtagtaaatcctctctgtcctggcct

SEQ ID NO: 10174 - DNA, 1501 bp, Oryza sativa
gatttggcaccgccgaagctggggactgccggatctgtagcaccagcggcggcggcggctgcggcggcggatgttggctatgcggcggtggtggcggcggaggatctcggtgacgcacttgtggaggggagacggcaaacttcgtgggctatcgccgaaaaaaaaaagaccagtggcggctggggtagggaagtggggaaaagagaaggggatttagggtttagttgtggcttaattatagagagcagctacaaaacggaatcttgttgtaacgggatagtttaagtggctcctccccgctttcacgtgcactccatcttgatacctggtaccttgggtatcagttggtacctggtacttggaacttttggtaccgactgatacctttggtacctgatacctgatatcggctgcctttggtaccgactgatatctttggtacctaatacctggtaccggctgccggctggtacatgttatctagtaccgtgatacctagtacctgatacctggtagcctggaggagaaggaggagagagagagggagaaaggagaaggcagccgcgtggtggagcaggacgaggaggcggtggcgaatccggtggtcggcgaggcggagtgtggaggaggaggcagctgtgaatccgatggtcgtcgaggtggggcagcctatgagaagaccaacgagggcggggagccagagcagcgcggtaagggaggggagcttgagggcgacccttgccgaggccgcgccgtcgtcgtcctcctcggcggctagggtcctgagccgacaggagaagctcccacccaacaacgccttccccggcgccagcggcggcctccacgtcccgctcctactctccctcttgttcaccgcacccatcgccgagctcctcgtcgtcgcctcgacccctgcagtggtggagcgacggcaacagggacaacggcgggcaccggctccgacgagcgttctccacgcccaacgcgccaccccacatagctagccaccatcgtcgtcttcgtgctggtagtcacagagagataagggagaaggaaggggaagagacaaagaagaggataaggatgctagatatttagtggtagtagttgtcacgttgcaacggaagcccggggtgtaggttttctgttaattataacctatatttttttgctgacacatatttggttagtactactataaataccgacagatactttgacctcaaaatatatggaattactgacacattttatgtctcgtcaggcagtattgccgacaaatagtgtgtcataacctttagcgacagatagattctcggtgattttggtgacagatgtctgttggtaatttagtgtcatggtgtagtgtccgtcctcgcggcggaacggtggcggcggcaggccgcgggcagagcaaaggggcgggcagagcggcggccacctcgccaaggacatcgagcgcacctctgacgcgagaggagcggcggcgcgcaccagccta

SEQ ID NO: 10175 - DNA, 1226 bp, Oryza sativa
  unsure (1)..(1226): unsure at all n locations
catattttccccgaatagagatgtgtatgtaaaattcagtggtatccaactacttcccattgagaaagtataagtttcttgatacgagatcggggaatttcgtgattagcgttggcatgcttaacatgcccttttcataggggatcaatcggttctattttatgttttaaagaagaccataaaaaacaaatatcatatttattgatggacctattaaaacaaaatctcatatacatttatggacttatctgtcagtaagctaactccaggggcgtccttgggcccgtgcgggctgtgcgaccgaacagggcccctaaaatattatgtcctatatataataatattagaggctttaattttgttaatttgcagttcaaatagtagtaaaacaaggtccaaaacgctgcaaaagatgaaccaatccatcttccatcatactcctgtccaggcgtccacgtcgttgcgtattgccgaagtcctgacgccgcaactgcttcgtctcctctccccagtcccctccggcctccgcttctacctcatcgctgatgataggctgatcaccacgcccctttttaattttactataaaaaattactaggctactagggccccattttaatattttgcacacgaacccgatttggcctggacgcccctggctaactcaatcaaccgggcataggcccaggctccctggttcggtgcagggatgtgatacttggctagtatatgtggttcaattatttttatttctttggtgtttagtctctactattcttatctctttaccacattgagaaagtgctggaaaattccggaataccctcttttatccaatggctgagatttattttatctattttgtcacttcatgaatctaacggctaatattaatatgatgatgtggctcatcctaattgtattttaggattcactttacactagtagaaatttgaccaaatctgtaaaaaaaatcattccgaaaattaacagacatgtcagaaattttgataccccggaatataaaacgaaattacgtccatgatggttaattacacatgccaccaccggaaacatccaatcccaatcacaatttcactttcttcaatatggcgtgcaaaacgccgccttattttattgcaaataacatcacagtatcacatccaccaccttcattttatagctgctagaagtttgccagtttccagctcacaccgtacactcan

SEQ ID NO: 10176 - DNA, 933 bp, Oryza sativa
tacacatgggaatcaacgtcctaaccacaaaagaaatgactacttatgtggggacgactaggcatcagacgtccgatcccagtcgaaactccgggcagtgtttcaccatatctagaaaaatgtttcacatgtttcaccattaactaagaaatgtttcagcaaaattgtttcatatgtttcattgtccaatgaaaaatgtttcatcatgtggttaaaatttttccaattatatgcaacatttaaagatactgattctaacaccgaaaacacattgtgtgcaacatccaagaaaatacaatgtacattcgtgcaacatccaattagaaaaagacggaacacacgaaaacaacaaagtgcaccaatataatacaatgaattgcaacaagcctaccgtccattcttttcctctactccaatagttagatctatcttcttcctttaatttgctcctgtggccgaatccgggcttccaccacaggacaaaactgagctacctcggacagggttctgggatacggaccgagtgggccgaaattcggtgaaattcgcccatttcggtccagcccgagacaacactaaaccggccaaaaaaattcggcccaatttgaattttccgcccagcccatggtccaaaacagccctcaagtatcttccctagtataaaagagcaaatctcacacaaaaaaaccctaacccactctttatcctccctgtcctctccccctagtggcggctggtgaagagactccatcactccaagccggaggagtggagcagcagctccggcgtcctcctctttctcccagctccatttctccctgttcccctccaccatcttctacttgagtccccaatccacattctcctcatggtgattttgtgcggcagcggtgatgttggttgtcaaggcaacggttaggacagtccaacaat

SEQ ID NO: 10177 - DNA, 895 bp, Oryza sativa
caattaatagaattaatatagtatgcacaccacaggtggtatatagtatattaataaagtatcattaaaaaaagaaaagaaaagatggtgtcctttagtttgttctctcttgctaattaagtttcctggctggataattaagttgtcaagcgtacgtgtcaacgcactatattgtgtacgtaacatgacgtccaaatcatgcatgaacttacttgatcagagaggtgtttttcttgtatttttccaagtaacacgtcgccctcgtagacgcacacacagtagaaaatattactatcacatcgatgtactagtatatatgtatgctaatgtgctggcctttttcacatctatctttgtacagtatctaccatgcatgtctttatacgtagaaatatatataccattatcaccatcatccttgcatgcatccacggtacgttaataaaatcgtacgtagggcaaagttatataaggagtatatacgtacagaagtacgtatatatatatatatatatatatatatatatatatatatatatatacactgatccttatatatactagtagtaatatatatcaattcgtatgctatagtattgtgagcttatattaatataattgtgcatgagaaaaataatgtaattggggggatcctaaataaaaccccacttgcattgggccatatatgtatatgttcaaaagtcccaaataatttaaggtacagaaagtacggaggaaagaaaaacaggacacaataagcacacgacacccagagcaaatgcatatcgatctaaccttagctacctacattgacaacatgcttaagcaagctggcccctgctctctgctgctttccgttggttcgttggttgcatgagctaatggctaatcacga

SEQ ID NO: 10178 - DNA, 571 bp, Oryza sativa
ggtttatactaaaatatgatgagggtttatcctaaaatatgaggcgtatcactcgatgagagtttggaaaagtagaaagctccacccccattgattaaaaaagagaagcagcaaacaggtgtattaagccttcaactagatgttgcatcctcaaaccttaagaccttgtttggcaaaggccaaactaccaaatcctggctcctccctggatggtccaggaatttagttggccagaaatttgaaataaattcccggcccatccctggaaagggcctaacttggtgtaaacccattcatggtatatgatttagacctagttctcgtatcttgatccctgtgtttgatctcaagcaaacaggtgatagtttaggatagtgcaatgcaattaaaccaaaccatgatatatgattagctaactgcaatttgtcgctctcatcccatctaacagcaattatatcaatcaaataattgtctggatgcagtgcacacatgtactcaagtgttcaagccgagctggttcatcacatagaccatgtaagttgcttcaagcgtaatcatgtgcgattggggc

SEQ ID NO: 10179 - DNA, 1501 bp, Oryza sativa
aaaatatgataagactatatgaggtaggcatggtgtacatacatgtagagctgcatgttgtcatcctctgaagagctcttgctcatgctaccatcgatgatgctcctttgcttggcgaggctggttgccaggaggcgccatccctcttcgaaatccactatgcccgccatgacagcctctgcagcccaaaggccagcttccctttgtgataaagacctttggattgagcatagggaggagacaatgttggttgctgggagaaaatgacaaatggctatttgtcattttactaataaaatatgcttacatctgttgagttgtgatccaaattcatttgcacttaataaaggctagcttctgccgtagcggagtgaaggcaaaagttggcccattgggctgtgcacctggggacgcccgggggtgcgggggcggagcccccacggtacgaatcatcatcccttttagggttccaccatatatatacctcttgtaagccgccgtgcggcgatgtaacctcacatcagatatagtgaagatattttgctggctggcgcccgtggttttttctctcctgttttgggagggttttccacgttaaatctcgtgtcttctgtgattgatctattgttttttatcgtttgttcgcctatcgtttcctaacaacatcacttctttcacatgttgaggatagagaccaaggctgtgtttagttcgtgtgccaaaaatttttttaagtatactgacacacatttgaaatattaaacgtagactaataacaaaacaaattacagattccgcctgtaaactgcgagacaaatttattaagcctaattaattcgtcattaggaaatgtttactgtagcatcatattgtcaaattatggcgtaattaggctcaaaagattcgtctcgcgatttacatgcaaattgtgcaattggttttttcgttcatatttaatgctccatgcatgtgtacaaacatttgatgtgacggaaacgttgaaagtttgaagaaaaaattttgaatctaaacacggcgcaaggaaaatgagtgttggctcttattaaagggccagttttatatgtacttctagaaagatatagaattaattcagatgtgagacaaaaggcaaaatattaaattagttttttaagtaggtaatctatcgataatgagcgttatatttggatagcatggatataacttagccggcagttggcattaccactattacaatatatatgtagaggctgggggtttatatacacttttatcattgtaaaaaggatataatacattggactgaataggatggagttttgcttactccatccccggtcttgaactgagctggaaggctggagtggagaagagagaacaggagtgactctgtccctgccgattttggccattgtcgctctcgctccataatcatgatctgtgttatgtcatgggagataattaattaactcacacattgatgcatggtggtatatgtata

SEQ ID NO: 10180 - DNA, 1501 bp, Oryza sativa
ataaatttgtcagacaacttgtaatgtacggaccgcatgcatgcgatgtcgtaattaaaatgggcctgcatatatatatatatatatatatatatatatatatatatatatatatatatatatatatatatatatatatatatatatatatatatatatatatatatatatatatacatataccaccatgcatcaatgtgtgagttaattaattatctcccatgacataacacagatcatgattatggagcgagagcgacaatggccaaaatcggcagggacagagtcactcctgttctctcttctccactccagccttccagctcagttcaagaccggggatggagtaagcaaaactccatcctattcagtccaatgtattatatcctttttacaatgataaaagtgtatataaacccccagcctctacatatatattgtaatagtggtaatgccaactgccggctaagttatatccatgctatccaaatataacgctcattatcgatagattacctacttaaaaaactaatttaatattttgccttttgtctcacatctgaattaattctatatctttctagaagtacatataaaactggccctttaataagagccaacactcattttccttgcgccgtgtttagattcaaaattttttcttcaaactttcaacgtttccgtcacatcaaatgtttgtacacatgcatggagcattaaatatgaacgaaaaaaccaattgcacaatttgcatgtaaatcgcgagacgaatcttttgagcctaattacgccataatttgacaatatgatgctacagtaaacatttcctaatgacgaattaattaggcttaataaatttgtctcgcagtttacaggcggaatctgtaatttgttttgttattagtctacgtttaatatttcaaatgtgtgtcagtatacttaaaaaaatttttggcacacgaactaaacacagccttggtctctatcctcaacatgtgaaagaagtgatgttgttaggaaacgataggcgaacaaacgataaaaaacaatagatcaatcacagaagacacgagatttaacgtggaaaaccctcccaaaacaggagagaaaaaaccacgggcgccagccagcaaaatatcttcactatatctgatgtgaggttacatcgccgcacggcggcttacaagaggtatatatatggtggaaccctaaaagggatgatgattcgtaccgtgggggctccgcccccgcacccccgggcgtccccaggtgcacagcccaatgggccaacttttgccttcactccgctacggcagaagctagcctttattaagtgcaaatgaatttggatcacaactcaacagatgtaagcatattttattagtaaaatgacaaatagccatttgtcattttctcccagcaaccaacattgtctcctccctatgctcaatccaaaggtctttatcacaaagggaagctggcctttgggctgcagaggctg

SEQ ID NO: 10181 - DNA, 1501 bp, Oryza sativa
tgttactgcagtagcctttgggttccttcagcaaattcatctgtgcttttgtttgtatatttctgttactgcagttgcatttgtattccttcagcaaattcatttgtgcttttgtttcagttggttctagcagttgaattagcctgaaatccggatagtttcaggaaatttcatctgagctttagtttcaacagacctccgcaggaaaattttaacaacagtgagtgagtgtgacgcactgacgctgcacttggcagttggctcttgcacatcactctcaatggcaatttctgaaaatggcatagcattgctcagagtcacaggaattcacttgaaatcatatcaacattagtggcagagattaatggaatagcttcaaaacataaacaaaaagaacagccgtttttttttgtggagaagttgggtccaaatgggctgggcccaccaatcatttatggcccatgggctcaaatctaacggcccatgaacgcatctcaccgtccccttctctctcctccgccgcctcctcctcactagtgacgacaccacccgaccaaaccgcaaagcgacgcgacgcggtaaaaaaaggaatcaaaaaggcgaaaaaaaatcgtcctcctttccgtagctggcaacatctccgcctctcctctcgcttcccgcatcttcccacacacacacacacaaaaaaaaaaacctcacgcgcgattccaatcctccctgaatccaccgcgcctttgcctaagggtttcgattcgttcgcgtgcggctgctctccccccgatcgatcggcttctcgcctcgctctcgacgaatcgaggtcgctagctcggttcggttgtgcgttgcgttgcgttggcgtggcggcgggcggttgaccggttcgctagggttggagctccgggagggggaggaatgatggcgagccacggcgccggggtggtggctgctggatccgatgccgctcctgccgaggtagatgacgcgcctcgtctgatgttctattgatttttgaatttgttttttttttgaatatgtgatcgtttatttagtgtctatttaggatgcaacgaatttgatattatgctaattactgtaccaaacttaagctaatttgaggatgtgggtgattggtagaagtaaaatttagccaagggaactaaactattcatgcaaggtggcttcgttgaatttttgcaaagaaaaattagagcagaagtttgatcggatttgaacgtctttgctatgcgtagaactacatgttaattctgagaatctatggttgtatggaagcctagttgtacgaatcattctagttgcaatatagtactgacttaaagcattttgccaatgaattactgaaatggttaaagctgcagtgaggatgaatcttttggtcatggcttttgtaactaagttgctatgtgcattatgccattatataaatgatcatgagttcatgacccctttatttgctaatggcaggtcagcattgtggggc

SEQ ID NO: 10182 - DNA, 1501 bp, Oryza sativa
ttctatgttttctcattacaactcgtaccaaaggaaattttcctttagctttcctatacctacattattatgaaccgaatgacactaatagtaattaattctaagtaatcgatttccctccaaactgaaagaaccctaaatcaactgtcattccacgagtaaaatatatcttgcttatataagtagccaggtgaaatgtgaattgtggcaagagagcaaatatcttttatctttttcctcgcagtgggaaaatattctttatcttaaccctcaactgaacagaaagttactttgttgagtaaaacaacacaacacctttttttttcatgtacttcatccattttaaaatgtatgacgccattgactttttcataaattttaaccatttgtactaaaaaaattatatggatatcatttattttgttccgacttgttttaatatcaattaaaaaaataatcttaacttatactttttacatatttatattaaatttttgaataaaacgaatggtcatatattgtgcaaaaaattaacgacatcgtacattttgaaaatgagctataattacgactggttcatctttttagaattagacaggagtattaagaaagtaggtgtaattaaatacgagatgaacgtgtttgcttgaaaagagaaaataggtgaagaatttaaatggtaaaatattatgattagttaagaaaaaataggtggaaaaattgttatattttgggatgaattctaaagggatataaatggttacttcaggttataagacattttgattttggtcaaagtaaaactgcttcaagtttgactaagtttatagataaatataggaatgtttataatactaaattaatttaatcaaatcaataattaaatatattttcataataaatttgtcttggattgaaaatgttactctttttttataaactttgttaaacttaaagcaatttgactttgatccaagtcggtggagtatacggagggagtacgaaatttcgggcctgtttggtacagctcaaactcctaaatttaactccaggaggtggatttggagtggagtccacaactctagtttattttgtgagagagcttcacccagctccactcccagttttggtggagctgaaactgtttgactgggctgaagctagagctgtgccaaaaatggccttccggtgcaaacttcgaaactccaaataccgcgccacgcggcagcctgaaaaataaaactggcgcctcccgtacgaaatttcgcacctgtcccgccaaatcaccgatccgcgcctcacgccacgtcagcgattcgcgtctcctctcgccatccagatcccaaccgtccactccctacccatccaacggcagccacctccccactccatcctctcgtccccttttaaaaccccctcccctttcttcccccaaatcccactccaatcaccaccgcttcttctcctcctccatttcctctcgttcctctctctctctctc

SEQ ID NO: 10183 - DNA, 1124 bp, Oryza sativa
ccaccattccaggtgctgttctgataatagctattgctagttccatatcctggagcagtctgatgaccaccagcattgtaatatgtgttacttgtgggaccaacgtaagactctgaattctgaaatgaagtaagaggctgatgagctgcacctgaatgttgatttgttcctccttgctggacagaagaaccatttgtagtttgtgggtaactataataatagtttgcatattctgcagcagtgtacccatgttgaagtgaacttgagtaaggcatgtgagaatgagtcgcattttctgtgcccatagttggctgagcattatgaggtgcactgcttgccacactctgattgtctcccgaaaccgaaacatccctttgtggatcatagtaaactgtatcttggctttgattgttcactggatagctccacgggactgtagctgccccagttgaagaggaccatgaatgatgccctaaagctaaaggtggataagtagatggatttgtctgccccacaatgctgacctgccattagcaaataaaggggtcatgaactcatgatcatttatataatggcataatgcacatagcaacttagttacaaaagccatgaccaaaagattcatcctcactgcagctttaaccatttcagtaattcattggcaaaatgctttaagtcagtactatattgcaactagaatgattcgtacaactaggcttccatacaaccatagattctcagaattaacatgtagttctacgcatagcaaagacgttcaaatccgatcaaacttctgctctaatttttctttgcaaaaattcaacgaagccaccttgcatgaatagtttagttcccttggctaaattttacttctaccaatcacccacatcctcaaattagcttaagtttggtacagtaattagcataatatcaaattcgttgcatcctaaatagacactaaataaacgatcacatattcaaaaaaaaaacaaattcaaaaatcaatagaacatcagacgaggcgcgtcatctacctcggcaggagcggcatcggatccagcagccaccaccccggcgccgtggctcgccatcattcctccccctcccggagctccaaccctagc

SEQ ID NO: 10184 - DNA, 1501 bp, Oryza sativa
gtatactccaccgacttggatcaaagtcaaattgctttaagtttaacaaagtttataaaaaaagagtaacattttcaatccaagacaaatttattatgaaaatatatttaattattgatttgattaaattaatttagtattataaacattcctatatttatctataaacttagtcaaacttgaagcagttttactttgaccaaaatcaaaatgtcttataacctgaagtaaccatttatatccctttagaattcatcccaaaatataacaatttttccacctattttttcttaactaatcataatattttaccatttaaattcttcacctattttctcttttcaagcaaacacgttcatctcgtatttaattacacctactttcttaatactcctgtctaattctaaaaagatgaaccagtcgtaattatagctcattttcaaaatgtacgatgtcgttaattttttgcacaatatatgaccattcgttttattcaaaaatttaatataaatatgtaaaaagtataagttaagattatttttttaattgatattaaaacaagtcggaacaaaataaatgatatccatataatttttttagtacaaatggttaaaatttatgaaaaagtcaatggcgtcatacattttaaaatggatgaagtacatgaaaaaaaaaggtgttgtgttgttttactcaacaaagtaactttctgttcagttgagggttaagataaagaatattttcccactgcgaggaaaaagataaaagatatttgctctcttgccacaattcacatttcacctggctacttatataagcaagatatattttactcgtggaatgacagttgatttagggttctttcagtttggagggaaatcgattacttagaattaattactattagtgtcattcggttcataataatgtaggtataggaaagctaaaggaaaatttcctttggtacgagttgtaatgagaaaacatagaaaaaaatttatccacacaaacatcttggaaaatttctatgaattgaagtgtgtatgtatttatattcctccattcttcctatttatatgtgtttaaattcctccaaaacaaacaagcccttataaagaaatctcgaaatgcttgttcactttctaggagtacagtgcaagttaatttcgtgcaagcccatctctgcacacatacgagctatgcgaccgtatagatccctaaaattaggggcccaaaatatgtgtttcaatttaaatcaaaatattccgatatatttaggattgtgtattcctttttttttcaaatttatctatttctctccactaaataggattaaccgagttgtttttctcaactccggtaagtgttcaataataatcatgggctacatcaaaggaaagaactatatttagcgacgacgatatgaacgtgcgttctaattctaaacaataacgattccattttttcatggaaaaagtacgaattaccccctgaaccataa

SEQ ID NO: 10185 - DNA, 1501 bp, Oryza sativa
cttataagtgggtaactcacttacagtacaaataaatgagcaacccacttatagattacaaatatatgggttcatgggtcggttcgcttgcactcaagagcaactttaaaactcagcctatagcttctttagatgatgaacttggcctatagttgaagatgtaaaatagaatttactttcaaaactaggtgaaatgtggcttttgtaccaagaatttaattattccttttatctcgacccccaatcaaactccaaattggaaaaaaccatgcaccactgtcggaaaataaaaatggcgcctcgtgtatgaaattttacatctatcccgccaagtaaaaaaatccaaatctcatgccacatcagcgatctgtggcacctctcccgtaatcctgatcccatccgcccattttcttcacatctaacggcaaatatcgcctgactcctacctttatcctctataaaacccctcgtcgtctctctttgaaatctcactctgggcaccaccaccagtgccacttctcttccaattccactagcacttctcgcgctccactagtcggtagccatttctgggcgcggtacaagtggtgctaggcgccatcggattgtctttcgcggctacatccaaggcatcgccaagccggtgatccgacgccttgcaaggaagggtggcgtgaagcgcatctcagggttgatctacaaagagactcgtggcgtgctcgagatcttcctcaagaatgtcatctgcgatgccattacctacaccgagcatgctcaccgcaagactgtcatggccatggatgtcgtatatgcgctcaagcttcagggccgcaccatctatgacttcggcggttgatcgggcttgttccctcctcgttccccgatagcttcaatgtccatggtcgcttctctattgcaaaaatggaatgtctctattcagttagtacgatagtagtatgagcaacaggattaccatcattttgtttaccgcgactgttgacgtcaaacacgaggcctgggagagtacaggttcaaagctcgccttcgggtgtgttagcgtgccaattgaattgatcctgcaatcaacaagaaatagaaacagagagatcgcggttaaatctataaatgatagccgatcggctaagtgtcgatgacatatcatttatctttgagccgatgtcatatgtgaatcgatcggcgactataaatagataataaagacttaaacctactcgatcggctgtagatattaccaatatatagttcttatatcgatatatatttaaatcaagtgattgggatagatcggtcgccatgccaagacaatataaatcacttggatcgaaatatatattaataacaggactatatatgtttatagcatagccgatcatatagatctagcatgtatcggctaatacttcgatactactctatatcaggatattaaaacaagtataatatatcaaacaaaagcttaatatacttaaatgcaataaga

SEQ ID NO: 10186 - DNA, 1501 bp, Oryza sativa
tcttctcagaatattttttgttcttacttatggaacaatctctccttttctttttgttgtgtgtgcttgtttggtcgcctcttctttcggctgcaagagaacgaatccactcttgacggccttgttctgggggcgtagagtgattttgccatggggggctcgagttgtgggtgatcccggctgccgtctttcgcggcggcctcgggttctcctcctctccccgtggcttacacgactacgatttgtgccggtttctgcttccgtttatgttttttcggttatcttcacaagtttaccgattgttaaagatctgaatatctgatgcatttgtgcccgtaaagatcgtgaggtcgacgtgcaaagatagcttgatataaaacgagaactggatcttaagaaaataattaagttttgagaaaaaaaaagtctggaaactggatggatgcagccgtgctatgcacgcactaagcagtatgcattggaatgattgaatggacgattgcaacgaatcaagcagtctgcatttgatgaatgattgaatggacgaacgatatcaatgaattaatattggtgattgcctgattggctgtcactggaacagtggaataacaaagtactctgtcagtaagagcattcttaacccaatgactagaatgatatccatagtattaaataagttgccatctaagatagaaaatgatatggcaagtgaataaatgaggaaaaagaagaaaactatgtcttgcatgagacatgttttctacataacatccaagacatcatgtgagataagtagcattaaatttaagtatggaatagtgacagtggtgtttgcattggaaaagtagtgtctagtggagtttatggaaactatgtctagtattttgggttagaaatggcctaagagcaagtctaataatacagcatgttgttagctataaaaatattcacatcaccaacaaaaataattaataagagtagtatacatacaatagttaactattagatcacctacaatattcacatcaccaacaaaaataattaataagagtagtataaatacaatagttaactactagatcacctacacataaatttttatgcatgcattctttattttttaatccagtcattctctttcttcttcacttcaaattattccgtccactagttcttctcgggaagggacaaggttcattcgacttactgttcttaccacggggtacggtaatagaaaaatcgcggtaacctccttaaatttaaatgaatttaaaaaataatttaaatttttaataaattttacacggtttttcatggttaccgcaccggcaatttggaaaaccatggaagggagctgaccatcgagagccccatgaaaaatgtgttggagcatgtgtgcagccggcgattatttagtcacccactcacaccttttctctcccaatttctttgccaactaagcacattagcatgcatgcactatcgccaactaaagtgactt

SEQ ID NO: 10187 - DNA, 1501 bp, Oryza sativa
aagaaaggctaatcgattggtgagaatcaagaacaacacagcagcaaagcaagtttcacacgaaagggatgcaatcgctacacatgctcttctgctgggaaatctggtgcgagagaaataggtgagtcttcaaagacacagagctccaaatccctcagctagtggcaaaaatcctggaaaaaaatcatgtatggtcagtatgtggtgcaaaaatcctcacgagaatagcaccttagtttactcccttaagctgtatttttttccctttgtgctgacctccccttgttcttctcctgtcaccgttggtgacccctatacagtgcttacttttctgaatataaaaccagctcggttggcttaggtttcataaaaaaatgggggaggggagggaagcattgatagaagcgcgtgagtcgcaggtcccgtttggtagggctccaaactccaactcttaactctaaactccaactccagttagagctggctcctataggagctgaagtagaatagaaagtgtttggctagattggttagctccactccaccaagtcctttgttggcattttgtcgaacagctggcaggcgtcgctgtcgccgcccgccctgccgccggcggtttgcttgtcggcgccgctgccgccaccgcacgtgcgtcgtcgaccccgcgccaccgctcgcgtgcctgctgccgccgctgtccgtggccctcgccgccgcgccatccgcccgccgctgccgaccgcttgtgtctaccgaggaagacagaggaggagagagaactggaggagatagggttggaaggggtagttcagtggcattttggtgtaaatacactaaaaattaaaaggtagtgggtcttttggggtggagtggagcggtggagcagcaaaaacccagctccaccccttagcacaattttgtggagaagctccaccaactccgctccaaaaaatgaaggatctggactgtttgacacagtttgggctctagataaattggagttgggagttgaagctgtaccaaatggggccgcagattggagatttgcaggcaggaccaaaaattgccaatgaagtttgtggaaggaataagttcatctgaggtcccttaacttgtcaacgaatccgattttcatccttcaaccgaaaactagatacaatgggtcccccaactatcaaaaccagtgcagatgaggtccctcggcggtttggatggcggttttggctgacgtggcgcttacgtggctaatttgactcggtcttcatctgacgtagcattaacgtggcgcttacgtggcaattcgatccgaaaaataataaatctcatgggacccacatgtcagtttcaccaaaagaatgaattaaaaaatggtgggtagcattctcacccctcctctctccccatctctcccctctcctctctccagcgccacggggtcacggggaggtccggcggcggcggccgacgacgcgggggaagggcggggcgtcagtggcgggag

SEQ ID NO: 10188 - DNA, 1501 bp, Oryza sativa
ttcaactgggattcatcacaccatgcaaaagtattgctaccgaaatatgctaccaaatgactgcccttcttcttctggtgtttcagtgccaactcagatgcatctgaagtatcaaatatctcaccaggccaccaaggatgacctttcaatttactccacacaagaccagatgctcgaaaaccatatccgtcaagaggagggaggcggtatttggcacgctgatcatcccctgtgagccctgcaattatactattcagtgacgccatgcgaggtgatgataacaacatgtcagaatcaaccggcagagcatcccaattgatcagagcagtgaccaaattggagcaaagctttacctgtttcagagtattgcagtgtgacaggatcagacatttcctctgaagtctctatagcagcatctcctaccggcataagcgtccaccctgcctcaccacgaaagccaccgagttccactcccaacatcctctcctctgcaccacctccatccagcagctcctgcatgttgtcagtacactcacccccgtatccttcacccactgccgccgatcccgtcgcgtacagcaaatcgctcaccactccgactccgacgccacctcctgcagcggcatcctcatccatggccaccacaaccttccccccatccaccttcaccacacgggccgccacggccacctcccccgcccctcccaccaccatcacctcctccccatccgtcaagtactcccccaacgcaacgccgaccagcctcggatccccctccagctccatcgcgccgcgatccacggccaccggcgccgacctcaatcgcagcgtcgcgtcacctgcaaaacaccaatacggggggcaaaatttagcaccaaaaaaacaccggaatacctcccaatctgagccgccgctagcgatggagtgagaagagaaccctagtcgcgagccctgagggagcgcgagctcatcaccatccgccgcgcgcgacgagctggaggtagacgaaggcgctagggttttcgcggcctcggtctccgtgtgcgcgcgggcgtggtgaactggtaatcggcgagggcgaggcgagctctggtcgtggtcggagaggcagacgagagcaaatggaccgagaggccgggccggttgggcccatgggccacgggcccatacggtggcacggggaactgacatgtggggccacggatgtcggagaggatctagtactagacttctcgagccggagttaaaaaaaaaacgtgcgcgcgcgtttatcgcggcgagggggtggtgtggacatactggaatgtagggacaggcgccattcggaggtggctgtcatgtggggcccacggcttggcggataagtcgccgtcgtcgaggttgatcgccggaataactgcgtgtccatcccggcggcgccaacggtgagaaaaattcaccttcttttacaacccctgaactcgtgttgccagcgttaatttagccccgagaagaggagaga

SEQ ID NO: 10189 - DNA, 1501 bp, Oryza sativa
tttaatctaaggacatcttttaacagttcttacttacacaccaccattcctattttgatcaatttttcttcatgtgcttttaatggattctaggaacacaccggtgtgttcggaacgcctggttcccaacactaagagcccgcacaaaaaccgaagcagcgattagcgggtgattaattaagtatttactattttttttcaaaaatagattaatttaattttttaagcaactttcgtatagaaactttttaaaaaaaacacatcatttagcagtatgaaaaacgtacgcgtgaaaaacaagggagatggtttaggaagaggtgctgccgaacacagccttagagtaggtacaataagtcactttagttggcgatagtgcatgcatgctaatgtgcttagttggcaaagaaattgggagagaaaaggtgtgagtgggtgactaaataatcgccggctgcacacatgctccaacacatttttcatggggctctcgatggtcagctcccttccatggttttccaaattgccggtgcggtaaccatgaaaaaccgtgtaaaatttattaaaaatttaaattattttttaaattcatttaaatttaaggaggttaccgcgatttttctattaccgtaccccgtggtaagaacagtaagtcgaatgaaccttgtcccttcccgagaagaactagtggacggaataatttgaagtgaagaagaaagagaatgactggattaaaaaataaagaatgcatgcataaaaatttatgtgtaggtgatctagtagttaactattgtatttatactactcttattaattatttttgttggtgatgtgaatattgtaggtgatctaatagttaactattgtatgtatactactcttattaattatttttgttggtgatgtgaatatttttatagctaacaacatgctgtattattagacttgctcttaggccatttctaacccaaaatactagacatagtttccataaactccactagacactacttttccaatgcaaacaccactgtcactattccatacttaaatttaatgctacttatctcacatgatgtcttggatgttatgtagaaaacatgtctcatgcaagacatagttttcttctttttcctcatttattcacttgccatatcattttctatcttagatggcaacttatttaatactatggatatcattctagtcattgggttaagaatgctcttactgacagagtactttgttattccactgttccagtgacagccaatcaggcaatcaccaatattaattcattgatatcgttcgtccattcaatcattcatcaaatgcagactgcttgattcgttgcaatcgtccattcaatcattccaatgcatactgcttagtgcgtgcatagcacggctgcatccatccagtttccagactttttttttctcaaaacttaattattttcttaagatccagttctcgttttatatcaagctatctttgcacg

SEQ ID NO: 10190 - DNA, 1501 bp, Oryza sativa
gatatgattttaatacaaacattcatgtagtagaaatatcacttttttgagggatcgaaactcgcagcccttgagaaaacaattaattgtgtaattgtcataaacaaaaaatcatacaacactcatcaaatacactatatcataaattatgatataggagtagtactactttgttttccttctggatcaactggttccatcccatcttggcatctttccttccattgcctctctccacggtctcacctcaccgtgcaggttgctgtgcaccccccaaacgcaaacgcgatagagacgctcacgactgcacttcctgcaggctgcactgcactcgcacacacctccaccctcctcctcccctcccccctgttcactcccgcatccaattcccccccatctctctctctctctctctctctcatccatcgccccgaagtcctcctcctcctcctcctcgaggacctcgacaccttcctagctcaccgcgcgcgcgcctcgccctcctacgcaggtaaacccccccgccccctcgagctcgccatcccgcgctgatctgcggcctagggtttcagatcgagggggggaaattccgcgccgctgaccttctcccgcctcgatccctgcagattccttcgccggtgggggtggggggagaacggcggcggcgttgttgcgatgagctcgacccacgtggctgtcgaggccccggatccggggggagacgggggcctcggcgaggcgaggctggtggatgctgatgctgctgctgcaccggcggcgggggatgcggaggggagattgggtggtggtggtggtggcagctcggcccccgccgctgcgggggacgctgatgtgacgatgacggaggccgtggaggaggaggtggaggtggaggttgcgggtgatgccgaggcggaggctgcggtggtggcgggggatgcggcgggtgatccgttgtatgggacggagtcggctggtatggttgtggatgagcccgttgacgccgccgagggaggggtagatgggggagatggtggcgaggaggggttggaagcggaggctagggttttgcagggtgaggctgcgacggagcccgttccggcaggaggagatgttgccattgcttctgaagtggcggcggaagcacatgattctgctactcctgagcatgccgaggccggtaagcggaccgatgacagtttgatgtactgtctcttactcctttcgcgtcgctgaataatggttactacatttcagaatccaatgatctcgaagaaaaccatgttgatagaggaaaagataatggcgtggcggtggcgcactgtgacgacgaaatgcagaataatgtggaggggagctccgagatccaagaagatgatggagctcccacacttgagcagcaggatgatgagtctgaaatgcccctgccttctagtgtgtcgaattttgaattatgcgctagatacagccttcctcctcttgataaaggagaatttcgagt

SEQ ID NO: 10191 - DNA, 1217 bp, Oryza sativa
tcctccccccgggctccccggcccatcagccatcccacctcccccctcctgcaccaccaccacccaaacccaaaccctagatccatcagtccccgcatcccaaaaccctagaaatgggattcgagcgaaggagagagaggcgtaggcgtaccttatatagaagcgcgggcgcgcgcggagagggcgccacgtggagaggagagagaggggggttgggcgcgaggtggtgaagcgaggaggagagagagagagagagagggggagaggagagagagaggaagcgggggtgggaacggagcggaggtgaggcggagaggcgagagggggagatcggacgctggagaagagaaggcggctgaggcgggcgcgattgaaggggtcggggtatcagggccgttcgtggaggggtatatatagggcggacgcgggcgccgccgcgtggggggtacgggtgagggtttggctgactgggtttgcctggccggtgcacggtggaccgggtgtaggggtctaggggaggagatttctttttttcttttttgctttttgggtttttcttttgcctttttgtagccttttgttttaggttttttttagaaaaaaaaagttttggattgaggtgagtttgtcgtttggtgagagtgcacacaacgtgggggttttacagttttacatcacaaatagaatgtgagatttgccataaaaaacatttatgatttgctttttttttcccgcttcttcctctgatacacgaggcatttgattttatgccgttcttaatatacgagtgaacatttgttatatatcaccattcatcagtggagggtaattagccgggaatattagaagctaccgctgctatacgtgacgctgacctcaattatttttgactggatggagtattttattaaaggttttacattgccataggttgtaaagcagtgtcattgtaacaacaattaaatagctacttcaagcgttaaattttgttttaaaatatagctacttcatcacttgttatattatctcaaccaattacaaccatatttcgtatagatttttcacataatttttcatctaaactaatcacaattatcactcgtttaatttcatttcgcttcttagtttctgtaaaaagttctacaagtacttgtatttttaagcaaagtgaataagttaagtaatacctattgaatacatacatggataattggata

SEQ ID NO: 10192 - DNA, 1501 bp, Oryza sativa
ctttcccatacatatatataaacgcaaaacgttgaaaaaaaggtatatattcaatttttattcctacatctgcatatatggtaggctatactacttagctttttctccctccctcctcctcaccttaaatattttttttctaactacttatccgatctacgattcgatcacaccattgtatttgacgtaattaaatctttgtaacaagatatcacatggttatattctaatgaaaaatgtatattttaaaccgttagaactcaataatttatctgcgatagcgacatgtttcaacgtgcgttccattgtgtttcataaatttcacataactacctccctctattctctctcctgcttctctctccattttatccatccatgcatgcatttaacgagctttaaaatgattttttttctaaactacttatccaacttataatttgagcgtatcattgtatttgttgtaattaaaatgaagatttgcatgattatattttgatgaaagaaaaacacatgtttcagaacattaaaactcattgttcgtttcatatgtgatagcaacatgtttcaatacatgttatcaccgtgtttcacaaaatttttaagtgtttcaattgctgatttgtctgtttcaccatatacaattttaatgttttactcgttggtcaattaaaatatttgaccctgatttttttttagaaatcggatgccaaattgtagattcttccgtagtattgcattgtgctttgtgtgttggaattttagttatagagatcattctattcaccgaagactctactcttatttaggtttagagattctagatttatagaaatagggtcagaatctaaaaaagcaggatatcgggctccgagcttgattagcttcatgatctagagaaaagaaaaatctaaattatttaagaaagttcactacgccagaaccctacatctgtgacggcataccagtgacgggcctatgaattggtaacagatgaccgtcacctttgacgggtcgctaggtttgctgtcatcgatggggcatccggccgtggcccgtcacaggtatcccctcacctgtgacgggccagaaggaaaagccgtcacaggtgaggaagtgacgggttttcctcccaactcgtcactggtatcccctcacctgtgacgggccgtggcattatgagccgtcacaggtggtggtccgccacctgtgacggatttgttttacggcccgtcacaggtaggtcaatacctttgacgggcaactggtcatacctttgacgggtttttttaatctaacctgtttgaggtgtgttgggtctataaatactccccaaaccgccaactactttctatcccgaccagttcactgttcacaaatcggttgggagggcaaggggggcgattttttgctaaaattcaaggtaaaaaacacattattctccattccttctcaatatatcgatcatcatatatttttcttcgtatgttgttgatttctg

SEQ ID NO: 10193 - DNA, 1501 bp, Oryza sativa; identical to SEQ ID NO: 7368

SEQ ID NO: 10194 - DNA, 1501 bp, Oryza sativa
ctgggatgctggcctcgaacttgaggaagtcgcgcgccacgtcggccgagccgatcacgacgcagtgcgtggagggcccgaggcggaggtagacgaggggcccgtggcgggcgaggatgcggtcgaaggcgcggtggggtggcggccggatgaggtggaggtggccgatgatgggcagcgccatgggactcgggggcagccgaccgcgcttgctgcttctgcttccagctgacctcatcaccgccaacaccacggtcacgagcaaggcaacaagaacggcagcgccgcccccaccgacgacgccttcctccatttttttggggtcaggcaggctgtttctgctttttcggtcggtactcccttagctagctctctctctctttatgtaggagtacttcttgttattagcaccagtacgtctcctctctcaatctacaccgttcatgttacctaccactactattatatatatactcctgcaccccaattcaatcgcattgtgtcaaataattaaagaaaaaaaaagagataagatggtcccgtgcaatggcattacgtactagtactactacagtcaattaagatgatgcattaacgacgacatcgtcgttgattcaatacagcaagtactttttgggtaggtacaatgtgcggccagaattcacacccccggccccccgtcactttcgctacgtagtgccatagtataagtccaaatactccgttcatcctaaaatagaagtatttttagactttgatatagtttttaaaatgctattttgatcaataatattcataaaactaagatgttttaaataaaagagttgcatattatgatagtttggttaatgataaatctagcaacatcaatttacatgtttaatttttttattaatagactaagtaaaaatggttgagttgaaaagagaagattgaaaagatacgtagaacaagtttagagaaattgagaagaggaaatagaaatacaaacaagtttgtatcatctcaaaatacaaacaagtttagaattcacttccgaaatctgtggaagcctggattgcatgcctactttcaagccttggagcttacaccaattatatgtaattcaaaattttgaaagaagaaaaatgaagataaaaggtaaaattatttacatgtagtatgtcacgtgtgggctcttctttaccagtacataccgagcacttgatagtgtgtgtgtttggctcgagacttgtgaggcctgtaccgaccgcacgattgtgtaattaattgcctgacaggtgtcacagaaaatgaacgtcctctgagtcagaaatggatgcgtgtctgcttctccttcattgatactaccatcaacatttgtcactatctaatagcatctccaacggactacctaaaatagactcttcaaatacccatatagctagttagccaattgatttggtcagtcaaactcattgtggactccaacagcctctccatctaaaatctctattccgaa

SEQ ID NO: 10195 - DNA, 1501 bp, Oryza sativa
ttgtacagaagctgttgaggaacatcaaatgggttgttttgtgttgcccagggggattgaccggtatttatctattctgtttggatggctaggaggggggaccctgaagcagacattcatgatgttgatgagttgttgttgctcagctcaagccacctttacaagaggagaaggagaccacttaagaggcaatactcaactcactaaaatacgcaaattgcatagatactgctgcaaacaaacaatctgcttgagcagcctgactgtaacatgcatgcatcaggattgaacatatataatggatcatcattaattgaacaagcgatgatcctgttgagccatagctagaattgcgcaatcgaagtggtcatgggcatcggtgatactaaagttggatggacaacgtcccagcagaagaggtggtccgtcctctgcgtgtctacctgccaacttgtatcactccttgccctgatccgcagcagcctccgtgtccgtgaggcctgcttgcctgcaggcgatcgatagttgaagagcaagtcgtttgtttgactcttaccagttaccacaaaggtggtactcccaagttttatttgctgaactgcatgtctgtttgaaccgcgagatactacaactaaagcttcagcaaatgcatctcctccaccaagaaacaagataggggtgcatctgtgcatcatagcttgggttaagttgacttgttttttttccttttcttttaagtaggcagaggcagcaaactactccagtttcctgagaagattaggatgactggtcagtagtagtccaaaattatagggtatacttttttaaaaaattcaactcggtaataataataataataatgataacaatagtaaatgctaagtattatgcatttattaataatataaatatgaaataaattaataatcaaaatatgttattataaacaaaatatagatcttatagtttagaacggtcagtgttagatgaagaagataagagatacttagtacgtggagatggcatccaatccatcgctgtctgagtaagtgaaggcaagacaaactgctcctcctcttcttcttcttcttgttgtacactacgcacattcggagttgcgaaaattgttgtgttgtaataagcaaacgtcttgcaacaatactcctccccctaataggagaggctaatacagaacaaattttctttagaagagggtaaaagtatattgataaagaagagatgctaatacatagaatatgtgttagtaatcagtattagattactactagtatgtagtagtaatatgagagagtaattattattatttttatttaggaggagtagttgattggaggatatatacagacggtgagaagaagagtgagatacaggagaggagaagcctcctgaaactgaaaggagacaagcagttgtgttgtccttctccctctcctccggccagcggccatggccatggcaacggcaacccccgcggcgcaga

SEQ ID NO: 10196 - DNA, 1501 bp, Oryza sativa
ccagtgacctttttatataagaaaggcatgcatccatgacgattgttgaatgaatccgaatatatggaatcgaatcaaatagttgaccactaacgaagaaggcacgtttagctcgttgctccgtccaatcaatctcaatgatttgtgtgatttgtgaacaacgcaacacgaccacatcaatctcaatcaaataggttgcactgtccatacccctgtccagtccagtgaagtcggataaactcaggtactacctccgtcccaaaatataacagtacaataccttgttttaaaatgaggttatttctctacctacatccttctcttaaccaatcacaagcattctctttcacctagtttctcttctcaaccaattacacgctttatttaatcatcctcacatactttcttagtatactcgtgtcaaccttagaaatgctttatattttaggacggagaaaggagtagtagtagtccactttgaaagaagagaaaggatgtggtcggagtacatattttcaccgatttgtgatggttctatattaaaaatagtagaaatataatataataataaataaataaataaccgatggttcgatcggtgaaccgcagccagagcaggtcaacccccgatccggtttttttactatgttgtggagtagtagctagcggataacactgacatgcacccacctacacgccgctcaggttctgcattattggcgcagtacgtacgtgttcatggggtacttcatccgtcccaaaatattataatttataataggatttgacttattctaagacaacgaatctagactatcattcgttgtactaggatggatgttgtaatattttagcacaaagaaagtagaaaagagaaagaggcgctaacatatgatcttcaaattggactagataaagagtagaagacacgtcagcgaaaaccgttcagtgagtcttttacatcggttttaggagttgggggttaatatatcccatgttatggttggaggctatgccagccaatagttgagggagttaaattggagtttattccttatcttttctgttttctttttaaattttttagacaaagaaaggctctcaaattcgaacggtctctctagtaccgtacatgtggattatatttaggcccatcaaaactctgtccggtccagtagtaggagtaaggcccatcccatgccatgaggaacgaaaggcccaggcccaccatcgtaggcctcttcggttgcgttgcgttgcgtcgccgatccgatccgatcctcttcttcataaatcatactctgggaatactagctgctctgctctgctgtgctgtgctgctagggtttaggcggcggcggcggcggcggcggctgcggctttccgattccaatccaacaagaagaagattcggagagattgccggccatgtcttccaccggtcgcccctacggccgtcgcggcggcgccgctccctcctacgtgccgcgcccccgcgcac

SEQ ID NO: 10197 - DNA, 1501 bp, Oryza sativa
aaagaccaagaagcatttaattgtgtatttacttgatacaaaccaaccaatgcatgctatatgtatttgcttttatttagtttttgccaatgcatgatgccctttgtcttattcaaaaaaaatgtaattatgaattattttgctagcatttgattcattattaaatatactttgagcataacatataattttctatatttcacaaaatttttgtgatcagaagcgatgacgggcctcgatcgtcctcacagccgatcgaccacgtggttcaggatatggagcccagcgataaactgtacgtgcggagtatgcttctgaacggtgtccaacaactaacagcccggcgataaactgtacgttgcactgcttaggattcctagactccgggaactttgaaccatcattcttcaatagagacggtgtaatcggggtcgggaactttgagccatcattcttcaatagagacagtgtaatcggggtcgggtacattaattcagaatatttatgctttcttcgttcgattgaattatcgggctttatgttctgtatatgtttgttttgtgtgaagtgagacagactacgttggtttacacaaggacgttaatatcaccaatcttaatctaaaaatggtctcaatgaagggcatgtcaggctcactagtactcaaaggcaacaagagttattggcatgttagtcgctagtgacggggcgtacactactgcagcttcttacatacactccttcaggaagacataccaagggatccatctccgccacgaaataataagactcaaatagtcaaattttcacaaagttttgccaaattcacaatttgtttttgctaacattatgatgaattattctttctcatttcagttagccatttgacgccatttagaagcatgttttgagtggagattatattaggtggtgggtagtagggttttacactgtttttgtataccagcagaaccagacatacaaaatgctttagttttgaaattagggcatttccctgcatgctttaggtggtgttaatttaaagtaggatgactattttgttgcccctctccctaattctaagtatattatagaacaaataagaacctaaagtatacttagagcctcttgtaatttagctctacatcttgtgtgagaatgaatgatgagaggggtatttataggtggaggtgccttggaggatagagtttcttccaagcatccaatgagcatcttcatcctcctagtgcaagtgtccattttatgaagttcttccaagcatccaatgagcatcttcatcctcctagtgccaagtgtgtattttatgacggttttcattcaaaaacctaaaccctaaaccctaattgttgccttagggtgtagggtatcagggttttagggtttagggtttagggttcagggttcaggatttagggtttagggttttgtcatgattatggataaggtatacctcctatcctacgacttatgaaatatgcgg

SEQ ID NO: 10198 - DNA, 1501 bp, Oryza sativa
aacaaccacagacacagagtggcacaagtggagcactggaaatgatgaagattgaataattcaggggagaagagaaataatgtcattgttcatatggtggtaagcaaggcaagtggcaatcatgttgtggtgtggaacaattgataactggaggggaaaagtgtcatgaggttaattaatagtacagtagtgggttaatttgcagagatgaagaaggaagggcagggcaggatagaagtgaagaagggaatggaagatactacaacatacttccttgctgggggacaatgaggaaatcgccgtcagcgttgcaaaaggcgcatccgtccatggacttgttagcagcgtacctggagcaagcaggatataatggattgaaagaaagtagaatcagcatggatatacatacatacatacatacatacatacatacatacatacatacatacatgtggatggcgtatccgtggcgcaggaaggagctgccagcgccgcagacggtgtagaggccatcgatgaaatcgaggggaggatggtgggggggcacgtcggcggggcgccagcgcagctgggtgggcgtggcgacggtgtcggtggtggtgcggtcgaaatccccaattaagcgggggtgggcggggcgacgggggtggaagggctcgtgggtcaccgaaggcttgatccggtacagccatctgcatctttctttcatttgatctgatagaattgaggaaagattgaagaatctgatagaattgcttacgttcggaggttgcgggcgcgcggggcggtgaagggcgtgccggagagctgctcggcgtagagtcccagcgggcagaccagcgggctgttctgcccgcgcgggagcgtccccgccaccgcctccgacgacaagctgttgcccagccccgacagatatacgtactccaacccccccttctcctgctgctcattctgcgccgcgggggttgccgttgccatggccatggccgctggccggaggagagggagaaggacaacacaactgcttgtctcctttcagtttcaggaggcttctcctctcctgtatctcactcttcttctcaccgtctgtatatatcctccaatcaactactcctcctaaataaaaataataataattactctctcatattactactacatactagtagtaatctaatactgattactaacacatattctatgtattagcatctcttctttatcaatatacttttaccctcttctaaagaaaatttgttctgtattagcctctcctattagggggaggagtattgttgcaagacgtttgcttattacaacacaacaattttcgcaactccgaatgtgcgtagtgtacaacaagaagaagaagaagaggaggagcagtttgtcttgccttcacttactcagacagcgatggattggatgccatctccacgtactaagtatctcttatcttcttcatctaacactgaccgttctaaactataagatctatatt

SEQ ID NO: 10199 - DNA, 1501 bp, Oryza sativa
aatggcatggttccaatttaccctttgaataatggcattgacttcaaaatatatttttactatattttttaattataatatatctaataaatacatatatttttccttttgttatgatactttgtaagacaagtctatataagttgttctagtgtctttaaattaaatattttttaaactattgatagttaaaattataaaagtttgatatcaatctcatctaaaacatcaagaattatggaattggagggagtaatacttttttttccttttgtctccaatagatctacaatagttgttgttgatggtcattaagtgcaaactttaactatcaactcctgcaaaaagaatataaaaagttatatcaaaacttagtgataggggctaacaactaaccatttccactaaatttggtaaatatatgtatgcaggttatttatggatgaaaatacacctgtcatgcgacaaaagaaacctccggccaatcatacgcaagtacacggattggatgatgcacctgacagtcaaaaagacctaaagtgggaccaaacaatcctcaactgccataagggcccacctgtaagccgctgaagaaagttggtggagaggggtgaggcccagggatcaaccgaactcttggttcgggtgaaccgccaacaacgaacattccaaccatcatacggaagctataaaatgatgagctcaacacacaaagtagagtacaactcacttttaggttttgcttagtatgttggattattgagtgaatgaggggagttccagaaggagtgccctaaagtatgagagttctctccgagaacttccggaggagtgtcaggtttgtcagcattcttccattggagttccgaagaagcgccagagctgtcagccttctttttgcttgtacctcagcggatgcttgctttataaataagtgttcgagatttcttatattgtttaattagtttacttgagtgagatatattctcatcggtgcgggtttgtcgcttagcttataataaagtgatatagtagtgctaagactctcgataaaaaaggaagttcctacgcgagactagggtagtagtcaataagtggtgtgtaggttagcagttaccttatttgttgtgcgcttaactgaaagtgagataggcggtaggtggtgacaaccttgttcatcctttgcatccctccatgttcaggtgcattatagagctcaaggcaagattcaccttgacaaactaagagagggccaatgctcgaagcattcgatagaattttacctttaacttaagataactagttgaatctatagaaattatctctagccaatcttatcatcaaattgttgtagtttgtagaatcctgtttgtagatatacacactcatttcttgcatttaatacccttggaatgctctaagggaaagtgctatacaacggtatccatgcgcttacggatttatctgtgcgtagcaaatacgagcagtcgctttctccgtc

SEQ ID NO: 10200 - DNA, 1501 bp, Oryza sativa
tgctgcactgcatgacggcacaccccactgaggcccagtagtcctggaggcgctggatggcctgctggaaggtgagcacggaggaggaggaaggccccttggtggcggcggaggcggagacagagactggggagggagcatcaccgtcggcagacgccacggcggatagcaggcggcgtcgtcggcgtgtgcgagaagggggggaggttgggtggtgggaggcggcggcaggagagagtgaggaggagagggggaggaggaggaggggagggggagccaaacccgccatggctacgactacactggacctggacctggacggactccaatccacgacaggataagcgggaagatgatgatgatgattatattcattcatttatttattttaaagcttttcttattggactatcttagtattttgctccaaggttttaataacaaaattctattttgccccaaggtttcaatagagaatgaaaaacgctagtatcttttatgtattttaagtttttatattgccctaataatttgagttttcccctttctaaaaaaacatggaatacatgccttgaaaatggtgccgaaaacattttttttgtcttcccatttgaaaacacggatttatctactcgattgtatagggataaattaagtactactactttaaaaaataaacttaacaaaatactctatccgtttcacgttgctagacatctccattgttcatttagattcactaacatccatatgaatttataggcacatagtccacgaaacatatatatgtagatcaatgtgaaatgggttagtctaaacatcgtggtagaaaaaaaaaggtgttttgagagaacgaacgtattttcaaaggcgtagagcaagtggaaagtattccacgtaataatctgaccaagtcgccgaaaagaacagttgccctacagtctaattcaccgcgttgcagtgattaaaatttcagaacaatcataagtgtattaattgtgtgaatttgcacaaacatatacagaagttgaaataccaaaataatcaaagacgtcaataaacaaataatcggttggaattgttcatcatgtactagtaatatttttttgactgaatgtactagtaatataacttgcctatatgaatgtaggatgaacctgacattggattctatataagttctgtacaaccttaggagtatgtgcttttgtgtttttttctgaatcatcgcagcacgaacgttgggttcaagttgtgtcagcattcagggacactgaggtatctcagtacatgcaatgttaatatgctcgacaagggaggatatttcacactagaagcgccgcacggacaatctcacaatatacatataagctgtgtttagatccaaacttccaactttttccatcgcatcaacctatcatacacacataacttttcagtcacatcgtaccaatttcaacccaaattttcaactttggaaggaactaaacacagccatagg

SEQ ID NO: 10201 - DNA, 891 bp, Oryza sativa
agtataacatcaaagagaagaaacttattaaaactatcacttttttccttatttatataccaatctcattaattcacgtgcctaattagaagtgcaaacacattttagatacaaaatttaacaacccataaaataagtaatttatggtactcattcattatttgcgatgcgatcatatcaatccgaatatatgccattgatgagttggatatgaatatatatgcattcatgaacatgtgcaactgagctttttccagaatgatcgtattcattaattgtttgctccacaatagtaggctgtatgcaggtggagacagggcaaaattttcccaggacagctcaatgctcaacaaaaatgtgtaatctataacagcttaccattttttgcgtctggtctgttgtatttgttactcttttcgaactgtacctcaatagaaagacacccgctctgatgtgtgtcctctaaaagtatatagaagctttttttttaaccaggaaaatgtttgtttgcccttcctaaaactgtcttggaaatctttccgctatgaattcactttactccattttaaattttataaataactcccgtaatattccaatatgaatgagcatgtaaactcagttccatcaaataattctgagcgctcccacactaaacaaaattccgaaaatatttgtttgcattctccgaaagggcagattcccatgaactccgctgacatttctttacgttggatgtgatgggcctatgatctcaggccatcaaaaatgcagattcctttgctattacccgactagatgcaaatagccaaagatagccgaaaatcgtggtagatagacacatggaccctacatgtttattcagaacagattctcccccaaatccctagg

SEQ ID NO: 10202 - DNA, 1501 bp, Oryza sativa
tccgttttctatgtcgatgggatagactcccaactggcacaaacgagcgcaacctaaggagagatgcgagttaagttagaaataattattatttgttaagatgaaaagctaaggggagaagttaaatgagacataattatgatgaaaaaaaccatagattgagatttgacactacatagaaaaaaccaatctaaatgaagatttgatatcacatagataatagaggtatattttatgacggagaaagcgactgctcgtatttgctacgcacagataaatccgtaagcgcatggataccgttgtatagcactttcccttagagcattccaagggtattaaatgcaagaaatgagtgtgtatatctacaaacaggattctacaaactacaacaatttgatgataagattggctagagataatttctatagattcaactagttatcttaagttaaaggtaaaattctatcgaatgcttcgagcattggccctctcttagtttgtcaaggtgaatcttgccttgagctctataatgcacctgaacatggagggatgcaaaggatgaacaaggttgtcaccacctaccgcctatctcactttcagttaagcgcacaacaaataaggtaactgctaacctacacaccacttattgactactaccctagtctcgcgtaggaacttccttttttatcgagagtcttagcactactatatcactttattataagctaagcgacaaacccgcaccgatgagaatatatctcactcaagtaaactaattaaacaatataagaaatctcgaacacttatttataaagcaagcatccgctgaggtacaagcaaaaagaaggctgacagctctggcgcttcttcggaactccaatggaagaatgctgacaaacctgacactcctccggaagttctcggagagaactctcatactttagggcactccttctggaactcccctcattcactcaataatccaacatactaagcaaaacctaaaagtgagttgtactctactttgtgtgttgagctcatcattttatagcttccgtatgatggttggaatgttcgttgttggcggttcacccgaaccaagagttcggttgatccctgggcctcacccctctccaccaactttcttcagcggcttacaggtgggcccttatggcagttgaggattgtttggtcccactttaggtctttttgactgtcaggtgcatcatccaatccgtgtacttgcgtatgattggccggaggtttcttttgtcgcatgacaggtgtattttcatccataaataacctgcatacatatatttaccaaatttagtggaaatggttagttgttagcccctatcactaagttttgatataactttttatattctttttgcaggagttgatagttaaagtttgcacttaatgaccatcaacaacaactattgtagatctattggagacaaaaggaaaaaaaagtattactccctccaattccata

SEQ ID NO: 10203 - DNA, 1501 bp, Oryza sativa
gttttatgagctatcccctgatctgcttgaggtggcggtggcccatatccagttgataattgtaaccaagtgagtattgcctaggatgaaagaaatctgaagtatggcttcatttatattttattggcatttatttatttcggtgtgttatggtacgtataatggttaggttcatagagaaattagagcaggacatccctggtgagggagtgaaggagcaactgtgcatcctttgcaatgtgtacgcgctgtatcttgttcacaagcatctgggtgacttcctgtcgacggggagcatcacagcaaggcagggagcgctggcaaacgagcagctgggaaagctgtatgcgcaggtatggtgtcctccgtcgatgtcaatgtcaaaagtggatgagaaactgagaaatgagacaaatgcaaatgcaggtgcggccgaacgcggtggcgctggtggacgcgttcaactacaccgaccactacctggggtcggtgctggggcgctacgacggcaatgtttacccggcgctgtacgaggaggcgtggaaggaccccctcaacgacacggatgtgccggacggttaccaggagcacctccgccctctgctcaagcagcagctcaagctctccaggctatgatcatccatccatcatcctccctttcttgctctatcaatcatatcatactgcatacgatttgagtagtagtaaaataacaccagcatatgcaaggtgctggctggctgctagtattttctttttctttataatttatttatttggggagagctggtattgtcttatttatttgggaagagctggtattgtatgtctggtgatttggtatagctgtaactgtgaacttcaccacatctcccccttctcaagggcatatgcattctactcctatggctgtgtttagttccttccaaagttgaaaatttgggttgaaattggtacgatgtgactgaaaagttatgtgtgtatgataggttgatgcgatggaaaaagttggaagtttggatctaaacacagcttatatgtatattgtgagattgtccgtgcggcgcttctagtgtgaaatatcctcccttgtcgagcatattaacattgcatgtactgagatacctcagtgtccctgaatgctgacacaacttgaacccaacgttcgtgctgcgatgattcagaaaaaaacacaaaagcacatactcctaaggttgtacagaacttatatagaatccaatgtcaggttcatcctacattcatataggcaagttatattactagtacattcagtcaaaaaaatattactagtacatgatgaacaattccaaccgattatttgtttattgacgtctttgattattttggtatttcaacttctgtatatgtttgtgcaaattcacacaattaatacacttatgattgttctgaaattttaatcactgcaacgcggtgaattagactgtagggcaactgttcttttcggcgacttggtcagatt

SEQ ID NO: 10204 - DNA, 334 bp, Oryza sativa
cttaacaactaaaatatggaatggttggcctgggttggcttgggatgagctgggacctgggtctggttgccagttcggtctgaatcatcgtaggccttgggttaaggcaggttcgtatgggttcacggccttgaataataacattgtgtagctctagaatcgtatttataaaatagctttgggcaactaagtgacttttaaatgctgtttactgtaaaacttaacccctattattatccccttgtacccccttgcattaatcatgcatctgccggtgtggcttgctgagtactgtggttgtactcattcttgctctatcttccccccctttagt

SEQ ID NO: 10205 - DNA, 1027 bp, Oryza sativa
  unsure (1)..(1027): unsure at all n locations
cttttcccccttccctttccctctctcggccgccgctccgccgtgcctatggccgccgccagcgaccataggggcgcgggcgctgcctcctgccgaccgcgccgagtggccgccttcgggcacgccgagtggccgccgcgtggggcccggccgtcagccgcccacgtccttaggtgcggctgaagcgtggggcccacggcgccgaccggtgctagcccgggtgcgcccggtccaccgtggaccgtgaggctgccgcgtgggccccaccccccgtggacccggtccgcgcgccctctcccctcggctgacgcaataaaccccttcttaaattaaaatttaaatgaagaaatccgcaaatattcacttaaagagcatataaacttcaaatggccataacttggccatttgaactcggaattgaaccgttcaagtctctaatttttccttaagaagtcaagaacccatttttatgttttgttcctgctttttccattccgttggtcgtgtagacgctgcagcttcagaagatccgcttttcgtggaggttgaagccgacgtttgggaaagcgagcaaggcaagtcacatcatccttgagcatattgaatcccagtttataaaattattttgatttaaattattgtattatcgctttatttaaattcccgcgttatcactgttttatttagccatgcctatttacctttgttacgaccttattattattgctattgttattattaccttgttcaccctaggataaacaaaaccccaactagtgggtactctattcatggttccactagtatgaatttaggtagatgcttcgctgattaattatgcaacattaggtggttttataactttagactttgggaatactcttatcacctggacactatggaatggttggattattgtggaattggattcacacctccccctctattcaaaaccctcaaaatggttntaggctgggctcggggtgcatggttttgacagtagcacctcggccatatatggaccggt

SEQ ID NO: 10206 - DNA, 1501 bp, Oryza sativa
taattactactcatagccagtactgttattactgtacatgtataaatacggccgggatacagctaacctggccataaatatatatattgctgcccgtattcctgtgagatcgatatatattgctgaaaagaaaagaaataaagaatgagtcgtcatcaccagcaaatatgtatgcgtgcgtttaacttttgaattcatgtcgtttgcgcaacagaaagaaaatagtccagcaagacgatgagttgtaaaattttgtttgtatccatctacaggtgatggttggcgtcgttccgaaatcaacacgaaagagaagaaaaaggaaagaaaaaggttggcgtcattttgtagtatatacgtgtaggtgtatttgcttaactacgacgccagcatcggcctttatttcttttgagcatgtagttcgatgggaagtgttagctagctaggcatgtagacacctggcatggcatgcacagcctccgaggccagaatagttgtgctgatgatatacacacaatagatggcacgcatccacgctcgatcggttgatcgatctgccttttgagttttgtacacatccatcttttcctagcatgtatagcgaaaaagggcaagtagtaaacatgtgtacacgcgttctgaacttgaagctattagctatatatctatcttcctcacaactctccttttaattagttcttccatttccacaactactccatatttccttttttctcatttcttcgatttgtgcgtcgaactgcagctgctggtatccagccgccgcttctccgtagctactttcaggccggccgaccgagcggacaggtaaaccggtgtggttgtggcggaccaggccgtctatcatctccgtaggttgttctatttgatccatctatgcatctgtattgtattgtattttcacgcatgtatgtcttataatatcctcttatccggtcattggtcaaacagactcgcaccagctgctttcgctctcccttattaaatcttcaccggcgggtcggatcgcttttcccctttcttttggtttcagatctacacccttgtaaaaaaaattgatcccttggtaaaaaaaaattaaatcatagggacatatttagataagcactgtgtccagattaatctatgggattggtttttttttgaacggagagagttatttgattagcttggtattttctctcttcgcctcccctaaaaaagatctttcttctccttttttttctatctaaaaagaatatatcttgacaatttctgctgtttttgttttgtttgtgttcaaacgatatgtatgtttgatttttattttgttaacttttgatatactaatgatctgttccgtaggcagatttattggtcgaacaaaacttccaaatctgtttatcgaacaaatcatgaatataccaagtgttagaaaaaaaaaaccatcaaacacaagtaactcagattgaagttataaaaggcaagagcactatatcaagtg

SEQ ID NO: 10207 - DNA, 1501 bp, Oryza sativa
gctttagctttagtggcaggcctggaagaggaacatgagagaggacaagagaggcactatgccaaattgtcacttaataggatttaaatcctggttccaacaagtgttacacgtatatgtctgattaacaggaatttattaagacgaggaatttgtcactagacttcatctcttccattatcatgtgttataagaggtatactcacaggtatttgtgcacagcttccatgtaattaaaaaaaaggcactatatagtggcaaattcagagtaagggctcgtaactagcgcgattcaatgtcaatctccaacctcacaattacagtgctcatggtagtaagtttttgttatttacactgagatacacctaagagaggttttccattattgtacaacagtaacaacagctggatggcttgctatcaatttgagttttcactgatacgctagcattctgcagagaacaaaaaatatgtcaatagagcatgtgccaccggcccaccggcccaccgccccacatgaaagtattgagttatgaatcgctagcataacagctggggctttcacttatgtgctgggatttctacagagatcaacaatgccaacagagccatgtgaaaactgtgagagttttaaactataaattgctaacagcaacgtccacaaatttccaccataaagcaggaccggttttatgccttccagacaggttcattgtttcgttgaagacgccatgctggagagcgaagaatgttttgtttaagaagctagagtagtggggagtgctttggagggttttctacctgtttatttttggttgcaaagtatgttgttgcaaggcacatgatctgtcttagactgtttcaccttttattttattttcctattttgactgggtacattttagtaggtgcagatcgagtttacctcacttcaaaaataatattctattctgtcaagagagattctgctggtgtcttccacggatgaaaagctgatgttaaaaaaaaaaggagttcctttaaacaggtaaacatgttcagatattcaggcaactttttgcgagtttgccaattatgcatgacttcaaatttgcccaccgtgtgtaagggtatgtactattagagaaaaacaagtacggttttttaatgattaaaaaccaatacttgacagtcttgcaataatgtggacggcagatgagaagaccctgaaaacatgggaatgcaataagaaaaatacttatatattttttctatttatttaatgtatagtgctcgtgtaagttttataacttttcttttgaagtgcttgagcctaaaatctaccaggcctagcaaatatatgtgaaggaaacatgaccacgatagtataactgacatgaaaccaaacagaagttcttaatctcacatcaaattcgtttgatcaaaataaagaagaaacttatatattggaggaacacaaaaggcactggagttgaattctatcttacatggccaacttatg

SEQ ID NO: 10208 - DNA, 878 bp, Oryza sativa
acgccgccggtacgccgttcctgtccccgccagatccggctggagcggagcggatctggtggttattgccgccgcctctctgggtgactccctaggtcacccgagcgtgcgagagagaggggccccgccgccactgtccttgtggccgtgcgccagtagccactcgggcggcagcgaggcggaggagggaggtgagggagaaggggcagccgggtcgtcacctcccgtgccgcccctagggaggacgacgcgagaggatactgttatgttcccgaaccagaggaagtctcatccgaatttcatgaatcctacgtctacatcctcatctgcatgactaacgaacgggtccttggagtttgatttttagtccaatatgcaagatttggggtttaattttccatcgaatacaggtaatcaattccttttttatgagtctgtctattatacatttgatgaaaaaaaacacccatcaaaatctaacaacttttgaacaattgcttcgtatactcaaaccctaattccttccacttttttccttagcaggacacgcctaaactatcacctactgcatgtttctcgtcatcgctgtctcctccattgccaccagcccagcacgccaccactcaactggccaaaagacctcaaccgtgccagcaagaccccacaatcagcctcctaaacccacgtaggattaaggaggccgactagagggggggtgaataggcggttttaaaacttaatgacacttaaacaaaactaacctaagttgctaggcaaggtgaggtgcaaggttaactaagcaactaagttaagttttgcaaacctaagtgatatgggctcaaatatgtctctatgaatataaatagcacaaatgtaaa

SEQ ID NO: 10209 - DNA, 1501 bp, Oryza sativa
accattggagctctttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccagggctacacctaatcctccacaccatcagcatcattgtagaactcttcctctgatgaatgattgcaaggtgagtatatgacatactcagcaagtcacgcagcaaatatgcaagtgcacaggataccaaaggatggcatagtagggtttcatttgcataaacagcatttaataaacatttcagaatttaataaaacagttaagtaataattaatcaatattaaaccaacgctatacaacataccctgttgcataggcccaaccattctgaacaaccatcccggctgcacagttctatctccaaaccaggaatataccattccaaaccaggagctaaacaaattattaccagttatagcatcttttattatgatgagaggtgtgagactaatcacgaaagacattgttagacccgcccataaccgcgggcacggctattcgaatagttttactctgatcagaggtgtaccactgtacccacaagacacagccccacatcatgtcaccatgtgcctcaataccaccacggtacctcggaaaggagctgtgacaataccctttgcacaacacaatccactacagcgcacctttcctggatcataatcacccccttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaggttttagttggcaagtaattaattaaccaatcacgattgaccatcgtgaactatcattaagccatcattaaataatagtgaatcttaagttatcccaatagtgtgctaatgtttctaagcatggctaagcaatcatatctaatatctagttgaaccaatatatatatagcccaactagtcaagttgtaataacccaaggtatcaaggaataaagtgatcaagaacaaaaaaggctataacaaacaataggttaattccacccaatgacattcgaaaataaatgcaatagttgaatagaaacagtagctttaaacgggatcaacatgctcaaagggttgtttaggatctgtgtgacttgccttgctggccttggaactattcaaattcttctcctgcgaaaacggactctccgga

SEQ ID NO: 10210 - DNA, 1501 bp, Oryza sativa
aaacttgttttttttgtcatggtggggtatcgaatcggttttcaaaggcggttaatttttttccgtgttgaatagaaataggacttttttttttgcatttttctgccctttttttaaattttatggtacgataggaataggaatcagatgattttttggggcgcttctttttttttttttgccttttttacgttttttttgccgcgtcggaatcggtctttttttgccgctttttttttctcgccgccctttttttcacccttcctattttttttcgcgctggccttttttttttttacagtcggactttttttacacggacgaaggaaacactttgtatttttaacagttccggtttttttcatccggtttttttcgacggttttttgtcgccatttttttcacagaatcgaattatttttttcgccggacagttatggttttttttggcccggtttttttcctcgctcgccctgttttggtttttttcctcgctcgcccggttttttttcgccggtttttttgacggacgatggaagcatctcttattttttaagtagtagagactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgcataattaaataaatttacaagtaaagcaagtgtgagaaataaaatgacatggttaaatttaatttttttttaaattctccatgattagttacgctctttgaaattatatttgaatttttcagagcttaattgttaattttattaatacaaacgtcatttaacaattatttacttggaaaaaagaaagaaaatacttccttttaggtttgcttcgaaatgaacacattcaataacttataattgtaatgcttctgaaaaaatgagcactaaaaagaaacttattctctttttttggcctgagggacctaaaatagacttatttccggcccttgccggtcggtccacggccttttgtgcacgcgcaagtgcacttcccatcccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagctgccgaaactctagcccatttccctccctcccatctcacatcgccgccctcccctccgcgcccccgagcggcggcgacggcgcccctcttcccgcgagcggcggcggcggcgccctcccccacaaccaacggcgcggcgccctctccccgaacaacggcggcgtggaggcggctgcggcccggcgggagcgggaggggcggcgggccggacctcg

SEQ ID NO: 10211 - DNA, 1501 bp, Oryza sativa
gttcgtgtgcaagcggggacaacactatatatgttgccacgtacctttcgatccagctgttttgaatatcctatatcccgatctggactgtcgctggtgcagcgcaacattttctgctatgaagatgtgacttggctgctaagggccggagaaccgagaatttgtagtttctgtcctcgactaacgactagtggcgatggttttctatgaccaacacagagccgcggagttttgtccttgagaggaggctcctcattttttacatatcgtgtaataaaagttacaaaaaattttaaaatatttgataagatagatcaataatgcaacttcaaatttaatctatatctgtatataaaaattgataactttccaatcgtcacatcattttttgtttgtcggtcaattgtagttcaggtccacctacaaacataacctacatctaggagtcttttccacgacgtattccactctgtttttttttactttcgcaatttttaggcgttcccacccacgtgattttcatatttctctcgcaaggcaaaataagcaacacgagcgaaagcaagagagacattacagatggcaatatataaatagcaacacaagacaagacagatcgcagagccctttctttaaggcgtcaagcatctctaatcccaggttgtcagtacaactctgacggagcgtggggctcctcaccgggagaccgtgcaggcccccctttgccggttcggccggggacgctaagtgaggttcttcgccctcgatatgaggaatgtcaacgagaagaagcgcacaagacacgggcgacgtagacaggttcgggccgctgagaagcgtaataccctactcctgtgttctggtggatctgtgtgtgaaggaatacagagagctccagagccagagagctcgagcgccagagagagttcaggctctccccctccagtccccccttcttaggcctgggcctcccctttttttatctggttaggggtcaccacatgggcctctccctgcctaagaaaagaaacatgctttttacaatgagggctaatctacagccggaaatgacctctgacaagcagtacacacgcctcctgctccgctcgtcagctctcccggtggacgcccgtttcatccttcattcaatggccagcgattttcttgccacgcttgcgctgaagcctggaatggatctgaccgggactgacttaccaactccaggagtcagcacgccagctccggctagagacgagagccaggaagctctcatcattccgacgggacggggcgaggcgtgtgacaggccgcctgttgccacctaacccgcgatctgaccggtctgtgaccggtcacacaccgcgattggtcacagaccggataagcatgcgctgcgccgcattgaatgcggcgtggcgcgctcgtctaacccgccataaatgcggttaggtgagcgccgctgtgctcacctaacccacacacgtggcgccaacaccacagg

SEQ ID NO: 10212 - DNA, 1501 bp, Oryza sativa
tcgtgattcctgtgcgctttcttgccatggaactcgctccattgtctgcaggtttaaggcctgaacagaacactcgtgctgtttattgcgagtttctgacaagagaataagatatttgcatggaagaacatgcatcttattacaatattactgtacgaatgatcaagcatgtttatggtttagttggtcaatgtgatgcagacatgtgctcatgtagagaactagagatggtgtagattttattttgtatgacatcgttgcgttcgacttgtcgccccatgctgtagagccgagggtgttggaaattctgactttggctgctgctgctgcaaacgactgatgatagcttcgtgtctcatttttctctaagctcgtgctcttcttttcccagccttttctggccggctttggtgacaactgagaaattaatactgattttgtttcgtttattttcgaatactggatatgtggtagtggtacttcagaatagtccaaacagatagatataacgcgaggcatgtgttgtttgtttctttggaaaaatgactaatatattttgtcttggtgtggaataggggaatattttcctttttcttgtatcctttttttttgtggatgataatttcacattcactcaccccctccccctatcttcaatgcagaacatggtgaatgtattaatagtattgtttgttcagttagctgcatccttttgcatagctatccaaaaactgaaaagtgttattgtgaatgaaacacggtagctgcagtggatatgaaggagctgcatgcaagcttgattagaatattattttgcattttaagtgaagtttttaaaaagatcttcaggtgattaagtaaccagattgtccccttcctttgaatttggatgtatctgatcattctgctgctgattatttaatgttttaagatatctgaccatataagtatcagaagggatgctcacccccccccccccccctgatgatgatgtcacgaatgcttgcatcatcaggctctgtttccacatccctacaagtatccaatgtaatcagatgtgaaccaagaagacctgtatgcattaccacgtggtcaacgggaccagtcccacagtacccatcagcataataaatcttaaattttattatgtaatttgtgttttgcttgactgcattgacttgctatgagtaggtctgatcagttgcatttatatgataaatgtggttcatcgctcttcttcgttgtgttccaaatagaaacttgaagtatcatctttgtgttttacagtttatattaatgttttctctcaactctgagcaggatagcaatgtttggaaggatctattccttgcttacaagactcttggtgttgtttttggtggcctcgtcacttctcccctctacgtttatccctctatgaacttgtcatctcccacagaagctgactacctggggatatacagcataatgttttggactcttactttaattggtgtggtca

SEQ ID NO: 10213 - DNA, 170 bp, Oryza sativa
cggcggccggcgggggagcccgcgcgccgctcctccccccgccgtccgcccgcgcgatgaatttggcttttttttcgttttcgtaaaccctgctccagagtaccagagagccaaatgggcctttttctggtcgaaatgaggagcttcgtgtttctgagatttgcgaattg

SEQ ID NO: 10214 - DNA, 1501 bp, Oryza sativa
cgcggcacaagtcgacccaccaaatcttgccctcaaaaaacgaatgaaatgttactgttccatggtaagtggatggggcatgtgagtgtcttcatagaccatactccggaagcagaactgaattcccaaagctgtgccttattactgtcagcctcgagaaccagttccatgactgagtaactacgcgcgacgaccccttcgtgattgtgcacgacaagagcgaagttggtcagcccggggttggtgttgcggtcgggcaggaaatccgccgccgcagagaacgtgtcaatcacgtagaggcagggacctatgcgggaaccacccttgtcgccggcgacgaacgggcccccgctgccgctgccgctgccgctgttgctgccgctgccgctgtggtcgaacaggacacgggcggagtaggcgtgcacgaggatgaccccagaagcgtccgccgctaggacgaagggggcgaacgggccgaggtcgccggagaggaagcgtccatgggcggagatctgcggtggcgccgccgtgaggtaggcactggatagatgaggtggcgccgcgagggagagggagctgatccgtggcggagccgcgagagcgagggagaactccgatcccttggagggcacgtcggccggatatactcgtgggaccctccacagtatcacccactgcggcaccggcgtgtcccaccgtgaagatggcggcgccggcgccggggggggagacgggggcggcggagaaggagggggcggcgccatccggggctccgatagcgctgtagcggtcgatgcgtcccgaggcttagagttggaggaggaattttggatgatttgtcggatgggggcggagcggaagcggtggggagggtttcggagcggcggcgacggcgaggactacggcgagggatagcgaggcgtgcgtctgcgtggggatctgtgggatttaaatggatttccgttctcctgtccacgtggctgtgccgtgtgggggaagaaagcctgcccccacagatgctgaggtggttgtcgacgtggcggtgtcgtgcggtcgaagaaaccagtctgccctgggagattttaacctgctgctggcccgatcgggttaaaaataatcaggttctaacgtgtagtgaatttgttcgggcctgcacataaccgtgtaccgcgttcatccgagcgggtctcaactcgttgacacgtacagtatcagtaccaaatgaagtactttactacagttcaacatgtgcacattcttgtacacggtgattggtagtactagtagagtagtagtaacatagtactgtagtagtactccatgtgtcgtcgccgtccccaccttcgtccacttccccttatccggaatcttccttccacctggcctccccaatccccatgaaccccggcgcttccacaccccccctcctcctcctccggttgagatctcccttcgccgctgcgcatcctggcccagggcacgcaacctgaatgagcaaatg

SEQ ID NO: 10215 - DNA, 1501 bp, Oryza sativa
tgaagtttggtttgtgatgctagtcggttcgaagtactcaaaacattgaagcatgcattatggatggaaaaccttctaaattctcatcttgtcgactgagtaggtaaattttgattgactcgatggtaactttagttagggcgtgccttcggatgattgatcataccgtgcctcattggttcgcagccaatcttaaccaagccaaaaactccgttttgtttggtttgtaccaaaaaaattgtcttgccaaattactttttttattcgtcttgccaaattacctagtttaatgttaagatgcaacttggatagcaaaccaaacaaatgctagtcatttgcgaaaaattttggcaatggccaattcttgccattatattcaactcgttgcattaaatgtggagaccacggtgttatggtcttgtggaaggggtacacggtatagacggatagaccggcttgtctagttgtctccccgatgaacggtactaggtcggcagctttccccggctacgtccgcatgtagatgtagtacagccgaggccgccgacgagaagagcaccgcgcgcgtacgtcggtcagtggcatcacgattcacaaaccaacacgacttcacgcgcgcgtgaaatgggaccgtcgtatcgctgaggcttgcaattggcattgcggccacactcgatcgtgctctcgtccccagacgcggtgcgcgccgtctccgttcgggacaaacgccgacgctatggagtgtggaagtacctgcacactactgcgcaatgcgcaccgtggtgagcatcctgtgcatgttagactctaaaaactgattgtgaacttagccaacatgatcacctcttctaggagcaagtttaatattatagccaactactcgtttcaaatcatctataatcaatttagtagctaactcatataatctttatctataaacatgcactacataatttatacttggtcccacatgttatacacacatatatcttggagtctgtaccgcaattagctataaatatataacccgctacttttctctcttctcttttatcttctcgacagttggctttagcttagattaactatatagctgcctagattttagcttaaattgttacatgggttaactaacaaaagttatacgtggttgcaaacctcaaattaaaatgatgaaatgatgtgatactgaatcatccatatactaaatatattgttgtatttatatttaggaaaaagtacgaattacctccggactatcgtagtcgtccgaattactccctgaaccacaaaaccaaacattattcacccccaactacgtaaaccggacaaattaccctcctcgacccaatccgcggtggttttggtctacgtggcagtcaagtcaacaatttatttattaaaaaataggtggcccgtctgtcagtctctctctcttttatctctcactctctctctccacctgaggacggtatagttggccataaggcccgaggcccga

SEQ ID NO: 10216 - DNA, 1501 bp, Oryza sativa
atgttttgggtggatacgggcaaagcggcgtacgacaaaccttccagtagatggctcctttcacatgaactggagttaacctgtcaattgggtatggtggatcttcagtttgcctccatgcatcagtgcccagagtaagcacttcaaacttgcagacctgtcttgttgtcggataatccctttggtagaaagctctagccaccttgtacttgttgctgtgaggatcaaacccaaatccgagccccatgccgccacataggctatggctcccttctggcagggaaacaatctctcttgtcgatggattgcagatcatcatcttgtgcttcctggtagaaatgaggagcaaaccatcgcagtgcaccggtcgaatccatttacggatacctcgaggaaaatcctgcagatgcattatattaggatcctggtatttatacaggctcatcaggaaggcaatattctcaccgttcttcttcatctcgaaagagccagggatcacgagcagtgatggcctctgcttggagcactcgagatgagcattgacgaaacgggagctggatatcgtggcgtgccaagccttgcacaccgacctgaatcggatgagagatttggatggcagccatgagaggattttgaacagcacatcttcagggatgtaacggagcaagatcgtcgaccaggagttgatagcaatgcgcatcgcctttcgcggccgagtagatgatacctgaatgtctgagcatcttttcatcatctccatgacaagaatccctgaaactgcaggagatgagagcgtcaagatgattggttattagtttagttatgggggtctgcctctgcagactgcagcaacatatataacaggagaattctctgtgcaaatcggattatgtacacctgaacttaaaattctactcgggctagtaaagtgatgagaaactaaattcggttcgaacttgtcaggtggcggcggttttctttcacaaaaaataaactttttctctctttcgggcaagatctgcagcgaaacctaaccttaaagctaccaacaaattcagaaaatataaccatgttgatgcagagatgaaactgacccaaaattatcagcgagagccatacagaaaaacttcactggtttcagagaactcaccggctgtacttcggcgccggcggaagtggatcccgccggcgagggtggcttggctgagcgacggaggagggtccctcgcgtggttgcgttgcgcgaatagcaatcgagattgggattttttttcccttttcttcacaagagtaagagaaaccgagtagaagaagaagaaattacgtgagtgtcgtactgtcgtccgacaacccggcctaccttttcggtccacctgaatatggctcgcacacgaatcgcagtcccattccggcccacccacttatgggcctcacgtgagcccaagtctcgtttaggcccacgtaattataggcagctcgacagctcgtaagtaaaaggaaa

SEQ ID NO: 10217 - DNA, 1501 bp, Oryza sativa
acattcattttctggcctagattaaagaaaatggtgatgaagataagtgcaacaactatcgacagtcctgaagaagattttagagcaaggtcttcttatttttcaaggggcagagcttcacgtagatttagttgggccttccgctcgacaaaatttcttaagctcataagataaaacaattatgaggctgtattctaaactcccctttcccaaattatatctcctcattttccatgcacatgactgctaaacggtgtgtgttttgcaaaaagaaattctgtaggaaagttgctttaaaaattatattaatccatttttaaagtttgttttagctaatacttaattaatcatgcgctaatccgtcgcttcgttttgcgtgccaggggtgaaggttcccaaccctcactcatgaacccaggagtgattttcatatttttccgttaagaaaaaaacaattatttaggggcatttttttgtaaggtgggagcatgtttttataatatatttatttggtgttgaaaatatcgttatacttttccacatacttgatcaaaattgaagtgtttgacttaggacgaaatgaaacaccttatattttgaaacagaccgaatagtgcacttatgcaactattgggtgaaatctattttcaaaattaattaatgatcattcccctatcacttttattacattttgaagcttttgtgatgtcgacgagctgtacccgtctactgtatttatatagtatgtgagacatcggtactaaggtatacgcgagattgcagtaaagtaagtgggagacatggatttttatacatattcggacccccctactaacaagtaatagctctactcctgttggccgaagccagtgttgctattatataatcaatctcccacaaatacaatggggaggagacctaatctagtctatgtcagtgtagcggcataaggctcaaataggtggtctacgggtatctattgtcaacttcctcgaacaggccagaacatcagcgagattggaggttgcaataaatccctcttgttgacttttgcggtgctcattcgattgtattggcctcgtctgggttcgtcttagcgtttgttgatgtatctttgcttgtcccctctctcctgggagtcatgtatttataccctctgatgccccttatccaagtagaactacgaaggcaggtatggatattgtcagggttatggataccacatacctaatagtagttgactaaatctcggcaagacccaccacataccatgtcttatacgaaaacaaccttcggatataggaggagttccgcataaggaaggatgaccagagttctacatggaaacgactaggactactcggattgtatccatactggtttccctagttctacttggacaaggagacacctatgggtatagatacaaggtcccctaggaagagaagggacacacccaccatagaagacacgaaacaatagatcaagacagaagatcaac

SEQ ID NO: 10218 - DNA, 1501 bp, Oryza sativa
tcaatgatttttgttgtagacgttcgtcaatgtagccgatcatgaagtaactgtggttgtcggtgtagccgcatatagccaaaggcgaaaaaaaaaaatttacgccatggtgtgaagacaaaaactgtaattgttagcatcttgcaccttgtagatgtcagaggatgccattagggacctcttgcatatgtcagaggacgtcgttggcaatgaggccaccactttggttggtccttctgcgccgtatagcggtcatcacaatagtgatgccgggttgatgcagtcgttgtagtcgtacatgacgtgatcgatgccgttgtcggtgacgcggtcgttgccgtcgtagaggacacggtcgatgtcgtcgatgaagcgtcttgcagattaatctgtcagaggacgcgaggtgtccatctatgtagacgagtcggcagcggcgatgcagatcgatccatggatgaggccggatggtatgatgcttgttgacgttgtctgctcctgtaacacctgccgcattgctcctgacgatcatatggttttctgtggctagctaatagatctaaaactaattattagaaaacgcatctaatgatatgcggtaaactaatctgtaaatgattggagaggctagctagctaatgcggtgcggtgccccagggagaaattgatctcatctccctggggcagcgcggatggaacctagctggaaccgaggatcgatcgacgtttgtctacggctctgataccatgtagaaaatctaatacgctgtattttggtattttctgatatattggatcgaccctctcatggggtatatataggagtacataggggatagagacttggagtacaatacaaataagagtagatttatctttaggattctatctctaggactctatcttatctctaggattctatctctaggatatatcttatctctataatttgtatttgactcttatctctaactaccatattattttcttacaaataggttcacagtaccggtgtcattggcactgcccctcttcacatcgctgacttacttctgtaacagtgtgagtgtggtgtcaataaccctgccactgaaaatgggtctatttatggaatataaagttttttaatgtctttttgtaaaataatttttttaaaagggctaaatgtaaaaattccatatacgtgcaatgtctctgtcgtcggtcaaaccggtgtctcaggtcaggcttcgtaggttactgaatgttagcacgaacccaaagctgtgcgacatttgcagggagaggaatccgaacgaatccaaaacaaaacgaaccaaagctgtgcgtgtgcgcccgtggcccaggacgacgagccgagccactgcccactcccacctccaccgtccctgggcggccccgcgtgtcgcccctcggcccgacaccacgccaggcgcaatcattagtacggtcgagtaaccacgcaataatttcccggtgattgggcctggtccgcccggtt

SEQ ID NO: 10219 - DNA, 1501 bp, Oryza sativa
gccggtgcatagggcgtacggcggttgatctgattgttgttgaatgttgcgtaatgttgttgttgctgctgctgctggactctggccattgctgatgattacagaacgctgaagcattgattcattgttgtgaagctgttaaatggaattgaaaagattggagtaattgattccttgcgaaattgatgcgcttaatttctaagctgctagcatatgatcgaagaagatattttgtggctaattgttgagcatttaattacgcagatcagccacgttgagaaactaattaagcaccatgccggtgcatgctaatctcatccgactaatcggtgattaatcagttgcagcctctactaaactcaacccgagatcgagggatcaggaaacggacgtgaacaggtaggtaaaagttgtttgtatgtatttgcccttaatggtacaaataaaccatgaaaatcaattaccattttaaccttttaccttctatacctggttcaccttttaagtaccttttccatcataccttttatcctgatgcattggattagagacgatcaacggtcgtaatcaattcccagcacggatgaacctctctaaataaaaacgttgagctctagaggcaaatggaaaaagctattttgcttaatcatttgcttatgggaagttcggttcgaggaatcaaaccgtacgtctaaaataaacaaattgatcgatcagtaaattatttcacagtttttaggaaatgaccaataacttttttccccgttaagatgtgtttaccaaagataagttgacaaggtaccagcccatttatttattcctcaatcaaccattataaaattggaggcatgcatgtgcatgcatgactccaatccaataggttttaaaccccaatgactacggtctacggatatagatggccataagacccgaaggctcggcccacggcatggctttttggtctggcccaagcacagcatggcccgacttgggttgggcccgtgccggcccggctcgaccgacgggccgtgtctgggcctccctaccagcacgctgggctgatccgacacggcacgatgggccggcaggccaggcccgccacataaagtgtagggactaaaaatagacatataaatgtcattgtccaaagaatagggaccttaaatagacttatttagctatttatataccacagcccaaagaagagggaggtaaaatagactatttttagctatatatatgtcacagcccgataggagggaggaaaatgagacttattctgaggaaaagcacgatgacccatcgtgccttcgggccggcctggcacggcccgacgcatgttgggccgtgcctgggcgtggcacgtggactggtacggcatggcccggtgcatcggtcgggccgtgccggcccgacaagcctcagcccaggcatggccgggcctaggccgtgccgtgccgggcagcccacatggccatctatatctacagatattgcacat

SEQ ID NO: 10220 - DNA, 1501 bp, Oryza sativa
ggagaaaaaaaattttggacgagaggaagtttttttttcttgcggatcacttaagacgcccgcatgcaaaaataggctcatttttgcatgtggccccttaataggtccaccaacgaaaatatatttttgcatacgagcctcttgagaagctgcatgcgaaaatagaggttgatttttgcagaagcaaccaattatgatctgcctacaacctataggggtcctcgtacattaaaattgtttttgtattaatggaaattagcacaaaacaaatacattaaaatcgttcttgtattaatggaaaatcgtttttcgtttttgtattaacgaaaaatccctagcaccagccacaaatatactggtaaggcttgtgagcgaacattcccccatcgataatctcgcgaatggatctatatatacgaggatgattacaggacgcgccatgaagtagtattgttctattcccaattttccatttcttttcacatgatcctcctatacatatcaagcttttttgttttttccgcttccttttttcatatttatttctttcgttagtcttttttatagttttattaatggaatttttaatatgaattattttttatagttttattaatggaatttttaatatgaattatttttttatagttttattaatggaatttttaatacaaattatttttgtggatacttagaatttagcaagaaaaaaactttaaattaccaacgaaaaatccttagcaccagcaacaaatacatcggtagggcttgtgagtgaactttcacccaccgataatctcgcaaacggatctatacgaggatgattagaggatgaaccatgaagtggtattgttctattcccagttttccatttcttttcacgtgatcctcctatacatataaaccttttttgttttttccacttcctttttttcatatttctttcttttgttagtcttttttatagttctattaatggaattttttaatatgaattatttttgtggagactttcttcatacattaactttatatatgcgaagcccaaaatatagactttacatatatagagtttctatatagattttatgtatatgaactttcaatatatagactttatatataaaatgtttctatatagacttcatgtccataataaaatttatatttgcaattagaaagtttagtgcataaactttaatagatattaaaaatgctgatcatgcagcacccaatattttttttgaaaaaaagaatccaattgaacgaatctagtaaagtaaaatttgtgtggcagcatggatttggtttataactgaagaaacaaaaaaagtaatcacataattaggcatgaagagatgttatgccatgctagacccaccccaaatacatagcatactcaaaccccactaccatgatatgttttatttcgttgcctgtcacgtggcgtgctgcgactcgacttttttactcatgataatgtaacttttgtggggctaac

SEQ ID NO: 10221 - DNA, 1501 bp, Oryza sativa; identical to SEQ ID NO: 2616

SEQ ID NO: 10222 - DNA, 1501 bp, Oryza sativa
gcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctgactcagccgccacatagaataaaaccagggtcaaaaccgccgaaagacctattgtgaccggttttgattagttaaggggcaccggatatctggttttgcagttgaggaatgattttgtaactcgatgataagttgagggaccttcggtgtactttttccgttttttttggcgtcgagccgtcgacggcgtgcgattgccaataagatatcagacgattggcttaatgatttgatggtatgctatactgagcgagagatattcaaaagtattgatgataatgcaatcatgaagcgattccaagccttgaaaacccccaaaatatcctttcctcgtgaataaattgtaacagcttagtggtatgtggtatgttgcttcttttagttagcatttgtttacttctaccatttatgcaatactaattttgctcatttatatattcaggtggctgctcactttactctttgctaaggcccaagaaaattagcatcttaagtcaaggactcaaggtattcttttataagtatatttttctattaaatcatgtaagtgttacatttgaattgataatggcatgtgccttattttagcattatcaacttaaatttagacttctagtccagcctatcctcaatttttatcctggattcgccacttgggctaccttacactagtacagatccttccatctgtgacggcccataacaagactggaatttgcgggccgtcacaaggaagtaatttcaatcgggccgaagtttcgcccgattgagatatggtcgcacagccatggtatatcggcataaaactaaagcccatcacggatgacacttatctgtgacgggctatagttgaggcccgattgagatgagggtaccatatctcaatcgggccctaaaagaagcccgtcacagatgagggtcatctgtgacgggctccaactagaggcccgattgagataagtttattgcccgtcacagatgacactcttttttgacggccttttattaaggcccgatagagattacttgtatgcccgtcatggttgattgttttagggccgttacagatatttgttgcacagtataaataccccccaccacctagtgtaactgtatcccactgttcactattttggtgggaggctgtagggggcgattttttgtc

SEQ ID NO: 10223 - DNA, 1202 bp, Oryza sativa
attcctgcagcccgtcctggcaccggcgttgtcttcgtctttggctcgatttgacctggatctggcgtggtggaggcggaaaggaggcggcgaccgtgggtggtgggcgaaggaggcagcgacccggaggcggtaggcgaaggagccatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaa

SEQ ID NO: 10224 - DNA, 1501 bp, Oryza sativa
aataaaaaactgaaggaagaattcccgtggggacgagtcgagcggctgcggcgtacctggtcctcgaggtccatctgggtgggcttgcccttggcggccgggtcagagtcgacgtccatcggcagacggcggcggccacgcggcaagctggtggaggacaaccacgatgacggcagcgggcaggaagaagcgggaggaggaagaggaggagaggactgcaaggtggcctgccgcacgctgctctcctcccaccgccgccggtggatccgtgcgaggtcaggcgagggacgcccgccgccactggatccgggcggaggacgaccgtcgtcaccggattcgagcgggggacagccccgccgagcccgtcgctcgccattgccgcagtgcgtcgccgtcgcccgtcgccgcatccatccccgagcacaagccacagccgcaggggagagggtgggcgccttctctgcttcgtcgccgtcacctcccaagtctggtatcccctcccacacggcggcggcggcaggcggacggggaggcggtggtggcggctatggaaacgaggcggagcggcttggctaactgcggtgtacgggagggctagatccgaaaataatggagagcgcggggaaaaagcaggggcgggttctggggtggggccacagttgacgattactatacgaggaggggggggggggggttgctgcggggggtgtgttttaacgcctacacctcatatgtagtatagtatctatataatataagactattatatttatgactttattataccaggtattttttatgaaaaagtttaattttatataatgacataaaactaatatttatttacttattaaaacagtatatgtagcttttttttatgatagttcaacatattttctccagttgtatatattatataggaatgttttccaaaactatatttatcattttaaaaagtgctacacatactttttaatatatattattttttatgtacaacaaacttatgcatatgataatcacacaacaaattttatacttccaacaatacagtttacaaatttctacttatttctcacatattgaagggtaaaactaacttttctatacctattaaacggtcaactaatggtcaattgatggcaagggtacgaaagggatccaaatcaaaattcagaggtatataaaggagtgaagaaaattcaggggcatagaaggaatcggctaaaatttcaaggatatagatttgaaatgagtggacgaaaataggagtattgcaattgatgctagctttgagcaggaaatgcaaaagtgtttggatcttgattttgcttcgcagttaccatccactgaatttttggggccgttgttcaggtgctgtccaaatggaaggaagggagtaatacaagcaaagggacatcacaggagaaatgaagtcaacactatgcccatatcctaaatgcaattgtgatgctttgctgaaaatatgctcacggatatt

SEQ ID NO: 10225 - DNA, 931 bp, Oryza sativa
catgttgggccacagaacaattggtgccaccatggccacaaccgatttgaccataccctccaccacaacaagcaagtttctaattggttccctttcaagctataaaagggagtgttgggaaaaatttcttctatacccctgaaagcttacccaatccatctatgccctcgagttttgtccactcccttgtatgcccctgaattttgattttgatccctttcatactcattccattagttgaatgtttaatttcaatgaaaaggacctttttgcccttagacatgaaggaaatctggaaattgtagactagctatactcttggaagtgtataattttgttatataagactgggacgcgctaaactgcacccagggtgcgttataactaaaacgctcgacgcaccgtacccctccgccccaacccacccaccccaccaccgtaccctctacctcttccctctctctcgaacttactctttccctaactaaatcaattactatcagttgtttttgttcgataagtaaacaagttactatcaaaatattccccgcaccttttttttccttcctcccgcaccttttttggtgattggcccattagtaacaatattattgtgtctttcggtctaagagtaaatgagttactaacacttccgcacttccaaattgatttcttctcttagtaaatgaattactcctaggttattttcagcccttcccaatttggttactcctttaagtaaataaattactctcagatcgttctcagctcttcattagtactcccaattggtttgcaaatcttctcttagtaaataaattaatatttgcacgtcattggacttctcttagtaaaataagttagtcctgatacaggagtaaatatattgcagattgcacaaggccgctggagtatttagtgacaaaacaaa

SEQ ID NO: 10226 - DNA, 1501 bp, Oryza sativa; identical to SEQ ID NO: 2612

SEQ ID NO: 10227 - DNA, 1501 bp, Oryza sativa
ccatcgcccaatcaacggctcagatcgtgtttcagtcgataaaaacagtactacctccgtttcataatgtaagtcattctagcattgcccacattcatatagatactaatgaatctaaacatatatgtgtgtctagatttattaacatctatatgaatgtggataatactagaaagtcttacattatgaaacggtgggagtatagaagaaaataatagactgatattttgtttagcacagctctcctaatcggccggcactggcatatagtatatcggcaaaagtaaacaatagtttgacataatcatatctggtcccacacaaaataagcaaatcttaactgaaaagaaaactataactaataagatcgggcattgcacgcgctaaataatcagctgcaaaccgacaccaaatcgccatgcttcacgcggtcttcacgcgcatgcacagaccggttgcatccaaattctcctctctcagcaacgtgaaatccttctgtgcatctcctgcttcttctttttaaatcaccagcaaacctttgactgcatcgatcaatgcatcctcacagtccaagattccaagtacatagctactccctccttccctaaatatttaacaccgttgacttttttaaacatatttgaccgttcgttttattcaaaaacttttgtgatatgtataaaactatatgtatacataaaagtatatttaacaataaatcaaatgatagaaaaagaattaacaattaattaaattttttgaataagacgaacggtcaaacatttttaaaaaaatcaacggcgtcaaacattttgggatggagatagtactaacttctcacataacaccaaatgataaaatgaccctctaacttactatacaaacaaccatccagtacatcacaaattcctatacaaataaattgaggccctctttgtttaggcttataagccaacttataagtcgaaaagtctaagcctaaacaaacaagtagcttttctgtttggcttttttgaagccataagccactctaacactattaagccaaaaactaggttggagaagtgtttttggcttatgtgaggtagatgtgtgattcaactactaaacttaggacattaaatccaccggcttataaatcatataagccaataagctgacttaaaagtctaggccaataagtttaagcctaaacaaaagggcctgagtagattttccaagtaaatcagttgcatcatgcatgtattctaaaataatctcgcctgcacatatacactactcctagctgccaaggctatatatatacatgcacccatggtcatcatattgatcccacgaacagccagcccaggcaacaaccctgtagatatgacactcgacacaatgacgataggcttgccagtaagagaaggtgtgagcagcgcgaagctcaccctcatcgtagcgtgttttctgctaccgtttcttgtcgaggctgaatcgcgggcaccggcgccactct

SEQ ID NO: 10228 - DNA, 1501 bp, Oryza sativa
gtgattatgtagctacataaaagcgatgccatattgacattgtagataaaatttcacaaaacttgccaaagaaaaacttgagagcatgaacattatgtgacaagtattttggttgcagtacaggtaaaatatagcttcaagataatggatagtaaaagaccacaaggaaagaagaaagatatgatgactgccaaaaaccagattaaacaatgccatacttgattggtcccacgtaaagtctatagagcatgtgtgaattatttatcaggcttttttccatgcaagttgggtagctaactagctaagccagtcgacacaatacaaatgtatcacgaggtagcagcaggagtaagacactgaaaaattgctgaagcatctttccattcatttgttgactttgaatgtctcataattttgaaatatatgtgtagtactcctctcaggaaagaaatatatatggagtaatgtgaactgaagttaaacaattactcagattttggatgatgcattttcagttgccaacccaaatattgcagccacacaaagcacatgtcagttatcaaacaggaaatactccagttccattgtgaaatcgaactgccaactaagatgcttcaggtcaagtgatcaacatgttgatttatatagaaatgaaacagagtacatgaactatattagatgattggttgatataacatcagttatcctattgatatgtcatgtaattgtgaagtatcaagaagagacacttcaccttttcgcattgacacctaagtcaagatgcataagacaaggtggaatatgtaagatcggtaagcatacctttctcccctgataactgaaaatcaaatctttaacgtgagaaaagctccagagatagtggcggagatcataagcatcgaaattgccgctttccacacaataaagtaccactgatgcgctcactagtgatgccacgtcctttagtacaggcttgccgcaaatagtattgcgcagggctaaagtagtaacggtcggaatagaaatagaaatcctgtgctcatagcagaattcagtagtatcgaaggtcaaaaccttcagtgtgttggaggagatctcgtcatccgcaacgatgcaatcatctaagtagagacgttccaatgctggacagccaatctggagttgcttgaagaaaccttggtccatgaaaacattgccgaaggcaattcttctcaggtagattgaattgaacaccgagcgatcgagctccaatgagttgagctgcacgacaacctccagaaaccaggcgttcttctgcaaaccgtaggaaatccacctgttcgcgtctgcggatccatcgtcgtcttcgtctggtatgcagcatctgaagaagaacgtctctattgaggcggtgggatcgcgtcgctccagcagccggttgacgaacctgttgaacaccaccaccacctcggcctcctctacgtcctcctctccctcgccgtcgatggtcccgtccggggtg

SEQ ID NO: 10229 - DNA, 1501 bp, Oryza sativa
gtggacgcggggaacggtgcgccagacgtcgcgccaccgccgcgacagcacgcacgtccgcacggcctggcgcgagtccaggaacgacatgacgcggtggaggacaccctcggggaggtcgctgagccggtcctccctgccgccggcgtgcgccggggccatgacccgccacccactcttgacaggcggcgcctccatggcgcgggctggaagccgagcacgtcgcagaggcgtttcgtcgaacaggtagtgcgcgtgcgtggaagctgcacgtacaaaaaccccccaagaccaaccaagaatcaaccagacatgagcccgcatgcaattctaagcaaagatttgtggatgaactgatgatgataggtgcaaggaacacaaacaacggatcgatcgaaggagggagccatgcgcatacctcgaattcgagattgggaggcgtcagctttggacacctggctgttcatttcggtagatagacgcttgcttgtatgtataggacgacgtgcttgtaaatttgttccatctgatttcctcctttctccgttatactccctccgtttcaaaatgtttgacaccgttaactttttagtacgtgtttcaccattcgtcttatttaaaaaattgaagtaattatttattcttttcatatcatttaattcatttttaaatatactttcatatatatatatatagttttacatatttcacaaatttttttaataagacgaacagtccaacatgtgctaaaaagtcaacggtgtcaaacattttgaaacggatggagtagaatataagtatttctatgctctatttggaaagcctccatagctacaacttctcttcgaatcttcggctcccgaaatagtttagaattttactcgggttataaggattaatttgtatatatagaatttagaaaatgaactataaacttaagttaaaaaatctaccatttctagactagatcttcaccggctgtttttagaatctccaacttcacaaacaaggagttgtttagcatagtaagattgagaagaaaagactacagttgcctcattaaatgatgtgtagttgaggagtaagaggatgtttggggttaatattaggttaaaaattaaagagtgaagtgcaccagcggtcgctaaacttgtgcgagtgtgtcatctaggtccctaaactcttaaaatgcatttttagatcccttaacttgtcttgtgtgtcatatagatccaaacgggcaccgacccgctccatccggtgacgtggcatgccacggtagcgcctacgtgtcagtggggacccacatgtcagtcatatttataaaaataaatatatgacatgataacaatatttacagaaagaactttacatgttttaaacttactctaatcaaatcctgtacgtgctaatggagcggggcccacctgtcataggcacagggagaaagcagcagcagctgctgctgcagagtttgccggccggcgttccttcacgacga

SEQ ID NO: 10230 - DNA, 1501 bp, Oryza sativa
acggatacctcttgtggaagcaatgtgaccggatccggcaaaatcgcactgacctcggccggttgaaacgatggatgatcatcaaaatgcaggttggcaagcagcatccgggtgctgctgttaaaactgatggaggctgtcatcgtgccattcaggctgtagctcggcaaacttgtcgtgttagccgactcgatggcgctgatgtcgacgcccatgtggtcgtaggtcttattggggtcccagatgttgttgtatgtgtcgaactcgacggcgatgaaccggtctgtgccgtaggccttcgaatgattggtggcaaggaggccaaggttgcctccatctgaattcgatggaatcgttgatgggtaagcagcgaggaagaaggccagcccgtccccctttgtgtccgtcgggttgctgatgtcgcttctgatggcgatagcgaaggtgaatcgcgtgctgaagctggccacctcgcccgtggtggcgtcgtagaacttcacggcgtgggcgtacgacatccgccccttgcacttgtggatcgtctccgcgaactcgttgcaggtgaggtccaccagcttgttgctgggctcgcttgcgttgccctcgaacaggaggtcctccaggcggtagctggctgaattggagaagtcgaagctgaaggagagtggcgccggtgcccgcgattcagcctcgacaagaaacggtagcagaaaacacgctacgatgagggtgagcttcgcgctgctcacaccttctcttactggcaagcctatcgtcattgtgtcgagtgtcatatctacagggttgttgcctgggctggctgttcgtgggatcaatatgatgaccatgggtgcatgtatatatatagccttggcagctaggagtagtgtatatgtgcaggcgagattattttagaatacatgcatgatgcaactgatttacttggaaaatctactcaggcccttttgtttaggcttaaacttattggcctagacttttaagtcagcttattggcttatatgatttataagccggtggatttaatgtcctaagtttagtagttgaatcacacatctacctcacataagccaaaaacacttctccaacctagtttttggcttaatagtgttagagtggcttatggcttcaaaaaagccaaacagaaaagctacttgtttgtttaggcttagacttttcgacttataagttggcttataagcctaaacaaagagggcctcaatttatttgtataggaatttgtgatgtactggatggttgtttgtatagtaagttagagggtcattttatcatttggtgttatgtgagaagttagtactatctccatcccaaaatgtttgacgccgttgatttttttaaaaatgtttgaccgttcgtcttattcaaaaaatttaattaattgttaattctttttctatcatttgatttattgttaaatatacttttatgtatacatatagttttatacatatcacaaaagttt

SEQ ID NO: 10231 - DNA, 1501 bp, Oryza sativa
gaataccaacttgtcacaacccaacgttggtggcgagactcgctgaaatcagtaggacagagcaaaacagatgagcgagaggtagagggagacatgggaagaagacagcatattggggaggtttttttcttttcatttcataattaatttccaccatatagcctggaggttataaatacatcaaagttcaccaacccttgtcggtccacatgtcattttctactttttctactttatgttttctttaccgggaaacgactctacgcactatgcctcttctcttttctctacttcatgttcctcttcatgtgtcgtcgctgccctgatgttcaccgtgccatcagacgtgacaccagcccattccgtgctacagactgcaaaggaggatgcctcaagccacgactgctcccattccgtggtgcgctggagagtcgagacgagacgcgacgcgagcgccattgaaggtacggttctcttcttgcatctttgccaagagctcggactaccatagaatttggcccgggccccccccccaaaaaaaaggcccaaataccctgtttggcccaagaagcccaaaaacagctagggttggagggagtccagcccaccaccaccaggcgctgctccacgcgaccacgccgccattgtcgtccacgccggcgccgcgccgtccccgccgtcgtccgcgccgtccccaccgtccaagccgccaagccgggggccgcgacgctgcgacagcgattcctccagtcctcctcgccgcctcgccggttgcgggttgccggcttggtggcttggcgcggcttgcccgcccgccttctccagttctcttgcttggctgctccacgtctccactgatccggcgctccaccattcagcccaggtaacgaacagatcaacaaaacactagaacggctgcctaaatcgatgtgtgattagagatcagtgaatttgtgaataagaataactgaatatgcaatttataagttgttactgattagtgaatgtgtgctattgtttgtaggattggtaaaacatgaagaggagcggagatattgcgtcattatttgggaaccatgaagcaaaaacaatggagattccagaatcttctagttcttcgaatgtattcattggtgatgaagctcctgtacctgaagaagaaccacgacaagttcctacagatgctgtaagacattatttttatcgcattttcactaaatttgtatttgtatatcggctttatggtacaagaaaattttagcatgtgacatgaacgtgtgaactagcactacccaagaaaaaattcctagctgcgccactgactgggagttcttcaccggtagattctgctcgcgaatcgttgcttgcactgcgatctcagttcttgcttacttgcgctgttgattcgtatgaattcatggcttcttttggtcttccgctcttgtgcagtttccacgtgcacctcctgttcgacgaaacgcctcttcggtatcggccacca

SEQ ID NO: 10232 - DNA, 1501 bp, Oryza sativa
cactataaactagtagtatcttctgaaatttaacttatgtgatgtagcacagggagtggaactatttctgcaagcaacgaatcaaataaaaatcgatctgtgtgtaatttacgaagtaaagagaactccagaattagtactagaattttactgaagcaaaatcaaaaccatttaaaccgctgtcggctgctcatcaactaaaatagaatgaaacacaagcgcaaatcatctctcgctaatggtcacagaagaattatctatgtggtgatttgataacatttgtcagacacattgcaaatttgtatagttgggacaacaacctcagtagaaatcttatgaagtacttggtgtaaaaactgaattttgctcgcgtcaggctgctagttttggaggatctaatagtgatcctacagcattatcatttatcaggaagtgatgggagaaaatgggacaggacgttacctgttctcgaaccagtagcagccgaagagatgggatgaacaatcaacggcaacatcaagatgagggcgacgttgcatcatcagcctctcctccgccggactgccatacaagcagcacatcgtggggatccgccgtccttgccgaggcgccgagcacgtacgccgcagccgccacaggtcgctggaggtagaggaggcggatggggcaaagggccgcgagggcgctggaggcgatgacgcggagagggagatggacgggcgatggaggcgacgatggaggtgaacgagaggccgagaatggcatcgaaggaggcggcgagggcagggtatgaagatggcgggggaggcaagggcgccgaagggggaggagacgcatacggcgccggaggtggagagggcggggccgacggacggcgactgagggggcgggaaaggcggcaagggtgggggagacagacggcgacggaggcggcgagggcggggaggcggacagcgacggagggggccggagaaggcgacgcgggcggaggagacggacggcgacggaggaggcggacaaggcagcgacggtgggggatacggacggcgatggagggggcggagaagacggcgaggcctgggggaggcgacagaggcggagagggagaagaatggcgtcgattaggataggatagagagggtgaagagttagataaagacaaattacgataatacccctacgcgaattattacctctggacaaatatatccctccatatttctactcccataaaatctggtgggagtagaactcgatctcaaccatatgattaaatacgatcaacggttcagattaatttcagcttgaagtaaacacagagtgattaatcgccaacggaaagaggtcagcgtagacgaggtcaacataaacctctacaacccgggccttcttctgaaaagcatggctgatccacctattcgcgactgcatcttgcgggtcagtgtcatcgtcgttgtcataagatatggaataccggagacagaacttgtccagagaggcg

SEQ ID NO: 10233 - DNA, 1501 bp, Oryza sativa
caaccgcatagattcaaaaaaaaaaaatcagtacaaccacccaaaataagattatgttcgtttcatcaactgcataaattaattgccactctaaactattgaacaattactacagtttccccacaatggctgcaaattttgtatgtacgaaggattaagtcatgccctaagcaattaattcaatgtagtagtagtagtgatgaactagctggaaatgttggatgctttaaccagttgccaaggcaagcatttgctagaaaatatcaaagatcaattgcacaagaaatgatttaatttgctacctttgctgaggtttaatgatggacttatatcagtaacacatcaatttctggaaactgttttgagtggaatttcaagtgacaggtgtatttaatttgcagctcaagaccaatattattgttcagttttctttcaaaaaaaaatcattgttcagtttcatctttcatgcttacaattcaacatacaaaatcgatttattagatctccagtttaacatccgcaactgtagattctctagtatagctataagctagtatacacagccatttgtatatgcatttatagaggcaaatttcagacaagttcaccactgaggcaacgagcaaataggcagactagcataggccactcgcagcggacagagtgggcgcaggagaccaggatgccggcatggaatagaggagaggaaggggaacagatacaggtgtggggtgggaggagtggccacctgaggattttgccgcaccgagccgctggcagcgccgccggagattttcgcctgatgcgacgcgctgcaccgccgggcaccggatgcgatgcgcctggccgccgggcacctccgtggcacctgatgagacgcgccggagggagcggagacggcggcaagggcggggagggcgggggaggtggacggcgacggaggggagcggaaaaggcgacgcgggcggaggagacggacggcgactgaggaggtggacaaggtggcgacgacgagcgatacggacggcgacggaggcaaggcggcgagtccgggggaggaatagcgcgacggagtccacacctgcgatgcgaaccgaagataccaaccgatgcgaacccaagaaaacatcccattccaaaattacccctaaggcctcgtttggctgcttgtgttttggtgtggaacaggccccaaacccacccttccgtggaatgcagcccacgcctggatcaattcccacatctggcccaaatgtgaatttggatgttcgtgtattgctgtgtattgcggctcgatccatgccgacccacgggtgagagaataatcctcacccgaggcctggaactctgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcacttagtcctca

SEQ ID NO: 10234 - DNA, 1501 bp, Oryza sativa
gggttcaggtttagaatttcatgaactaactcatcaaatattgcgataatatgggagaattaacgagtcacacaacataaccaaatgcctttcagatagaatgtagcttagtttgaacaatatataaacattcttagatctgctttgacaatgttcagtacggtatccagtaaaacgcaaaggaatattgtggaagtagaagtaataagttgaatatcattaatttctaacttgataacatcacacattgcattttgagtagtttactattattgcattgcattgtgaacaaatctgatatctatacacagttaaaatatttgcaaaataaatcaactgatttaagttactatgtaaatacatcaatgtagtatcttctgcaaaaataacaaaacatcaagaaatgatgagacagtgcataaatcattgaaatataacaaaatgagaattgactttagtttaaaggagaattgtatatgttacatgaagtgtattggaaccgatcacataggtattctttaaactaattaagacaaatttcaggtattccaaagtctgggagtttggacaaaatgatttcatggttaactaaatccaacgctttagaaagatcaagagatattccaacagagtgaagtttgtgattaatattattagtaaatctgtcatgtaatacgagcagagtcacaagtcagagtgattacatctgaagccatactgagagttacttaacagataaatgttatttaatgggaaataaatccgctataaatgattctttcaagtattttagaaacgcaaaggaagttgtggaattggtcgatagtaagaaaatgattgacggtcatcttttttaagtactggaataatttcctaatttcaaatttattagtgagattccctgtatttacagaaaatttaaaaaaatatatgaaagaagagaagatatatgatagataatttcttcaaaaccacaactgttaatcatttttatataacgtactatgtcaacaatttcttcttctcttgtttgagaaaaaaagatgaaattgctgcaacaatcctgaatggaatgttcgagtaacacatagtgacgtgaggatataagcaataggcccctattggagaaataaattagcaagttgatcatttgtcagtttagtgtttctggcataaaataagatgggaaaccattttttctttcgtctatcctgtaagttatttatagtcattaatattttaaggtttttcttgttcttttcaaaattttggtataaagttacttacgaatgaatttcaatatttgattaagaatattgtatgctttaattgtttcatatcaatttaattttgataacaaaagcttacaaccatgtaacatacgattcgtacgttttaattgtttcatatcaatttgattttaataagacacggtcgtttaaaaccatgtgacataagatttttatgttgcagctgttcatttaaatttaattttaatttc

SEQ ID NO: 10235 - DNA, 1501 bp, Oryza sativa
aaaatttcaaccatacatgcaccctaaatataataattgcaaatatgtttctatactccccctgcaaggaacaaatatatattccgtcatcaataacgaagaaaacatgattttatggaatattatgcacaaagcaaatgaaggagagctcgtataataagtcacagagttgccaatttgtatttgattgatcacaacttcaataattcataactttcttattttcattcagaatttgctcaaactttcactcacctgattttcatattattctgcctctatcgaaacaaacttattttgggggtggactttccctttaattagggtacgcatatgcgtgttcccagcaccccaccccgcccttttcagcataagtccggtgtgtaaagtcaatatacgaggagacctttttcttttgttatacgagcctttcagcaccccccttctgcataagtccggtgtttaaagtcaatacgggtaaacctttacgaaccggagattttgagaacacacatgcggtccctccgtttccggggtgagggggggggggtgggcgggaaccatctctttaagataaagacaactcctggtcatacgattgcattgtgaaagaaacgttgtggaatcggtcagaaaaggttgatcatctagcttataaatattgatgtgtactgcaaggttctggaatcatcaaaatgataagaaatttggcccagtcttggtaaagttacaagcactatacacaaaaagatgtatatgggactacgcgacacgtgcgcgatatctatccggtccagatagatataataatttaccaaatatagcaattagtataggcggtttcccggcaaaatgtgtatcatcacatattagtcaaaacatattctttcacatgattgagattccattatcatattttgagaggggggcgtttccaaaactggtctttactttaacgcgacctttaccctagggtaacttttctctgtctgaacaagactagtattgaactgtaggacctctcgtataatagtcaagtgccctcaccataatataccacggtactgaatactgtctgagttaagtttttcattacagtgttctctggatcgctctaagtatgtaacaattaaacgagtgtacaattaagacatttcaagtggcttattttttcctgaattaatagcggaaacatctggaattttcacgcggaaatccgtgtaactaacacccactgaggaaaatgttgagaaaaaaaatagaaatcactttccagtgtaattgtggttgaaatgaaatatccttagacgggctttgttttgaactaagaagtaataagtttaaaatggagttaattggttgcaatgaatgataacctgagcgcctgtgtgattcctccgagttcaaaatcctgcaacaaacatccggctctttgaaagtgaaaaatccctacttttcacctgaaatcgtttgaagatatcggagatcacctgaacagcaa

SEQ ID NO: 10236 - DNA, 216 bp, Oryza sativa
tttaacccccaaaacgcccccccccccctgtgtacgcgcctgattccaaggcttctgaagacaagtgggtttaaacagagctttgaagatatcgacaggttagttcatgccaattgaggccgtttttttaaagtttttaaatgttaatgtttttaagatatgggttgataaaataatctgattgtgtatctgaatatacatatattttgttgcagc

SEQ ID NO: 10237 - DNA, 826 bp, Oryza sativa
ccgtcgacggggtccttgaagtagtccgggtgcgtaatcacttccttcacatcgaacacctgggccctattcttatcattcactctgtgtgtcagtcctaaatatataaatcaaaagacgagaattaacatcgtaagtggatcggatgacgatataagaaaatgtatatgagaaactgttatgtcttcgatcatgcaacattttttgttttcaggcaatgttttgtattcttaggaatgtactggtgaaagaaaaaatggcattaaaagatgaaaattaagggagagaaagagaggaagagaaaggaagagagagagagagggggggggagggggagggggtgggggaggggccgagcggaagttgaatcgaaagaaaacggcaatcaaccaaacgagacgaaattttgagagccaggaagctcacgttacgaggattgacccaatcgcaactgtgtatctgtaagaaccatctaatatgaataaatgcaatgatttaccattgctatcgttttacctcccttttaaattgtgacatcgaatatattttgttaattctttataattcggccattacttgtttgttggcatgtaatctacatctcttgttaatatccatatcatgtatttaagatgtcatgtaccggtaaataaaacccaaatatcttgacttcctagctttgtatgtacatactacatttctttagatagataaattactgttttttttggtcataaatatatcatataattcgtattgcaacatctcttaataccattaaacgttcaacgtattacaacttttcataatgcatccgccaccgagg

SEQ ID NO: 10238 - DNA, 1501 bp, Oryza sativa
actaaatttcaaattgatttcaaatttgggcctaccccctaagaaatcctggatccgcgcttgcataggcctacttgaaccaagtttggttacaatttgcctcaatgtcttttacgttatcgccgtaaacaaaacgttgaattttgacctcgttacattttaacctttaacatttcaattcgtttttgtttcttcttattacacttaagccaggttattccttcaatggttttcaagttagtgcagaaattaaattcattctggtatttctaaacactttcatggccctgtaaccttatgacctgtagccacgaaatacatgaaacctgatgaattcattctaatatgcgcatgtatatagttcatccaagtttggtttgaattgcttttaatgtttcttaaagtaaacgcggtaacgagatattttctgatgtttttaacacttttattgaacctgtaatctttgacctcttacaccaaagtatattcagttcttcgttccaatggataattctttatcatttagccattatttgtttgttggcatgtacattatgggagaaatgtaatcttaatgttaatatctacaaaatgtattaacgatttcatgtaaataaaacccaaatatcttaacttcctagcttggtatgaacatctcttaattggaaccgatatattatattttgatcgcccaatccgtctgtccgtttgtccggacgtccatcccgccttttggtatcgcggaccggctccggacagacacggccgcgttcggcaccaccctcggtggcggatgcattatgaaaagttgtaatacgttgaacgtttaatggtattaagagatgttgcaatacgaattatatgatatatttatgaccaaaaaaaacagtaatttatctatctaaagaaatgtagtatgtacatacaaagctaggaagtcaagatatttgggttttatttaccggtacatgacatcttaaatacatgatatggatattaacaagagatgtagattacatgccaacaaacaagtaatggccgaattataaagaattaacaaaatatattcgatgtcacaatttaaaagggaggtaaaacgatagcaatggtaaatcattgcatttattcatattagatggttcttacagatacacagttgcgattgggtcaatcctcgtaacgtgagcttcctggctctcaaaatttcgtctcgtttggttgattgccgttttctttcgattcaacttccgctcggcccctcccccaccccctccccctccccccccctctctctctctcttcctttctcttcctctctttctctcccttaattttcatcttttaatgccattttttctttcaccagtacattcctaagaatacaaaacattgcctgaaaacaaaaaatgttgcatgatcgaagacataacagtttctcatatacattttcttatatcgtcatccgatccacttacgatgttaattctcgtcttttgattta

SEQ ID NO: 10239 - DNA, 154 bp, Oryza sativa
aggaggaggaggaggaggcttagggttgcagccccccccccaaaaaaaaaacaaaaacaaaacaaaacaaaacaaaacaaaacaaaaacgttgttcttggactaaaataagggtttagagggaaaaaataagaagggggaggaagatgagaaaa

SEQ ID NO: 10240 - DNA, 1501 bp, Oryza sativa
ggtcctgatttagtcttaatgttattggatgaaactgaaaaactgggcagggtttatcgtgagtgcactttgatgattggtaggctgttatgtcacctgaccttttcaaatctaatcaacgtttcaattatgttgttatgcattctgtacgcaccttttgctatccgacgatcctttattatatgacgtttcttcaaacgattttacatgtacatgtacatgtattttaaacttcttccagtttgaacaggctaatgatttaaaacttgatcagccttcaacaaatctggggggtgtgtcacaaatatccttgaataagttcaacttaactctaagttggactataaaattatggagagccgtttgcagccttaaaaaaaacatattcgaatgcgaaaattcaagtattttagactgttattaataccacatcaagaacatgaaatcttcttgataatagaaaatatgaatgatttgaatcaacattttatgcctcggctttgaataattgttaagtcaaacttagagattaaaagttcaacttaggatctttgtgaaacaccccccagggatgatggcaggaaatcatttgcctttcctataatctctaatgagacacatattgaatgatccataaatctcaccaagaaaactcaatatgtcttaggaaacacgtattacactttgagacaggatattgctgcctaacttcctttttcgatgatctctcagaatgttatcaaagtaataaaatagtcttaacaagttaatgtcaaactcatttaaacataattttgtacttcagacaaattattctgatcatctgcatgtaaataatctcccctataatgtcaatgtatagaattggctttccttctaatttagggggtttaaatgtagagtatttggctgatctaaagttaatacttcacttatgattcaaaggtcatcagattataatgctctcgataaatgtaaacacatttaattacactgtagcatgtgcatatttgcataaagttctagctgcaaccttgaataacttagatgccatgaatactatacaccacgcagtacatgcatctattgagcatgttctggatgtgaaccactggtttgtcatagttatggaagtgatgtcaatcgtccgtccgtccgtccgtcccagcggtctgtaagagccaggggcattcctggaataccagaaatgtctagtcaaactaagacctagatgtgaagaatagatcctgctcactggagaataaagggcagcctttgttgcattgtacattaatgtagcatcagcaaaacacaaaagaaaaggagaactttcattggtttgcagcactcaggaggccttcagtcatacgaaactacttttaatatattaactggtggtctagaagacggttggaatattatgctgctcttttgagaatgtgcagggcaccggacaaagctgtctcaggctgtgttgaataacaagaactgaaaggaccac

SEQ ID NO: 10241 - DNA, 1501 bp, Oryza sativa
tgcagccgaccgtcgtgaagaagacgaggaggaatgtcgccaagactgctgggtactcctgcgtcatgttagtcgcctattatttcacaaactgaagacagacagactttagctatcaaaccacctcaaatagtaatgccggatgatatgatgcattcgatattatataacactagtggtcctttcagttcttgttattcaacacagcctgagacagctttgtccggtgccctgcacattctcaaaagagcagcataatattccaaccgtcttctagaccaccagttaatatattaaaagtagtttcgtatgactgaaggcctcctgagtgctgcaaaccaatgaaagttctccttttcttttgtgttttgctgatgctacattaatgtacaatgcaacaaaggctgccctttattctccagtgagcaggatctattcttcacatctaggtcttagtttgactagacatttctggtattccaggaatgcccctggctcttacagaccgctgggacggacggacggacggacgattgacatcacttccataactatgacaaaccagtggttcacatccagaacatgctcaatagatgcatgtactgcgtggtgtatagtattcatggcatctaagttattcaaggttgcagctagaactttatgcaaatatgcacatgctacagtgtaattaaatgtgtttacatttatcgagagcattataatctgatgacctttgaatcataagtgaagtattaactttagatcagccaaatactctacatttaaaccccctaaattagaaggaaagccaattctatacattgacattataggggagattatttacatgcagatgatcagaataatttgtctgaagtacaaaattatgtttaaatgagtttgacattaacttgttaagactattttattactttgataacattctgagagatcatcgaaaaaggaagttaggcagcaatatcctgtctcaaagtgtaatacgtgtttcctaagacatattgagttttcttggtgagatttatggatcattcaatatgtgtctcattagagattataggaaaggcaaatgatttcctgccatcatccctggggggtgtttcacaaagatcctaagttgaacttttaatctctaagtttgacttaacaattattcaaagccgaggcataaaatgttgattcaaatcattcatattttctattatcaagaagatttcatgttcttgatgtggtattaataacagtctaaaatacttgaattttcgcattcgaatatgttttttttaaggctgcaaacggctctccataattttatagtccaacttagagttaagttgaacttattcaaggatatttgtgacacaccccccagatttgttgaaggctgatcaagttttaaatcattagcctgttcaaactggaagaagtttaaaatacatgtacatgtacatgtaaaatcgtttgaagaaacgtcatataataa

SEQ ID NO: 10242 - DNA, 1501 bp, Oryza sativa
ggtagacagagatagagagagagagagagagagagcgagagagagagagggagagattatgtgtgtacgagtgtgtgtatgtgtgtgtgtgcgttagtgtgatagagagaaagagagatagagagagagagagagcgagagacaaacaagagagagaaggggaatgggggagggaggtggggggggggggggtggaggaattaaaatatttatatagagagagaaaaagaggggcaaaagagtaagacagggagcggtgatgggagggaaagagagaatgcgtgcgtgtgtgcagtatacatgtttgtgggagaaagagaaagagagggaaataaagaatgagaaggaaagaattcccaactttgagagaatacacacgactaggtacattgcttctttataatccttcattcttactttcagattgttggcgcgatcagtcttaataatgtagatctagcttcaattcgatctagattcacgtgaaagaacatataagagccgagatgtttattacgggaagaaattaaagactagaaagtgatgaccttatgataaatacttcacgcatcttaaattccaccactaatgaaaatagaaaggaaaaaacgtcatcttggtgcccacagtgtgatgattaaatgttgttataattctcgtggactgcagcaccctatccccctcacccatttgccccgacccgacctatgtttgggtggccttgtcataattctaagcagtagcgtacgccggaatttttcgaggaggggcttttaaaatttgaaaatcgcgccgaaaatttcgaaggactcagccagccgctgaataagggagggggaattggaaaattatgcctaccgatatttcgttttgtagggggggggggggggggtaaactcattttttttgtcaccctttagcacccacaaaaaaatgtattcattttttttttgaaggggggggggttcttaaaaacacctcccttacaaaaattgaggggggggggttcaactcccaaaacaccccacccctgcgtacgcgcctgctcctgagcattcttatacctgggttgccggacagttctgcagaaagtgatcgttggaccgttgtgacattgtgattcttggttgtaaaactcgatctgtacatggttaaagaaaataaatacgtgtttttttaaaatcactttttacatctagccaatatgagaaatctcgcataatccctaaatgatttagacactctaattataattttggtctatgagctacaccaaaactctaatgttaatttcgcgtgtagaatggcggaggaatgcaaggcaacatatccacatttgttattactaattttctaaataatcccattactttggcagaaagtttaatccttcattcagctgtttaaagtattttgatcactaatgaaaaatccccctcgttttaattattatttgtaaaatgagggtgacgaaggattatccaaattgaatgttattatt

SEQ ID NO: 10243 - DNA, 1472 bp, Oryza sativa
tcaacgaaacggagttaagtctattgttaatttcgtttattgatacggcaggcagccagtgaaaacgaattcgtttaataaaattatggaaatgcaagcactactttaaacaaacagaactttgtcattcctcgctcattttttttcaattatagttgtgattaagttatgatagaacatcgatagaagacgacttacattaccattctcgacttcttaatccttgtctgaattcagtcccccccccccctcccccttcctcctcctgggcgaagcgcggaagctttgacgtattattagacaaagacgattcgctgtacctcagttcccgactctttttccctctttcttcgtacgtcctcttactttttttcttctctttctctctctctttttttttggccggcgttttttggggggcgaccgcccccaccgcccccctggctacgcgcctgttaggaagataacgttaccactattagactacggcaatgtattataagaatgaagggccaccaccaaccctagcagggttgttatgactttcttctgtccttcaatcagagcgataatccttccgtctgtggaccacgctgttgaggttttttcataggcgatgttggctgttttattggcattttcgtgttggttatattatacgcacaaccagccggcccatgtattgtcatttttaattaaataattaattaacggtcaccgtatttttttgaaagtggagctgaattggtatgattattttggggtctaaagttaccttcatagcaattttaggttctaaaagggcactagaaatgtcatagataagaataagagcgttaaccatgcactttgaaggcatttgcggtctgaaaacagaactcaactatccctttaagtgatgcacagataaaataacccggaactgcgagatagagtacactttcctctttctgtagctgctttattattcccctgtttgaacttttacatagcttggctacatcgtttagattagttttattttgtttcctatttcatcatatatatatatatatatatatatatatatatatatatatatatatatatatatatatatatatatatatatctatatataataataacattcaatttggataatccttcgtcaccctcattttacaaataataattaaaacgagggggatttttcattagtgatcaaaatactttaaacagctgaatgaaggattaaactttctgccaaagtaatgggattatttagaaaattagtaataacaaatgtggatatgttgccttgcattcctccgccattctacacgcgaaattaacattagagttttggtgtagctcatagaccaaaattataattagagtgtctaaatcatttagggattatgcgagatttctcatattggctagatgtaaaaagtgattttaaaaaaacacgtatttattttctttaacca

SEQ ID NO: 10244 - DNA, 1501 bp, Oryza sativa
cagataaaataacccggaactgcgagatagagtacactttcctctttctgtagctgctttattattcccctgtttgaacttttacatagcttggctacatcgtttagattagttttattttgtttcctatttcatcatatatatatatatatatatatatatatatatatatatatatatatatatatatatatatatatatatatatctatatataataataacattcaatttggataatccttcgtcaccctcattttacaaataataattaaaacgagggggatttttcattagtgatcaaaatactttaaacagctgaatgaaggattaaactttctgccaaagtaatgggattatttagaaaattagtaataacaaatgtggatatgttgccttgcattcctccgccattctacacgcgaaattaacattagagttttggtgtagctcatagaccaaaattataattagagtgtctaaatcatttagggattatgcgagatttctcatattggctagatgtaaaaagtgattttaaaaaaacacgtatttattttctttaaccatgtacagatcgagttttacaaccaagaatcacaatgtcacaacggtccaacgatcactttctgcagaactgtccggcaacccaggtataagaatgctcaggagcaggcgcgtacgcaggggtggggtgttttgggagttgaacccccccccctcaatttttgtaagggaggtgtttttaagaaccccccccccttcaaaaaaaaaatgaatacatttttttgtgggtgctaaagggtgacaaaaaaaatgagtttaccccccccccccccccctacaaaacgaaatatcggtaggcataattttccaattccccctcccttattcagcggctggctgagtccttcgaaattttcggcgcgattttcaaattttaaaagcccctcctcgaaaaattccggcgtacgctactgcttagaattatgacaaggccacccaaacataggtcgggtcggggcaaatgggtgagggggatagggtgctgcagtccacgagaattataacaacatttaatcatcacactgtgggcaccaagatgacgttttttcctttctattttcattagtggtggaatttaagatgcgtgaagtatttatcataaggtcatcactttctagtctttaatttcttcccgtaataaacatctcggctcttatatgttctttcacgtgaatctagatcgaattgaagctagatctacattattaagactgatcgcgccaacaatctgaaagtaagaatgaaggattataaagaagcaatgtacctagtcgtgtgtattctctcaaagttgggaattctttccttctcattctttatttccctctctttctctttctcccacaaacatgtatactgcacacacgcacgcattctctctttccctcccatcaccgctccctgtcttactcttttgcccctctttttctctctc

SEQ ID NO: 10245 - DNA, 1097 bp, Oryza sativa
agagacgatgaacaactactaacgcaaagtcgtaagccatgagaatgtcaatttctatctcgttctgctaaataacccgaacaatagaatcaaccaagtggaatcaactgttaaatttgttactgcacgtcataatagtattaaagagcagcaaaggcgaacgattgtcgcaaaaattcaaaaattgttgcttagattgcttaaattaccatgagacatcaagcttcatagaactatgatcgacacacatgatattgttttgaaaacagtctgaaaaattggaggtagaatgaataagagataatgtggtcatgtttcttcttatttgtctgatatatttaaatatttcattttatgttttctctttctttcgacgttctttatttttgttgaaacatctctcccactcccattcatatcttcatatttttcattataaatgcctcaggggttattttttaaatggtttgttttgatcaatcgtgattgagaaggtgatctttctttcttttcatttaacatcttttttttaattcatcattttattttgtttccatcatgtctattaaacctgaactatacctctgtccaagatctgtttatatatagcatgtgcttagaagagaagtcacaaattgtgcaccttctctggggacagttacctgtgtaatgtaacgaatacgcatgccattcctccaagtaaattttgaataaaattattcaaacagaagtatattaagtgacaaattaacatcaaatgaaaagcaatgcacaaatgttacatatgtatgcctaatcacggaattgaatgcacgaagacataccactgtctgtccggcgcatggtactaaatcaaattgaatgacgcaattagctttttgaatgttgatctacataatcattcaatttcgcacgaagttgaatgaacgtaacgttaattcggatgctaagtttacgaagttgggcgggaaaacctatattaactgtcatgatgattggcacagcaggttctgccattcattcgtatttttatattgcatgtacttttatccttcctttcactcccggccccccccccccccccccccccactcagg

SEQ ID NO: 10246 - DNA, 1501 bp, Oryza sativa
aatgggatttaaagacatgaaaatatgttagcctctaacatatagcttataatttgacttcccagaacaattaaacatcgggccgtgccaaaatgaatcggtcatcgatgacggggatatattatcctctctccatacgcacacgactccacctccactcggcacacgctccgtgaaggaagaaggtccaagcggcggattgagagctagggtcatcttccaatttgtgggtacagggtttggggatttgatggaaagattttctttaacctaaaattctgtaattttgcgctttgggagtagtctagggaactcttattggtgcttttaattaccccatacgattttgttagctgacacccttttccatgcggtggatcccaccaaccgttctctcccaacccgccgctgtaggtgccaccgttatcaactatcacccattaccagtcagtcactaccccgtcacccctctaagatccaggaatcacgacaagcggtcggaatccattcacgtgttgaacacacacgtgtgtgttcacccattatacttttcagagcggttgaaacccgttcgtgcaacgagcattaggcttatcggatatatattacattgatagcctttatgcagtaaatttggccagccttactgtgtcttagctagtaagtactcagttatgttagatttcgtacgttatacatttagcttagttaggcacctatgtgaatggcagtatcatagcagaaatcgaactgtgaataataattgatacctgtcatatccatccactatagaagttgttttaaaatatcaaatatatccatttaatttgttaagtttgtagtaattaaaacttaattaaatatactaatagctttctcattttacgtgcgccaacttaatcttcatcttcatcagttttaaacactaccacagtagcttaaagcaatcaacagctgttgcatatcatgccatgtttcgtaattggaatcaagagtccttaatctataaaggtatttcacaggtaaaccactttaggttaacgttcttcacttttaacctccaaattaaaaagtcatatacatgaaaaatagacgatgtgcatttttaagataggaaagcaaatattaccacctaaactaaacatgccactatggcacaattaacaaattttgctccactaccattgaggtatcaattaattaatgtcgtgaaaagaaaaacacattaattcgagttcaaaagaccttgtatgaccaaacagccataaatcccttcttggcaaccatccaagcccaaattggtcatttcaccaatgctctaacccctataaatcccctccccaacccttcccatttcgctcacacatcgatcacagaaagctaagctaaagtgctaaactaagcacgagaaaatctaatcaaccaagcttagattagatcattagctatatatagctaggcgatttaatcatccacgagctagcttattagctaagcagta

SEQ ID NO: 10247 - DNA, 1501 bp, Oryza sativa
agtcaaacgctttatctgcatattaagcccatatcaatcttggcccaccaaaaagcccagccgctgcttactttggtctcactctagtcccgttcttttctccgacaagagttggatgaagattaacggcatgttcactttgaagccatttttaaccttaccaaattttagtaaagttactaaaaaagtggctacatttagtttgttgtcaaattttagtaattatataagaaatcctactaaaattttagcaagttgttgccaaaattttggtattactaaaatttagtaaggttttttttggcataaagtgaacaggccctaagattttcgcggcacgctttcaactgataaacggctcgtttcgtgcgaaaaactttatatataaaagttgctctaaaatatcatattaatttatttttcaaatttgtaataattaaagctcaatcgaatatacgttaataccacatcattttacataaaaaaaaacttaatattcatttttatcttcaggggattcaatgatgaatataaagatgaatgtgaaaattaagtgtttcacgtaaaacgagatgataataacgtaagattaattgagttttaattattgcaaacttgaaaaatggattaatctgatattttagaacaactttcatatagaaaattcttgcacaaaacacatcgtttaacggtttaaaaagcgtgccacgaatatccaaaacttaatccactttttttaagtggaaacgaatggagcctagtcaactcgcccacgtggaccaattgttcatcgagaaaatcccaccctcttcttcctcctccgaattttcccaatttttttttgctctttccacgaggcgacgacggcgacgatgagcgcggcggcggaggacgtggtgcacagcggcgggtgccactgcggtcgaagtccgggtagcggcggttgtcgtggtggcccatgtgcatgccgcagtcgaacatgacgcgcttctcaccgccgaaggtgaccaccacacagctcttccctacctcctaccccgcccctgcgccatcgccatcgccatcaatccacgcatcattcccatcaatcaatcaaatccgtgcgagaagcggagagggagagagaggagtggaggacgacgaagggtacctagcacaaggcactcgatgtccatggcgccgccgccgcttctaccctctcccccggcgctgctccacgccagaatccctcaaccacgcctcagttgcctctccgccgccttcctcgccgcgccgccgccaccgccacccgcacgaaggccgcttgctctctccgccgccgacgaggtcgcgagctggttgggctgcctcatgggcttttgtgggccgtaggcccagtgctcagtaagcccatatcagtgtgagcccatgggccagtcaactcgagtccatatattaagcccatatcaatcttggcccacaaaaaagcccagccactgcttgccttggtctcactctagtc

SEQ ID NO: 10248 - DNA, 1501 bp, Oryza sativa
gcggcgaggaaggcggcggagaggcaactgaggcgtggttgagggattctggcgtggagcagcgccgggggagagggtagaagcggcggcggcgccatggacatcgagtgccttgtgctaggtacccttcgtcgtcctccactcctctctctccctctccgcttctcgcacggatttgattgattgatgggaatgatgcgtggattgatggcgatggcgatggcgcaggggcggggtaggaggtagggaagagctgtgtggtggtcaccttcggcggtgagaagcgcgtcatgttcgactgcggcatgcacatgggccaccacgacaaccgccgctacccggacttcgaccgcagtggcacccgccgctgtgcaccacgtcctccgccgccgcgctcatcgtcgccgtcgtcgcctcgtggaaagagcaaaaaaaaattgggaaaattcggaggaggaagaagagggtgggattttctcgatgaacaattggtccacgtgggcgagttgactaggctccattcgtttccacttaaaaaaagtggattaagttttggatattcgtggcacgctttttaaaccgttaaacgatgtgttttgtgcaagaattttctatatgaaagttgttctaaaatatcagattaatccatttttcaagtttgcaataattaaaactcaattaatcttacgttattatcatctcgttttacgtgaaacacttaattttcacattcatctttatattcatcattgaatcccctgaagataaaaatgaatattaagtttttttttatgtaaaatgatgtggtattaacgtatattcgattgagctttaattattacaaatttgaaaaataaattaatatgatattttagagcaacttttatatataaagtttttcgcacgaaacgagccgtttatcagttgaaagcgtgccgcgaaaatcttagggcctgttcactttatgccaaaaaaaaccttactaaattttagtaataccaaaattttggcaacaacttgctaaaattttagtaggatttcttatataattactaaaatttgacaacaaactaaatgtagccacttttttagtaactttactaaaatttggtaaggttaaaaatggcttcaaagtgaacatgccgttaatcttcatccaactcttgtcggagaaaagaacgggactagagtgagaccaaagtaagcagcggctgggctttttggtgggccaagattgatatgggcttaatatgcagataaagcgtttgactgggctctgacaagcagggcccatgggctcacactgatatgggcttactgagaactgggccgaggcccacaaaagcccaactcttctagccggcaagcccaaccagccgcacgccctcctcggcggcgcggcgaggaaggcggcggagaggcaacggaggcgtggttgagggattccggcgtggagcggcgccgggagaggggagaagcggcggcggcggcggcggcggca

SEQ ID NO: 10249 - DNA, 1033 bp, Oryza sativa
gtttctgacatccgcgatgccctcactgtcccggtaatttcccagctccttcttgtgtaggatgtggtgcttcacatacaagctctcgccaggagtcggggatcatcttgtttggcgttggatgagtgaccagtgctactcggcgcgttcagtataccaggcgttcttttttggtcaacactcatttgtacgtgctgatcttctctagcacacgaagagtcctgctaaatgcaaggtctttctttggtttgcatttcagcagcgctactggacggccgatctcctctagaagcatggcattgatagtcactcggcctaccccttttgcactcagcatcttgagacggcgaaccatatccttctcgactgcgtgttcgctcggtaggtctggctccgtgtggtgtcgcttcctggctagggtacccaccccctcccccgaggtagctggctccaggactggtgatcatcctctagggcctacttgcctgagcatctctgtgtcggcttggactccctggtactcctggtctcttggcaattgtggaaggaacggaactccagggttttcgactttgcgctctcttttgtctcagtggttctggagtccattcttctgtttcagtggttctggagtccattctctcagagggccatatgtggtctttaactggcgttgctgcttttggagatttcttgggagtttagcatgttttgcccccttcctactgatcggagttgagtttagcctccgtagacagattttgctttgctttttctcccttcccctggcataagccgatctggctgattgtattgtgtaagaaaaactctttcattctaatatattgacgtgcaatccttttgcgcgttcataaaaaaatagtataagacaactaccagttttaaaaattaatagatcatctacaaccaacctaataacttactctcgtgtgttgtaacaggattttaattgctaaaaatgatcattaaccgactattatcattactttttatacattatctcttaaatttt

SEQ ID NO: 10250 - DNA, 1501 bp, Oryza sativa
taatcatgtttcttgtatgtatgatcaagttaaatactttctggtgttaatccctagcttcgtttctatcggtcttattcttgataaactccatgtgtttggttgactccaaaaagaagggcaacttccaacgtaactcttattcaagtgtaaacccatttttatattttggtcatgacttttggctagtactagcaaaagggtcccgtgcgttgcaacaggatttgaaaaaaatatggtaatggttccacctcatgatcaagtatattggaaacgaaccctactatatgtacgacgttgctgtccgatcgtgttacggcgtgggcacagctaacatgcgcacaccaagattcatcatagactgaatcatctatcgggtgtgaagctttcaacgttgctttggtcgtacacaggagtcggacaacaatgtcatatctatattactagaaaaaatacccatacgttgtaacggatgaaatgtattttaatcttattgttgttatacggtttagttaaggtgagattcaccgtgggaatttgcttgaatatatactttttaaaagatcatgagctgcaattaggatttttgtgcacataatataattaactttaatttttaaattaaaaacgggttcattataagattttataatcaacaaaaaatttgttgaagaaagaggtactatagttttgatttttcatcaaccggatgtgcatggtccgtgctagtggtagagaaaaaaaaaattgcgcgcaaatatgatttgacaggagggaggaaaagtagacttattccaggagaggcccataaaaaggtagacttattccgagaggcctatagacacagtgcaagtaatataggtgtaaaaaggagagagaggtgattacatggaagatacatatactatatcaaccacggttttgacccgacaattaaacggatcacccaaaatccttacatatttttttattaggtatagaggtatatattagaattagaattaaataacatgttattattaaaataaaatactaaatatatttttattaaattcttcatgaatgaaccacactatctagaattgttttgaatttttcaaagctcaattgctaattttaataatacaaatataattttaataattaatttaaagtaaaaacaaactaaaagccctctcctaagtctaggtcaaatctggcccattcttcttctcctccctcttgggctgccatcccttcctcttggccgtcatccctatctccacttgggcccagcagccacctctcttcctttcctccttcttgggccaccatcctcgggcccaacagccatgccaacccatgaaaagaagcagatgggaataaaaccgaaaaagacacggaaaaaaaaggaaaacggcgaaaaaaaacgcacggacgaaaaaaaattgtcggaagccttatgtatatatagattttcgattggaaactcatcctctaatgtaacaactcgtatgtatgt

SEQ ID NO: 10251 - DNA, 1501 bp, Oryza sativa
gtaagtgacttaactttccgtcgtcataattttgacatagttgtatgcgtggagatcattttggttgatagatacatacattgatagatacatactattgtgttcatccacaggatggaccccttaactacatatttgttggaaatcaaactagccggggatcgaaaaaatgctagggtggaatatgatcggtttattttcagtaaagtgatagactcaaatgcgatgtgctacaaagactttattgatggattttgttattgtgatgccgtacaaagtggtctagtcatagttgacatattttgctattgtaaggattgcttcctcatgatgtattgatgcactgttatggaccttatgccattatgctcatgatatactgcctagctaatttggtttgttggttgcactattttgtttgaaatggaaagttgtttgtttcctgcactattgagtatggaaatggaattgtgggtgcgcatgatatgaactgttatgtatggatgatggaaagattatgttctgtgcatgatattgtgtgttctgtatggatatctctattgtatgtatgatggtattcatgctcttattttaccataatcaatttcttatgcagaggaacaatttcttctatagagaaaactgataactgtacagacagtcagcttttcctgatcctattatttttccaaacaaaaagttcattatattgtatttttttcagtgccacaataaatttgttatacgctcattatttagtctcataaaatacacatattgttcagttgacatttttttcaattttttctatctagctgccactcctccatctacaagggtattttagacatttggaaccacacataacgtgaaaatgaaggaaacctaacgggaggggcatggaagggatcaaagcgaaatttcaggggtacacaggggattgggtaaaattcgagggtatagaagggattatgtgagttttcatgggcacacaagagattttctcgccccacactagtcagtggcctactccattttggtacaggtcggacggcgtggtgctgcccctgaagcaagggagagtgaaacacaccatagagtatagatggccaaaatgcccgaggcccgatggcccggccgacggcacggtgttttggcccggcccaagcacggccaccgggccgtgcctgggcctctccaccggcacgttgggccggcacggcacgatgggccgcaggctaggcccgacacataaacaatagggactaaaaatagacatattatatgtcatggtcgaaagaatagggacgtaaaatagacttattttagctatatatatatatgttagcccaaagaggagggacagaaaatagacttattttcactatatatatatatgccacagtccaaagaagagggacggaaaatagacttattttcgctatatatatgtcacagtccaaagaggagggaaggaaaatagacttatataaaaaaggca

SEQ ID NO: 10252 - DNA, 1501 bp, Oryza sativa
gagccctacaacagattagcctaccattctcacaatatcggagaaaattaaagagagggtggattctgacacttttcgaggtgacgtgctcgcttccgcgtgtgtccatgtcgccccgcttcctccctgagtctgggatggttgtcggcccagctactgccattcctgcgcttttgccgcgccttctcccgcttttctcgccgtcgcactccattgtgttgccgccctcgtccgccactatcgcccgccgctggcctcgtccgtcgccgtgccaccgccactggcctcgtccgccatggctaccgtcgcactccactaagtcgccatcctcgtccgttaccgccgtcgtcgccctcatccgtcgccgcggcaccgccgctggcctcgtacgtcatggctactgtcgcactccactgagtcgccattctcgtcggtcgtcgccgccgccgccggcctagtccgccatgggcgccgtcgcactccatagggtcaccgccaccctcgtctgccacggctgtcgtcttcgtcgcgctctaccagttcgtcgccctcgtccgccatagttgtcgtcgcctacatccgtcgtggccaccaccgccctagtcccttgccattgccgtcgccctcttccacggtcgctgtgttcctcgtccaccctggtcgcctatgtccgccttgaccgcggcccctatccaccgcggccgctgccggcgcgttcttccgccacagctcatccaccgcgtgcatgcaccgctgccatcgtcctcttccgccgtagctgctgtccaccttcgcagctaccgccgttgttgtccactgcatccaatccatatcggaagagaagaagtaagaggaaggagagaggaagacatggaaagatgatgtgtccataaaagataaaatatttgtggtacagtaatttctattatatagacattaggtaaaacgtttactatagatgatatggctattttttttaagtcaatattattaaccttgctctatggtatagatggccttttggcccgcacggcccaccagccatcgggccggcacggcccgatcggcacttcgtgccgagccgtgccgacccatgggctgcgcctcccgcccaggcacggcccaccagccgtcgggccgtgccgggccggcccgaaggcgggagtggcccatcgtgccttttttatataagtctattttccttccctcctctttggactgtgacatatatatagcgaaaataagtctattttccgtccctcttctttggactgtggcatatatatatatagtgaaaataagtctattttctgtccctcctctttgggctaacatatatatatatagctaaaataagtctattttacgtccctattctttcgaccatgacatataatatgtctatttttagtccctattgtttatgtgtcgggcctagcctgcggcccatcgtgccgtgccggcccaacgtgccggtggagaggcccaggcacggcccggt

SEQ ID NO: 10253 - DNA, 863 bp, Oryza sativa
agtgttaacctgtattggggatgggagaatgggagctgggagggcggccgactttggcgcacacgacgggagggaggtggccggcgacgcccgcgcggcgggaggggcggtggccggcggcccgcgcggcgggaggggcggtggccgccggcggcccgcgcggcgggagcggccgtggccggctgcccacgcggagggaggggccgtggccggcagcccgcgcggcggggcgacgcccgcgcagtgggagggcggtggccggcgccccgcgcggcgtgacggcggctggacgacggcgcgtggccggagggcggcgggaggatgcgtcgacggcgcccacggtcggacgacgccgggacgacggctcgcgtggcgggaaggcggcgggacggcggcgcagtggccggagggcggcgggacggcggcgcaggactgcagcccggcggcgcgcagaggccgctcacgtggagagatgcgggagaaggaaaggggatcgaaactagttagggttggaaggggcattttagtatttcctaaaaatactgacaatacaacacacggtttgattaacatatctaacggaaacctgacgggaggggcatgggaggaatcaaagcgaaatttcaagggtagggattgggtaaaattcgagggtatagaaaggattaggtgagttttcatgggcacacaagggattttctcgtagtcgaaagccgtgtgatgttgtttccagctgcaagtcaaatccgatactactattcacaaagctgatagttccccttcttcctccctgtgcttttcccctttcctttctctgatttctctcaaatgaattactgttaccagttggtgtgattctccag

SEQ ID NO: 10254 - DNA, 1501 bp, Oryza sativa
aaaaaaaaattcacaaatctatctctcatgtgaaatcctgagtatgtccataaccgaagacgcggctattcgaatggattgacgccctacagaggttatacaactttatctacatgatacagtttggtgccactaaacacctaagagtaaaaattccgctacctcaccctaaacactggcttctctcacggacggtccagtttttgaaacatcggtatacctcgtggtaaccgcacagttttcacaataaccgtgaaaccgtgggctggcggtaaccctcccaaaaatggtctggagaaccttgcttggcatgcgcttatgtttcgttgttgatgatcaacgaatgattaaattcatggtggatgaaaagagtaaataatatgggattaaaaggccgatgctggcattgatcgggagatgtaaagactgatgattgatttgctctcacttttttcttaactgctggtggatgggattgaagcagcaggtatggcagccgttgggtggcatgtgcgcgtgaagggaaggcgcaaggtcaaaaaaatattgttttatgtgtaaatttctaatatcacaagatttttactcatattaacatgcaacattcgtaagttataattgaaatcctaagattggaatcatgtttagattgtgctttctctcgattataatattaaaaatcgacgcgctcggtaaagatggaatgagaatggtttgaaattacacaatggctttaaaaagatcgcaattcattgcaattcatttcgacggctagggtgcctgtgatttgagatgaattttgattttcgaacaccactaatgacaaaaaaaaaaaaccaaacgaatctcattgttataccaaaagttttgcacttgcggagttgcagtgggcactgggcagtgccatcgtcctctccgataaaccctagagcgagatttttgccaaaaatccccaaatgcccctcctcgtcccctaaaccccgccccgccgccttcctctctccgccatgcttctcctatgccccctcctctccccctccgccgccgcctcctccccgacccacccctccccgccgccgcccgcctttcccgctccgaaccctttgtctcctcctcctccgatgacgacgacgacgactcccccctctccgcagatctcttcccgcgcgccggcgcgcccaccctcctcaccgtcgcgcgggggctcgccgccgccgacgacccggtcccctccgcgtccaccgtgctcgccttcctccgccgccttccccacgacgcctcgccgcacctcttcccccacctcgtcgccgccctctcccgctcccgggggggcgggggcgggggcgggggccccctcctcgcgctccgcctcttcctcgccccgctccacccggccgccgtcacccaccactccttcaactccgcgctcctccgcttcccgctcccgccgcacctcctcccgcccttcttctcccgctccctccgacgcttccccggccgc

SEQ ID NO: 10255 - DNA, 1501 bp, Oryza sativa
tggctctggcatttatccctcggagtttatgtttgttgaacgtactaatgagtatatatatggtttcgtttggtggaaaacttttatagtagctgcagttttttttcagaattttaagctctctcaaataattaacaatccagattcttattcatattctgacagtacgtagttatagaagtcaaaagaagttagaaaatccagcttcttaccatctctcttttgtcccctaatcttgagctctcgaaacagggcctaacatactcatgtgatgcatgtaacggcgaaaactgttctcaagcaggccggacgttcacctagctctctgtcattgtgcctccaatgtaccgtcgatgtctgaaaaaagtggtcgactgctagctccgtcaagagacgcgtgcatgtattaattccatgtactcgaaaaaatgaaaacgaaggacgaagaagcgaagcatgttcagatttcttatgggttttaggccttcaccgttttgttgacggcttcttgctcttcaaaagggtcgtatttacgcgcgtcagaactgcataaaaacgcagctgacgtatatatatctggccattcatggccatgcgtggccgattgcccatcgacacgagagatatggatcgatgtaatatatttatcggatcataaataaacactaatatctcgagaggacgttaactcattattatatgccatctaaatgttataaaatataatatacgatatatcgttcttcaaattcgatctttacaagtttaataataataatagatttaactgaaacactttatatttaaatttgttgttttaattgtgaaatataaatttaaacttgcatgttgtgaagtgatatatcatatattaatttatcttgctaaaaaaattttaaggacacgaggaaaaatgaagggaaaccctatctctaggattaaaaagtctctcattagagatgttatcaaaatattggtcgtgattcaatgacgggctaaaaatggccgccacaggtcagccgccatgggggccgtacatcgaggaattaataaacagcaacgtgatcaataattcgttagtcaattaacttgatggtattttccgagtgacagtgcattaatttgtttgtacagttatcgccgtgcagagtcttagtacggactccctccgtcaacaaatggatgtcatgttaaggtccgtgcgtccagtagatcgatcatctaaagctatttatattttggtgctccgtatatggaaaaatgagtgctggtttaatatatttgaaattatcatgagatttaaatttgtcgtagagaaaaacattggatataatataaactttatgagtgaattttcacaaaactgcatatatttgataaagctgttatgtgcattaaagctttgttttgcgaaactatagatttaacacggaacatgaaaaattttgaatttagttacaaggttgatccttgtcttatgttcagttttttttttttagtt

SEQ ID NO: 10256 - DNA, 1501 bp, Oryza sativa
ttacatctaagtactccatattcatatctaagttcacttgtttgtgtttctaccatgtgaaataaaattatttgtatgagaattcgaggacatactaggaaattcatcactcgataaaaagaatgacacatatataattagcatgccattcatcacccgataccaaatatataattagcatgccattcatactcgcatttgaatgttaaaattctaacaaatatttaatatgcaaaatctatcacttgttctctttctttttcttttccattacctttctctcctttttcctatgacatggcaagtttcagtgggcccaaggactacatatagcaacatgataaactgtagattgcagaggttctattcttgtattgttatcttgatggatcttttaaaatagatgtagctttgtgataaactttatgctaaatatgcagttttacaataccatactgtgatgatttcagtattaaatttgtagttttgtgatatggcatattaagtctatcgatttgttattgttttatcaatttatctctagtttttttaaggtttactagctccagtttcaatatatatctcatcacagcaaaacaaatggagtaaatgaattctttgccaagattgatggtccccgcagaaaaaaggcactccttgtgcctcacacctataatgccgagacaatattttgttgtaataattattgatgaacaaactaaaataatcaagctacagggactaaaatgtttttataaaaaactctacgctttaaccgacatagaatttccacactccaatctttactctccagctccagaaaaaaaaaagaaataaatgatataactctatattcttttatctgtacacgcaaaaattttaattatgtcttgaattatattagaagaaaacggcatagtacacacaacggtagctttagtcaataaagtgagcagttcacaaattaagagattacataatatagaattccaaactatttaggcagttttagcatgtaaaagtgggaaaagaaaagaaaagaaaagaaaagaaaaaaagaaacagaggccggccgggaccaaagcgtagacatcttgaatcgaatgcaagtgtactaattcctcaggcgtgtcgaacaaccaaagcccctcggcaacatacggaacatcaagctatggcacaccaactttagaaagaaggaagattaaaccaggagctagctagacacagcagacaagttaagtagatattaatccccacacaatctccaaattaaaaccatgcatgcttatcatcatcaccatcaccaccaacaagaatgtccatgtcatccttccaccatcgatctctccatctctttcatcccccctccacctataaatactgctaattagctccctctcttcttcatccaagctagctatagctagtatatatctgacaaattcagagaaattcagagagtcaccgcgagagcttaagctagctagctagccggcca

SEQ ID NO: 10257 - DNA, 1501 bp, Oryza sativa
ctggaggcggaggggccaatggcattaggacctcaagaggcggcctccaccccgagcttatttcagcgtcgacatcgccttcgatcccgagctccgccaccaatcttccaccgccttcgccttcgcctccgcgctcgacctccaaacacacattcacatccaaacacacgtctgggcatcacgaaatcaatataaaatgcgccagaaaattaatgagaatgaaacaaagacttgccattgacgatgaaatcctaaagctgctgttgccaagctcaacgctggaggaggatgtcaacgctgatggtgcttcggcatcatcgtcgcttgagcggatctgcaggaggcggctgctgatgaccttggagcagaggacgaaggaggaggtggccggagcatggggccatccagatctggtggtctccaaccaccttgagacttgatttggtgccaaggagcatggggcggcggagagatggtggtcggcgaccttgggcggtggtgggcgaaggaggcggcggcctcgagctcctggaggctagtggcgagcgaacgtgacagtgacgcggtcgtgggaaggaagccgcaacaaccggtggttggcgggctggtggaggaagcgagaagagaggaggaagagagagtggaggagatggggagggagtaggggtggaggagaggaggagaaggggcaaattggtgggtggtaggccccctgggtgggggggtgggggttttcttttttttaagtcaccaccgacggtataaaaattgaacatgtttgaggtgagatatctcaactgtgacgggtgcaaacataaaacccgtcacaggtaagaggtcatcagtgacgggtctatatgtggacacatcaaagacgttatgtgttgggtccttgtatagatccgtcaaaggtgagtacttacctgtgacatgttattttcctaagccccatctacgacgagatttattttaacctatcagagatgatatctgtcggtgacatgggaccgggagtatcgtgactagaggcttgggcagccgcgctcacccacgtggcctgaccccctcgggggggggggggtcgggcccgagggtgacgtggccacccctccctctgtctccccgaggggtcgggccgctcccgtttcggccccgagggctggggcgccccgaccccctgtggtgttggcgccacgtgtgtgggttaggtgagcacagcggcgctcacctaaccgtatttattgcgggttggacgagcgcgccacgccgcatttaatgcagcgcagcgcgctcgcttatccggtccgtgaccggtcgcagtatgtgaccggtcacagaccggtcagattgcgggttaggtggcagcaggcggcctgtcacacgcctcgccccgtcccgtcggaatgatgagagcctccaggcactcgtccctagccggagccggcgtgctaactcctggagttggcacgtctgtcccggccagattcatgccaggcttcat

SEQ ID NO: 10258 - DNA, 1501 bp, Oryza sativa
aaatatagccactgatccagaaggactctcggggcccatgagtacttgttggaaagcttatggagtctactttgatatggttctagtcctacatcaaaattctttccaaggagttaggaaactacaaaacaagctatataccttatccagtcggagtctgatttgggctttgggctttgtaattgtttcgtgggctaaaccctatccctaatcatatttattcagtagtcgtcatagttcagagtgaggttttgcttagattatcttatctaatgtagtttcgctactagttcggtttgtggaacccaaaattcaagtgctaaatcattcatatgtaattgagttgtaatctaccttgtttttggttctgttcttcaattcacatgtttggattagccttgtcagtgaggtcaatcggaccgcgcactgttgataaaaggagacatggtgctgtggttgcaggttcgaatcgtgtttattggaaactggattgtgtgtgtcaagtttccaccaaatcgagagttgtcagtacctatcggaatatgattttaggtttatttttaatgtagtatttacagtgctatataatatataaaataatatttacaacttgtttcaattgtaactttgattgtaatttctatctttattaagtgcaaatatttgaaatttgtttgttttccttcataatgtaatatatttttttggtgaagtcatatatatgctttttctgattaagtgacatcccacaaactttcttcggcatatatgtagaatgaaggagcctttaaaacaaatagtttttattggatacaaactttgtaattctttataagctcctttttttcttcctgtaactttgtacatattctgttttaataaaaatacactgctaggcaaagccctggtagtttttcggtaaaaaaaaaaatgacatcccacaaatgttccatgaaaaagatagacaaataaatgaaaattttgattggcccattaaggaattgacgtgggctccgtcatgacccttacaacaggcaggcccattaaaggccgaaacaactcagcaaacctatatgagtggcatacatctgttgttggaataagttcacatgagtccctcaatttgtcaccgagttcaagattcgtcccttgagcgcaaaaccaggtacaacgcatcccccaacttacaaaaccacgcaaataaggtccgagagaaagaaatagaaactaatcctatcctaccctaacaaaacggatacaatacgatcttatccacatactctaatagtccttggcgggcctcgcctcggggctccccgtctccccagcatgatgtacgtcaggcaccctgccagcgccgtgatcgacgacccacagtccgacgatggcccggagctccggccgccgctccctcctctcccgtctcccgtctgtcgcggcgcacagctcctctgttatcagctaccacacgccactcctcaaccgcctctccgcccaatgg

SEQ ID NO: 10259 - DNA, 449 bp, Oryza sativa
tccactacagggtgagtaaaccaaatctattcaaatagccgtgctcacggttattgagcaccgggacgtgtattacacttggctagactctaaattcttaacttgtgtgggatgggatattgcatgatgatttttatgctgttggagctacttcctgagaggagggaaggtggacgacctcagaaaaccatgacgactcaatggcgggaagatatccttgggatcacaatggatggtggacagaaccgtcgttgtttaatgtgaacactggtattaaaatttgatcagtctatgcaaggtcttaggcttgtgaaaagatttgcaaaacttgctttgcgcaaaggaacctgaagccattccttaaaataccttctatcatatgcatcgttgctgtggtagcttgctgagtacgtttggtactcacccttgctatttatatatcttttagg

SEQ ID NO: 10260 - DNA, 1501 bp, Oryza sativa
acattggtgaaggtggtggtgcagcggggcgacgagccgacgaggaggaaggaaaggccggcgcggaaacgacggcgttccggcgaaattcgggcgacgccgtggcctggccgggagagaggacggcactgcgacgtcaacggaggagacggcgacgtcggtcggcgcaccggcgacgaacagcagccggccggagacggagaagtggtggcgacgccactggacgccggcgaggacgcgtctccggtgctttccccgcgaaacggagggctgaccgagggagaggaggtggctgcgaggccgagggagaagacggcgcagccggagggtgcacgggtgaggcgggaggtgcggctggaggtggccggcgcggagaaaagaggagggcgacggcgggaaggcagctccgggggtcacctcgcgaaacggagggcaagccggggtggaggaggtggcggcgacgctggaggaggcgacggcgcggccggccggcgcacggtcgaggcggcaccggcggctggaggcggccggcgacgtgggagagagagggcgacggtggggagggagctagggaccacggggaggctcgggatggggctaaaacgagagaacgggggatgaggatcccattttataggatgggggagggagccggccacgggaggagcgggaacggcgacgggaatggtggccggcggcaaaggaaggcggccggacttggcgcggccgttcccggcgattgggggcaccattcaaggaggaattaagggggaattgaagaggattcaatggggtttaatttcccctatttaattttggaatcccatgagcgaatcacacggatttgagggaggaagggagtagggtttcacgggaagagagagagaggtggccgggcggaggaagaagacgacggcggcctggcgcgtgggccccgcgcggccaggcgcgctctcagcgcacgcgcggcgcacgtgcgcgggggggggaggggcggctcgggcaggagaggcccggctgggccgggacacggcccaggaggggaggagggggaggcggcctgggccggacaggccgggaggggagggggggggaaaagaggcagcccgggagagagagggaggaggagggagtgggccgggaggggaagggggcccaagaggagggagagaaggagagggagagaaagagagggaggagagaaggacttcgggctgggcttggcccaaaggaggaagaggaggattatttttagattttctttttattgaactttgataattgttgttgttgtttaataaatatttccggtgctctgaaaattcaagtaaaatttgagggctcattttagaccaaggagaatttaacaaaaattctccgggtcacatttgaatttttcttgcacgtattttagtgtttgccaatttcttttcgaattttaattaattctattattccttttaggaaaacgaattttaattcggaatggatttatcaggac

SEQ ID NO: 10261 - DNA, 1501 bp, Oryza sativa
ctccctcggattcgttcggaaactttccccctaacctcgccggcgcatcaatggcggccggatcttccgcgcccgtttccccctcgtccggccgccctctcccactcccaaccctatataaaccttccccgtgcctccctccaccgtttccgccactcgccgctctctctccccgccggaatcgagctcgcgccatcgctctctctctccgccgtcgccgccgagctccggtccgccgccgtcgtcgccccggaccttctcccgcttcggcgtcaccttcttcgggttcgccgcaacctcgccgacctcgtccacctctccgtttcggtcgccgaccgccggaacgccgccgtccccgtcgacccgagccgcgccgccgcctctatccgctccggtcgccgttcccgtcgtcgccgtcgacccggggtgagccgtggatcgccgattcgtttcccccttccctcccctctctcgggcaccgctccgccgcgccggtggtcgccggcggcgaccatcggggcacgagtgcgccgcctcccgtcggctgtgccggcgtggccgccttcgggcgcgccccgcggctgccgcgtggggcccggccgtcagccgcccgcgccctcgggtgcggctgacgcgtgggacccacggcgccggtcggtgcgagcccgggtgcacccggtccaccgtggaccgtgaggctgccgcgtgggccccacccccgtggacccggtccgcgcgcccctcccctcggctgacgcaataaatccatttttaaattaaaatttaaatgaagaaattcgcaaatattcatttaaagagcatataaccttcaaatggccataacttggccatttgaactcggaattggaccgttcaagtctctaatttttccttaaaaagtcaagaacccatttttgtgctttgttcctgcttgttatatggagtttattagagtaaaagccttttcttttccgttggtcgtgtagacgctgcagcttcggaagatccgctcttcgtggaagttgaagtcgacgtttgggaaagcgagcaaggcaagtcacatcatctttgagcatattgaatcccagtttataaaattatgttgctttaaattattgcattatcgctttatttaaattcccgcgttatcacagttttatctagccatgcctacttacctttgttatgaccttattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatggttttaggctgggctcggggtgcatggttttgatagtagcaccttggccatataaggaccggt

SEQ ID NO: 10262 - DNA, 1501 bp, Oryza sativa
acctaaaatataagtatagatgtcagttctattaaaaaaactcggcacctatagtataggtgtcggttttttaatagacctgatacctatagtgcttaaaggtgtcggttctatattttttcatcgtgcggaggtgggaaaaggctcataggtgctggttttaaatgaaccagcacctataagaccggtccttatgagggttttttagtagtgtttggtcggttatagatgatttgataattttttaagctagcagttgattatattattgtacttgctttgacaataagtccataaatttccatgtttgttttatgcatagaggcaaaatagatcattttaagaaattaaaccatcaactaatggaatattggggatgtaagggacaaaccaaaaatcagagacttattttttgaggtgaagaggggttgtgggggtggggtggggtggggggaggcaaaccgtataaagaaaatataattcagatgtaatgtagtaccttcttgacccgaaaagttgaaaacaacatttgagcgggcttaattgattgtcgaggtttcacaagtttaataaagtaatgaatataaatataaaatactctggcttatacaacaaacttatacacttttgagagcaattataataatacgatgtaatcgggctttatgagttatcgtatcgcatttgtgcttatgtggagtagaggggagaggagaggagagagaagaaaaacaagctatagatttatagccagctaaataaagcacgagctcaaataaactatgtaaagagagatgagccaaatattaatgatgtagtgtgtgtgtatagatagacacacagctagctgttgtatgaccaggctatttggtcggctgtagatgatgtaataatttttggagcttgactatattattgtactcgcatgctctctatcaacaagtcgttcacaattacataaaatctaataagtttagttacggcattgtgaaagtattttttttaaaacaaatgtacacatgtcgtcgtttatatttcaaatattactacctctgccgaaataatgtttaatattgatatgtgatccatgcaatcacaacaatttgattttgactatagttattgttttaaagtacaggtctcatatatattaaaaagtatatattaaagtctgtcattacgaatgcttttacaatagcacacttgtataaaattttttaatccatataaacgagaatttttgattgagtattcaaagtagtaccttgttgacctagaaaagtttaaaataacattttttttatttaacagattaattgatagtcgaagtttcaaaagtatagtaggatcatatcaaaaatgtcacatgcatgtattttacttgaagaagtactgatttggttcatttaattatttaatttgttacttgccagcaactgctgtcgccggaggtattctggcattcgtggtgctgtacattctcaaggagcataggaggcgg

SEQ ID NO: 10263 - DNA, 1501 bp, Oryza sativa
gcatgggcacatccgtatgcaggcagcacccgactagacggaccagattctcatgctggatccgagcctggctcgttatctcatccgcgaaatcctgtttgttaagctcatggccgtttctgacaaagcgcttcacagcaacctgctggttgtcctgggtgatccccttgtaaaccttaccaaagtagcctttcccaatcattcttttctcacagtagttttttgtcatcttcttcagctcctcttcgctgaagattttgatgtccatcatcttgttcagtatgttgccaccatttttgtcaaatgatctatttcgctgccgcctcctatgctccttgagaatgtacagcaccacgaatgccagaatacctccggcgacagcagttgctggcaagtaacaaattaaataattaaatgaaccaaatcagtacttcttcaagtaaaatacatgcatgtgacatttttgatatgatcctactatacttttgaaacttcgactatcaattaatctgttaaataaaaaaaatgttattttaaacttttctaggtcaacaaggtactactttgaatactcaatcaaaaattctcgtttatatggattaaaaaattttatacaagtgtgctattgtaaaagcattcgtaatgacagactttaatatatactttttaatatatatgagacctgtactttaaaacaataactatagtcaaaatcaaattgttgtgattgcatggatcacatatcaatattaaacattatttcggcagaggtagtaatatttgaaatataaacgacgacatgtgtacatttgttttaaaaaaaatactttcacaatgccgtaactaaacttattagattttatgtaattgtgaacgacttgttgatagagagcatgcgagtacaataatatagtcaagctccaaaaattattacatcatctacagccgaccaaatagcctggtcatacaacagctagctgtgtgtctatctatacacacacactacatcattaatatttggctcatctctctttacatagtttatttgagctcgtgctttatttagctggctataaatctatagcttgtttttcttctctctcctctcctctcccctctactccacataagcacaaatgcgatacgataactcataaagcccgattacatcgtattattataattgctctcaaaagtgtataagtttgttgtataagccagagtattttatatttatattcattactttattaaacttgtgaaacctcgacaatcaattaagcccgctcaaatgttgttttcaacttttcgggtcaagaaggtactacattacatctgaattatattttctttatacggtttgcctccccccaccccaccccacccccacaacccctcttcacctcaaaaaataagtctctgatttttggtttgtcccttacatccccaatattccattagttgatggtttaatttcttaaaatgatctattttgcctcta

SEQ ID NO: 10264 - DNA, 1501 bp, Oryza sativa
ttggtttttttgtctacatttaatactctatatatgtgaccaaacattcgatgtgacagcgtgaaaagtttttacgtgggaactaaacagggccaaaaactgtctatcaatatctatctatctatctatctatctattatatactaaaagtccatgaaacttcctacaaacgctctcaagccgccacgtggcgttctaataaaatagagaaaatcctagaaattctacgaaaaaaacaaaacatccgaccattgattttcatttaaattggtggacccattattttacaccattagatttatctcaagaaaaaaacaaccaaatccacctctttccatcgttagattagatctattgagactcacggtcaagcacacctcgcctctttccgtgcatgcgacgcactgtacgcacacttcctctcctctcttttgctgcccctcccctcctattctcttttctatttgtaagcaatcattttttttatcaagaaatcaacagttcgatgtgttcaaaataattactatagttttaatttattttgtaagcaaactatcagatcaagaaaatcctccgtcgatatatggagcagttctacccactgttgtaacaatataagtaaatttcttgaagcttttggaaaataaattaattaattttaggcatttgggttatcaggtggtttttaagagagcgtgccctacctcttcctacgtatgtgcctccctactcttacactctaataagtcttaatttatacaattaaaaactcagttttgaatatattttaaatcataaaaatataattttgcgggaacattatattatattatacactaaaagtatattaaactcccaacaaacgttctcaaacattcacgtgacacagtggcttagataggatttagagtaaaggcggtccatctatatgtaataggtcaattaaaagggtggtccactatataatttttattatattaactagcacatatactatagttttaatcttgatcaatcttttaggtggtccatggcctacagtgccaccttgctagctacgcctctgacatgacgttctacagacgcttctaggatgtcatgtggcgctttaataaatttaaaaataaatcatgaaaattctaattaaaaagaaaaaaaattctaaacattgattttctttaaataggtggacccaataattttaatcttaaaaataaatccggtaaacccaccttcacccccaccgtatgtgatcacgcatgtaagtactcctccatcctcctactctcctctaggatcccactctcctctctattttctagctaactttcctattttctagctaacacaaaatatataaaaaaaacaatagctaaatgatcatgactctcaagttacatatacttttctcaatctatttgctttcttgtgttattgtataattaaatacataatccaagatctatattgcccatatttactatataaaagttagataatt

SEQ ID NO: 10265 - DNA, 1501 bp, Oryza sativa
tcgtccgccgtctgtttcgttccattaaataagcgatgtacaagtcaaacctcagctagatggacagaatgacacagaccactgtattgacatagagtatatagtttgtttcattgtctgatagcgagttgttgttagtgttatgatttgtgaaacttggcaacaacgcgcgcgagtagcgagatattaagtctggtatacatgtgcattaatttatatgcacgtttttgtagtaattaactgttgactttactcgttgacgacgtaattacaaagatacttgtcagctactcggcatatatactccagaaatggccaacgtctatatatgccaattattatatatatttaacccaacatcgccgacgtctatactagtaatggtatccaaagacggcatagacaatatacttccctccaacccatgccatagacaattcaatcctaacatttaaattttatcccataaaaataaatttctagaatatttatagtactatttcccctccaacaacctaccctgactatatttctccattttacccaaccacaccctctcactttcatccatgccgggtataaattgtatttttttttggaagggagggagtattaagaatgtgaaatttgcgtatagcattaattaaacagtggcgaaactacggttaacctagcttgagtcccataatagaaaatgtccatacagtggcagatctagaaatttgtgtgagcctaggcaaacctaattaacaaggggcaattgtaaattttccactactttaaatcgttattgtaaaattgccaatagaaaattgcaaaaataccactagaactatcattcgagtgacatccttgcaatattgaaaaaacggtggcaaatttgcaaatgccccaattaacaacgccaacggatatataacaaatcacatataactccatagactgtgtaccatacaacaacttttttttaatctattctaatttagaggaaaacatggttgtgtttttttttatctattctaacttagtaatctatttattatcttgaatagagaaaaattataatggtgctagaaaatttactttgccttcaagttgtagacgtctaatagcttgcactcaagtaatgggtacaacgatctagctagtaaacaatcatggtgcttcaggttactctagatgattgtatctaacagattattaaaacggtcaaacatgtttaaaaaagacaacggcatcaaatatttaggggcggaggttgtatgttaggagaccatcattggcgatcttgatgcataatataggattaaaaacgttagctagctaaacaccgtatatatgtctactagtagtacaactcgatccactatataaagacatgcgtggtcactgcaaatccgcacgcatagctagctactagaaatgggcaaaaacgacgaaattcgcatacgacgactaattgccatgccacacatagtagtagttgtgctatgctggtttc

SEQ ID NO: 10266 - DNA, 1501 bp, Oryza sativa
cccctaaatatttgatgccgttgtcttttttaaacatgtttgaccgttttaataatctgttagatacaatcatctagagtaacctgaagcaccatgattgtttactagctagatcgttgtacccattacttgagtgcaagctattagacgtctacaacttgaaggcaaagtaaattttctagcaccattataatttttctctattcaagataataaatagattactaagttagaatagataaaaaaaaacacaaccatgttttcctctaaattagaatagattaaaaaaaagttgttgtatggtacacagtctatggagttatatgtgatttgttatatatccgttggcgttgttaattggggcatttgcaaatttgccaccgttttttcaatattgcaaggatgtcactcgaatgatagttctagtggtatttttgcaattttctattggcaattttacaataacgatttaaagtagtggaaaatttacaattgccccttgttaattaggtttgcctaggctcacacaaatttctagatctgccactgtatggacattttctattatgggactcaagctaggttaaccgtagtttcgccactgtttaattaatgctatacgcaaatttcacattcttaatactccctcccttccaaaaaaaaatacaatttatacccggcatggatgaaagtgagagggtgtggttgggtaaaatggagaaatatagtcagggtaggttgttggaggggaaatagtactataaatattctagaaatttatttttatgggataaaatttaaatgttaggattgaattgtctatggcatgggttggagggaagtatattgtctatgccgtctttggataccattactagtatagacgtcggcgatgttgggttaaatatatataataattggcatatatagacgttggccatttctggagtatatatgccgagtagctgacaagtatctttgtaattacgtcgtcaacgagtaaagtcaacagttaattactacaaaaacgtgcatataaattaatgcacatgtataccagacttaatatctcgctactcgcgcgcgttgttgccaagtttcacaaatcataacactaacaacaactcgctatcagacaatgaaacaaactatatactctatgtcaatacagtggtctgtgtcattctgtccatctagctgaggtttgacttgtacatcgcttatttaatggaacgaaacagacggcggacgatgacttgtaaatggctgataaggaggaattttttatctggtgtgtactagtgatatgattgacgaacgatgtattatttgattaaaggttggcgccaaagattattacagcatgcaagttgtagggtggattgggcgtcggaacagcagcacacacactccagacgaaaccttttacgttgctgtggaaaatggtagaaaattaagtgtaagatgaatttatttgttagctagacaacgtaattttaaa

SEQ ID NO: 10267 - DNA, 1501 bp, Oryza sativa
tctatctctattaccgacaattgcgctcttaaaatctaatgctgcttaattcccttgtgctcgaaaatttatgattcttcttttacctagcaagcaattgacgtgctatttgatttttttcctccaatcaaatgttttatgttaggataatattttatcaaacttttgaaatgtttagactatttgagcgacctacattaataggttctctttaaaagctcatatcacacaaaaaaatgaattttaatcatcaaatgcgcatcacctgcccaagtccaccgcccaccgctggtcctccgccgctcacggccatctctctaagtctcgagtaaacctctctcttccccctccccaacccccttctaccctgacaccccccctccccccaaccaaaccctaacctgtatggtccctgtcggagtttgggtgtcgccggcgccagagaagatggggagcccgccggagttggaggagaagaagccgatgcacgaatcttagtatagatccaatggtccaaaatctgtaaggtttcatccccaaatttcattcgaatgatatatagcaatttcatttatgattatcctaaaagcagatgattcttttttaactatcctcttttttctgtttttctccaacaaatccttttcttgaactaaccatttttattttttcctacagtaatattttttcttgctcgatgacgacttgcttctaagtagtagagaaattctttttcttgaactaaacgttttcagttttcaaaaagaatattttctttttgtttttcttcagtacttttttttccttgcaaaaagtgtgctgtgcgttaggagagaggatgacgacgactcgctttacagacgcttttgcagtactctgctcggtctacatatgtgttttgtggagtgtttaaagggacatttaactccatgtcacttttaagatgtgcttatctatgacatatgggccctcatatgtctgacatgtgggccctcatgtgtatatgacatatgggtttagtgacaaataatttagcaccaattttaagcaaatagttaattattccgtgtttataaccaatacacttcttgattatggattagctgagctaccaacctaccataactgaaatgagctgaaacacccgcactgttcccattatcatttcatttcgttcgttacctgtagaggtcgcacaactccatcatacatgacacatctctctggcggctgcaacaaaagaaaactcaactactgtaacgtactagtacattgcaaaatatagtactaatgatgcaattattaggaggaaacgaaacctagtactgtacattgataagaacgtgggcaagtacatcagtgttctcctgacgagcaaaagaatatccatgaggaacaaaataatatccagcatcttttttttttgttgcaaatgtggtaggcaccccacctagcaccaaggtttgaaattctcggtttttaaagccacaataaaggcccc

SEQ ID NO: 10268 - DNA, 1501 bp, Oryza sativa
  unsure (1)..(1501): unsure at all n locations
ggctaagttctacacagattatttgctcggctattttatcatttatcgtgaacatgcattttaaattactaaacagtattttaaaaaagttatatataagtttctttaaaaataaaataaatctattttctaatattttataaaagctacttcgtaaaacttaattaatcatgtgtcagtggcgattcgtgtgctactaaaataagataaaccaaataatcctatggaataaagcattagatgtaatcgacgataccacgctacatgaaaaaaagtagattaaccgtttatttttttctacatgcatatggaccatttgcattaagaatatttcacaaaagttagggaaacgaattataagaaaaataatatgaccgtcattctccgttttttcatagtctacaaatatttattaataagttgattttgtaataactctatatttaactaataaaaatcaatgtcacgtcaattcaaataaattaatcgtttaaaatccacacgtccctgtctcaaaataataacatataaataaatattataaagatatatcgccgtctaatcgaagcgatattccataattaaccctgcacctctcagggaggtgcagttgagcatttacttcactctttttctcgagaaacccaccgggttgtcgtctggacctgtttgtcagtgactgtcgagagcacgaggtgatgggtgcacgggccttaaagtttaatcctctatggattcgattttttcacttatttttttacttttcggtgaagcccgggaaaaagggcgctccatttcggagatttcgcacttcccaccccttcccttcgcttcctccctccctcgcctccgcctcatcgccgattcaaccgattcgccatcgccccccacctcgccgccgtcgccgccgccgcctcgtaaaccggtgggattttgcggggaggagggagtttggtgcgggagaagggggcggaggagtgggtggttttgttttttttttttttgtattttgtttttgtgtgtgagagaggggggaagggggcaatggagatggacacatcgccatcgtcttcggcgccgtcgtcgccggcggcgtcgtcggactccatcgacctcaacttcctgccgttcctcaagagggagcccaagtcggagccggcttcaccggagcgagggcctctgccgctggcggcagcggnaccggcgtcttcacctccgccggcgcccccaccaccgncactcgaggtgcaaggggcgacggtggcaactccggtgccggcgacgcccgacctctcggcggcggcggtgatgacgccgctgcagtcgctgccgccgaaccccgaggaggagacgctcctggcggagtactaccggctcgcgacgctatacctgtcgtcggcgggggcggccggcgtaatcgtgccggcggcggcgccggaggcctccgcgggggcggtggcgcagcccgggtcggggtccggcgcgaagaagcggcggccgc

SEQ ID NO: 10269 - DNA, 1501 bp, Oryza sativa
cttaagcccaccacgtactggatccgtcgccttcccgctgaccaccaccaccgctgctgcttgcttctccattgatgcaactgctgctactcgattcgcggctgatgttcccgcttgctctaccgccgtctcgctccacccggtcgtcgctgattgcttgtcacttgcttgccgcaaccaccaagataatgagtggatagaagcgaaaaaagtctttacttgaattaaagctagatggcgcccgcgtgccaccagagcgcattttttccgggagtaacaagcataactagttttagacttttagataatgacaataattatccgattacttttttctttttaaggtagtaatacttttctttcttcggtttttttaactaatagagtgaaaagaaatctataaactttcacgtgaaatttaaagctttctaactttcaactcaaaatttgaaactatttttaaaattttcgacttgatatttgaactttcaagttaaatttgaaaactttcaactcgaactttaaaaactttcaactcagatctgagagatttaaaaactttcaaattcatatttgaaaatttttaagtcaagatttaaaaactttcaacataaactatttaaaaacacgtgtgctaaagattaaaaaaataatccaaaaagcgaaaaaagaaaataaagcgaaaagcaaaaaagaaagaaaaaaatgcgaaaaaaagaaagcgaaaaaaacgccgcggggggggaggggctgcaaactggcgcgcgcgcgaattagccgcccccgatagaagtattggggaagaaaagaaatatgacaaggtggatctctcttgtcagtctctaatactaggagcattttggtccgcatgaaatacaggatgtaaaaacccggtctaattgtttccgtgatgtatataatggcatggtttattttttacaaaatactgatagcatctagctggtatcgaaaatattagtgttattttgtcaaaaaaattaaagagaaaaggtagagagtctctacctatattcattgatgtgaaatagttacatatatgtaattggcagaggagagggatgataaattaggaggaggcgaggggaagaagagaacgagaagagaagaaagatatattttgtcaattaggcatagttgtgattgcagggatccaattaaactttttttttcattttagagatcttttctattacctcagtttcacgttataagacgcttcaatctctccatttatcatattcactagtatccatatgaatttaaaggtatatacaaagcacatatattgatcaatgcttgaatagattgaaaacctaaaacatgttatttgaaacagacgaaataattcattgggacctacttgctccgtcccacgaaaaacaaatctagaattggatgtgacattatatccagattcatagtattaggatgtgtcatattcagcctattggttttttatggatggagagagtactccatg

SEQ ID NO: 10270 - DNA, 1501 bp, Oryza sativa
  unsure (1)..(1501): unsure at all n locations
gccgccgagaggtcgggcgtcgccggcaccggagttgccaccgtcgccccttgcacctcgagtgncggtggtgggggcgccggcggaggtgaagacgccggtnccgctgccgccagcggcagaggccctcgctccggtgaagccggctccgacttgggctccctcttgaggaacggcaggaagttgaggtcgatggagtccgacgacgccgccggcgacgacggcgccgaagacgatggcgatgtgtccatctccattgcccccttcccccctctctcacacacaaaaacaaaatacaaaaaaaaaaaaaacaaaaccacccactcctccgcccccttctcccgcaccaaactccctcctccccgcaaaatcccaccggtttacgaggcggcggcggcgacggcggcgaggtggggggcgatggcgaatcggttgaatcggcgatgaggcggaggcgagggagggaggaagcgaagggaaggggtgggaagtgcgaaatctccgaaatggagcgccctttttcccgggcttcaccgaaaagtaaaaaaataagtgaaaaaatcgaatccatagaggattaaactttaaggcccgtgcacccatcacctcgtgctctcgacagtcactgacaaacaggtccagacgacaacccggtgggtttctcgagaaaaagagtgaagtaaatgctcaactgcacctccctgagaggtgcagggttaattatggaatatcgcttcgattagacggcgatatatctttataatatttatttatatgttattattttgagacagggacgtgtggattttaaacgattaatttatttgaattgacgtgacattgatttttattagttaaatatagagttattacaaaatcaacttattaataaatatttgtagactatgaaaaaacggagaatgacggtcatattatttttcttataattcgtttccctaacttttgtgaaatattcttaatgcaaatggtccatatgcatgtagaaaaaaataaacggttaatctactttttttcatgtagcgtggtatcgtcgattacatctaatgctttattccataggattatttggtttatcttattttagtagcacacgaatcgccactgacacatgattaattaagttttacgaagtagcttttataaaatattagaaaatagatttattttatttttaaagaaacttatatataacttttttaaaatactgtttagtaatttaaaatgcatgttcacgataaatgataaaatagccgagcaaataatctgtgtagaacttagccagaaccgtaaatataccatttcgttgatagaattagctgagatctgctactcaacacgacatggtgattcttagggggaaaatttggccttagaaagtttcaaagcaacaagagaacaaacaaaacgcatttagggggggtgtttagatggggctaaaaatttttaaatccatgtcacatcgaatgtttggacgctaatt

SEQ ID NO: 10271 - DNA, 1062 bp, Oryza sativa
acgccatcgccgtgcctctacgtcgtctgtggctatgtgtctagtggtgggtttatcaatgcagggcccctccgggaacgggggctgattttgccccgcatgtatactcggggcctggggcggaagaatagttcccgggtcgggggcggggccgttccagcccaacccgcacccgacccgccccgttgccatccgtagctgctatagcggtagtggaccaagtagcggactgaagatagtatgttgtaacttagcgcccgctatagcagcctgttatagtccttcgcgatcgctataacagcccactattgactttgttggactgttataatgcttgaatgttgttcttcatatatggattgtagaactttacattgtgtatcttatatttatcttatacatctatatgttatttcatattttttatgttatgaaatataggagtagttaacaatgtcttataaattgtaatttttacataaaacttgatgttaatattgatatataatctaaatttatggttatttttctatatttgctattggaacttagcgcccacaatagcggccgctatccgtaatccgctacacaagtactaatctactaacaacccgctgctaacaacctgctatacactatttattaccttgattatattcggtaagttgttttcttaaaagctgggtaaacacatacgtgcagcgatttgtgattgtatgtaggaaccgtgtgagtaacctgctggactgctggaggataatctgttagactgctagagcgtggtgaaatgtgatgatagaatgcagaggaggcagattaaatggagccatcagccattgagagatttgatttagtggagatgacggacgcgtagccaagatggatgctttgtagatgcatatattgatagttgcatgaagattttgagatcaattttatttcctttaatttcggttaaatttggctatcatttttgtgggaccgacttgatttcctaaagactaaggcaaccggtatatatactggtgatggccgattggaaaagaactcctgaacaactta

SEQ ID NO: 10272 - DNA, 222 bp, Oryza sativa
atacagtggcatatcgtccgttttctcgtttggtagagcttcaacttttaaatttaactttaggagttagatctgaagtggagttgtggaacagcttaacctagctccacctctctagttcattttgttagagtgctccacccagctccgccccattttcggtggagctgaaactgtttggctgagctccagctctaggagaggtggagctggaactggaga

SEQ ID NO: 10273 - DNA, 606 bp, Oryza sativa
ataaaattaatcagaagcgggagatgaagcttcggaggatccctatgcctactaccaggagggagatgaagacgatgacgctcagtaggtcttagtacggtcgttgcctgtggcaatggcatgccgctgcctgaattccgctgccttatctatttctgcttttggatgtattccggaccgctcggtccgatgatttaagacaatgcctacgggcttatgatgtaataattagcactagactctcgtgtatgtgcttttggtatttcagctatgaactcgtgtgtaccagactacttgatccagggaaatggtattgtttacacgaatgattcctgttataaaaacaggggtccacagagctggcatcagagccatacgactgtaggaaaagaccaaaaggcgccccaccccttttctaatttggccaagggagaaattcccatttagtaatactttcaaaaataaaaacgctatgtttacaaaactcggtacgattttcatcttactcttaactattttctttacaaaacaagttttactctcaactgactttgggtttttcttaaaattagatggcagatccggattcacccgctacctgggagt

SEQ ID NO: 10274 - DNA, 1501 bp, Oryza sativa
gctcttggcggcgtcaactttcgccttcttcgttgcccttgtgtgggcaggcggtggagcttggggggcccttgactttgaaggtgccggaagaggagcttgcggaggagtcggtgcaggagcctgaggtggagacggtgctggagcatgaggaagagactgtgcaggatcctgaggaggagatggctgaaccggaggagatggtgcacgagacgccgtttgtcgcccagggaggatgatgtaccgcctgcgccatagaatgatgtcatggcttgtgttccagatgcgtctcaccgtctcctccagggtaatccagctcgaggtcctcgtacgcaccttcgaccaactcaacttcgaccttggagtatcctgctggaatcggtctgcagtggtaagtacctgaagggtccgttgggatggccatgcccgacgccaccatcatgtggtgagaggttatttattagtaatcaacatatataatcagcaactagcggaatggccaaatctaaaatatataaactacgagcttacctttattgataagttcttgaaaggaatatgcagctcacatggtgtccgctgagtgatgtcatcaacgggccaggtggattcgtcctgggtttgcatggcgtccatgctctgtgatcctacctgccccgttgaggcgcagctgctacagtttcctgacgggctcaccattgcaggaggaatggtcggctggggatcatgggaccgatatgcggccatgcgttcatcaaccttccttgccacctcctcttgcatgctgcgctcgtagctcgataccctgaaatctagatctgcaatcttcgcctcggtatctctcttgcttctcatccgactcctgtacgtgtggatgtcctccttgaacccaatcttccaaggaatcacccctttccctcgtgttcgtcctggatgctctggagtctgcagggcgagtgacagctcgtccctctctctatctggtcagaacgtgccctgagaagagtcttccactgcgtctgttagtcgacacgcagcctctcgtatctgatcgccgaagacaagtgagccatcagctgggttgagcgttccaccgtgagcatagtaccagaacttcgatcgttccggccaattagcagtggccggtttgatacccctctcaagcaagctagcctccatctcctcccacttcgacatcgcgacgctatagccgcctgaccccaagtggtgtggtacttcttcttggtggcattttctttgtttctttccatcatcgcctgcccttgttcacctgtcttatatgcaacgaactcgtcccagtgatcccttagctttgggaatgtgtcaaagttcggtgtctgccccttcaggatatatttctggtacagatctcccttgaagctctgaaactgttctgccattttcttcagagtccaccttttcactttgtcctctgtacccgcgggaagggtgaatgtctcgagcattgtggtccacagca

SEQ ID NO: 10275 - DNA, 1501 bp, Oryza sativa
tctcatttctaataaaaagaaatgggggcatcttgcccttgataagaaaacaaaatattttgatatttttgttatagttcatttgtatatgtaattttaagacactaagaatacatatataatattttattcgtttctaattaactgtaggccaaactatatgactaaatcaagtattttttttcgataatcatcagcatacatttttcctttttctgggggacttttggcatctggtgtgtgcaagtttgttttcactcatcttatttgtttaggtttgttttttctaagtgtatatggattaatacaatgttcgacgtgtaataataatctcgtactcatcattattaaagatcaaaatatcccaacctggatttcttatctatggtgtctctagaaccatccttctttcctcttgctccgtgtgctaagcataccgacaaaaaaaaaaaaatcctaaaaccgctgtataccctcgagccccgacaatggagattttttttccccttccgattccatcggccccacttccgcgaaggcgcgtcctctctctctctctctccccacagcacgtcacgtcacgctcacgccgtcagccctggaaactgacggtgacggccgcccgcctccgccgaataaatcagctgcccccacaaccatcaccatttcccctccctctctctctgaatttctttctccccaaaccaaaaccaaaccgaagcttccccatctcgcgtgaacttcggagcaaggaagaacaaggcgccgcgccggatttagccccgcccccctctccggggtatcccccctcctctcctctggtcggttcttgcggtgaatcccccgctgatttgtcctgtgaattcttgtgagattatttttctttttttttttggggcggttggcttgggatttggattggtggggagtttttctgatctgtgtggtggtgtggtggtgtgcttgcagggtttgattggagtgaggtgaatcggtgaggttgtggctcggttggcgtccggatcggagggggttcgggcccttcctgattaatccctcttctggtgagcaatttctctggttttttgtgttaatttgagctgaatttaccctggggatcgggtggatttgatggtctgaggctgatcgatccggaatgatttctcctttgtagattccgtgtgggggattcaatcactggtgggcaaaggcgagatatttcgtcacttctccccctcatctaaccatgtctggtacgtttctcttcatgctctggaatttctccccttcggttgaatgtttcggtggttaataacgaatggctctctgaattttgtgcaggtttgatgtgcctggagatcaagatgggattgtaaccacgctggttatctcgcgatcgcagagggtttcctccatcctctaaggaaggaaaggaacccttgccctttcttctccatggcttctaattcgtagtgtgaaggatctgatttttaggttagtg

SEQ ID NO: 10276 - DNA, 862 bp, Oryza sativa
aaaagaaatccagtaataacattaacaaatttatgttgatttgtatttagggactgtttagttggcaaaaaaaattacccctacacgtcacatcggatattcggatacacatttaaaatattaaacgtagtctaataacaaaataaaatatagatttcgccagaaaactgtgagacgaatttataaagcctaattaatctgtcattagcaaatgtttactgtagcactacattgtaaatcatggcgtaattaggcttaaaagattcgtctcgtaatttcctggtgaactgtgcaattagtttttttttttctatatttaatactacatacatgtgtctaaacattttatgtgacagcataaaaaatttatttggtaactaaacaggtccttaacaatattttcatgacaactaatagtataccatgctttcccgagaccaacacgtccatcttcgttaaatatataaatgtgcatttattgattttaccataacgttacattattaaccatgattatgttgatttcgtaaaatgtatagtaaagctcattacttatgtcgaagcaaattttatttatagaaaattcactatgcatgttgtcatgtcaaatttactattcattaacacccctccaaattcaaaaacgggtgtaaattgactccttaagtggtttataaaacggtttcttctgaagaggtagggtgacttagtccaaatgtgctgacgtggcagcacagtcatgaaaggaattgaaaataaagcgggtcccatatgtgagtgaaaaggataaaaataaaaaaaggtgggccccatttgtcagcccaatatctcctatcttcctctcccttctctctcgccgaaa

SEQ ID NO: 10277 - DNA, 1501 bp, Oryza sativa
catccctctctagcctctctctctccctcttgggctgcagccatctcggcccaattcatcatcctatccctcggactgaagtccgtttacctcctcccgctggccacctcctttctcttgggccgtatagccccgaggcccatctcagatccccgcgggtcgtgtcccttagccaagccgtcgcccgttcttctgccggtcaaaccctaccgccaccgacacgccgatctacctacccggacgtttaccatccgaataaaatgccaaaattggttcctctcctcctcttcatgaattcccccatgtttttccctcttgattcagcctttaatcgtcaaatttaatctccggtgaaccaccgccattgatggccgacgccccaccggcgtcgttctcctatcccggcaccgttccactccccaatctgctataaaaggaaccctggaccctcctcatcctccgtgcttcctcgggacaaggtctctcgcccccacgctgcccctccccccccccatgcctcctcctctctcctctgggccggcgaactccggccaaccctccccgtcgacgggagcagcaccgaaccacacgccaccaccttcctcggcatcgaagagacctccttatccccggcctcatctgcgtttcacccaaagggcgccggaagtgcatcctcattggcaaccaatggcgccgccgccgtcgtcctcctccagccggccctgaccgtcaaatcaagtgtctctggagctcgccgctacctccaccggcttcgcagccgcctcctcttccccagcctcaccttcgtttctcctggagaccgctggaaactcgtcctcgccggtgaacagtgaatacgtcatcgtcttcttcctccagtggcccctccctcctcagtggagcaccgcctcactgcgccgtcacggctatcggctgcacctcatcatcctcaactacgcctagggttggcaacgagacggatggcgggggagggggcggcgttggacaagaacggtcccgcccccactctcttgcgtgttcacccggccccggcccggattggagaatgggacgaaattagtcaccatccccggcccctccggggccccgccatccgaccaggttcccgcacacccggtgctagcgacagtcgaaaggagagtagaacaaagtgggaacctgtagccagaaggagagcaagtgaaagacgcgaggagccaacggccggcaggatgggggaaacagcatggagcatcgcatcagagaacctatagctgagagtggtggcaaggggcagagtagtcggtgctagctgcgggcggccgcctcctgggtgagcgtcgcaacatgcgtccgtagcagcaacgccaaatgatttttcttctctctgcttttttctttacgcgagcctcacacgattgcgttgtgcccccgccgccagaaatgtttcgtcgtattgtggggatggcaccgcaccatatgggttagggtttgcttcttt

SEQ ID NO: 10278 - DNA, 1501 bp, Oryza sativa
acatatcaatgcttcttgatttaaatcaattccacacattgaaggtcaaatcattttcagcaatttttttctatgtttccttcaatgagtggtgttctacctaccttttactctatgttttttcctctcaaaatttatcctgttgcctcacatattcatgtgtttacaagggattgagctagccagtattacatagatactagaaaatgagcgctccttgtggtgcaccaaaaaatttatagcccgtgaatattgtttaattgctctaaaatatataaatgtattatgttttgtttttttaacatttttcttaaaaaaatatcctacattcaacaaaacccttaaattgatttttaattctgtttttgaatggtttggcacaaatcaaataggatagtactatagtatatgtggcatttttttaaaccagcacttttaaaataaataggtgccgatttcaattaaactggtaactatgaaccgtcaccaataagagattttgtagtagtatatgttgattggtggacaatctaattttaataattgacatttatatagcctcagaaaacatccttccagcaatatgattattataaaaaaaattataaaatgtgatttccaaaaagacagcatataactttagtaaaaggaaagtttgtgtgtaagcatttagaattcatggtaaaatatatgttaacaaccttcctattttatgcgtaaaatattaggtttatcaatgtacttattctttgaggtggtaaagtataaaaaaaaataaggcagcttaaatatagcaaatagtcaaataaatctggaaatatgtatctagcactgatgacaaggctttcgaattagcgggatttatggaatctgccagtttacatgaaattcagaaaaatctcttctaggcacagtagtgtgcagttttaattaaaataaaatttagaacatttcaacttggaagatatgtttgtcactaaaaaaaatttgagactggtttctgtgccaagaaaatatggaggtgtagtttggcacaatgattagttgtggtggaacctgttggaataaatgggctaggcccaatttaattcaattaaaatttcaagagcccacaagtaatgttagagataataatactgccttgaaaatttaggtggaagaacctcaacttaaacatggtgatattggagattttccgttgaccggttgaggtgatggttggacagccacacgcacgtgcgcgcgctgagtcggcctcggccgtgggtgtgccgatgcaaagtggccaatcgagccgagcctgcctgctgctcttccgttttgtaacagatgagaataaagttgccattaataaaggaaattcattgtgttgtaacctccacaacaaatgagagattcattgtgttgtaacctccacaacaaatgagagattcactgtgttgtaaccttcacaacaaataatatttattttgtggttgtcgacgagggatacccttggacc

SEQ ID NO: 10279 - DNA, 438 bp, Oryza sativa
agctccgtccgagatggaagggggaagccgtgccgagctccgtccgcccacacgcctccgagagggagggggaagccgcgccgagctcctcatccccacccctccccccccccggtcgccgccaccacgtcacgcgccgccgctccgtgtcctccaccgccgctgacccgtgagacggtgagagagagaggaagattgacagagagaagtgagagagagaacagagagtagtgtatgacatgtgggtcccacaattttttataaatagaatgctgactagactgccacgtgtacgccacgtaaaccaaaaccaccgcagattgggttgaggggggtaattcgtccggtattcatagttcggggtgaagaatgcccggttttgtggttcccgggggggtgggtaattcggacgaccgcgatagttcgggggggtaactc

SEQ ID NO: 10280 - DNA, 1501 bp, Oryza sativa
aatcaaaataattttataaactgggattcaatatgctcaagggtgacgtgacttgccttgctcgctttcccaaacgccggcttcaacttccacgaagagcggatcttccgaagctgcagcgtctacacggccaacggaaaagaaaaggcttttactctaataaactccaaacaacaagcaggaacaaagcacaaaaatgggttctttacttcttaaggaaaaattagagacttgaacggtccaattccgagttcaaatggccaagatatggccatttgaagtttatatgctctttaaatggatatttgcgaatttcttcatttaaattttaattaaaaatcccatttattgcgtcagccgagggaggggacgcgcggaccgggtccacgggggtgggggcccacgcgtcagccgctcggtccacggtggaccgggcgcacccggctggcggcggtcggcgccgtgggtcccgcgcgtcagccgcacccgcgggcgcgggcggctgacggccgggcccacctggcagccgcgagggcgcgcccgcgccccgatggtcaccgccggcgaccatcggcgcggtggagcggcgcccgagagagcggagagaagggggaaagcgaacggcggtcttcggctcaccccgggacaacgacgacgacaagaacggcggccggagcggaggaaagcggcggcgcggttcggaatgacgatgacgacggtgctccggcggtcggcgggcgaagcggagcggcggacggggtcggcaaccactcggcgaagccgatggaggtggcgccgagtcgggcggaggaccggagcgacgtcggcggcgaaccgaaggtcggcggcgacggcggagagagaggagcacggcgcgggcacgaaaccgacggcgagagcgatcggcgagcggcggaaacggaagagcgaagcacggggatcgaatatatagcaacgggagggggagagcgcggccggggagagaggaaaccgcgcgcggagatctcgggcgccattgaagacgccggcgaacttcgcgggatgaatccggacgaatccgagggagagagagagggaaaagagggggaatcgggagagggaaacgcggggagtaattcccctctctttaatgcgcgcggggacggcgggatgcggcgcaatccgcggcggcggcggcgctagggcacgggcgtggcggcgggcgcggcgggaggaaggcgatgacaggtgggccccacccgtcagcgagagcggcgggcgggcccgcctgtcagcggcgcgcgcacgggggaggagccgatgggccggggggaaagagagagagagagggagggaatgggccgagccggcccaagaagggaggaggagggggaaaagacttcttttaggattttctttttataaaccttttcaactttgtttatttcttttcaattattatttgtgctctgaaaattccactaaaatttgagggctccttttagaccaaggagaatttaac

SEQ ID NO: 10281 - DNA, 1501 bp, Oryza sativa
ctcggcggcgacggcggagagagagagcgacggcgcgggctcgattccgacggggagagagagcggcgagtggcggaaacggtggagggaggcacggggagtgtttatatagggttgggagtgagagagggcggccggaggagaaggaaaccggcgcggcgctctcgggctccatcaatggcgccggcgagatttgcgggagcaaatccgcccgtttgaacgcgagagagagagagggaaaaatggggggaaagggagagggaatcacggggagtgatttccccctctttattgcgcgcggggacggcgggaggcggcgggattcgcggcggcggcggcgctagggcacgggcgaggcggcgggagcggcgcgaggtaggggatgacgggtgggccccacccgtcaacgagggtggcgggcgggcccgcccgtcagcggcgcgcgcgcgggggaaggccggatgggccgcgggggagaggagagagagggagggagctgggcctagccggcccacagggggaggggggggaaaaaaggacttttagggtttttctttttataaaaccattttaactttgtttatttcttcttaattattatttgtgctctgaaaattccactaaaatttatttacgcattttaggcttttaggaaatatacaaaaatcctccaagccttattcgacttttaacttcgcacattttaattgttggaggctttcacaaggattttacttcttctaagcataattttgaggatgtgttttagagtcgttttgggacgcgacaaacctacccccgttaaacggaatctcgaccccgagattcggaagaactggcgaagagatcgggatgggctgccttcagctcgtcttcacgctcccaggtagcttcttcctcggcgtggttgctccactggaccttgcaaaaacggattacccggttcctggtcctgcgttccatggtgtccaggattttcactggcttctccacgtaggtcaagtcttcgcgaacttcaatttgctctgagtcggcctgctcggatggcactcgaaggcatttcttgagttgcaacacatggaacacatcatgcacgttgcccaaggaggcgggcagctccaactggtaagcaacttctccgcgtcgagcaatgatacggaaaggacccacataccgaggtgcgagcttcccctttgtctgaaacctgtgtacaccgcgcaagggcgtgacccgaagatacacaaagtcatccactgcgaattccaggtcacggcgtcggttatctgcataacttttctgccgggactgtgccacctttagattatcccgaatggttctgaccttcgcttcagcttctctcaggatatcagtcccgaacacttggctttccccaacttgatcccacaatagcggtgtccggcatttgcgtccatacaacgcttcatagggtgccatttgtatgctggcttgatagctgttattgtaggagaactcggcatag

SEQ ID NO: 10282 - DNA, 1501 bp, Oryza sativa
gccaccccttactgccgagttccttatgacagcctgtcacgaccatacaaccggggctaaatacggaggaataccctccccagggaattaacttaggattatatacaagcgcggaggaatacctgtactgagctgtcaccattagcggcccacctctcatccgcaacatataaccccaaataatgatatcccgtaatctagacaccacgtctaaactaccagatactactctaatatcatcatcatgacatagagtaattgcttaagcaaacattatacccacaccacagcttctcccagataagctagctgtatattcagtataacatgaacataatgtaaagtaggtactcatatactcggaaagtatttcaataccataaatgtatatagaatagtattctaataaaagtacagagcttacaaaagaggaaaggaaagctactagagccatacccgaactcttccgaaggcttcaggactcctgatttctactctattcctattccaccagctagatactactaaactaaacttgagagaaatgagagagctcttgcttgaggtatgtgtgtgaagtgagaagaggagctccttttatagctaaactacgacgattgtgacggttggaatggtcggtaataccctccaactgtcattggggcttcatctcaaccgtccagccaaaacctggatccaacggaggagagggaggttcggccgaaccagggcccgccccaactagcccacctttcggctggcggcctcctctatttctcctttatgcaactagcccacctttcggctggcggcctcctctatttctcctttatgtagatttgtgaattttggcccagtttgacgtgtcaattctgagttcttggcccattcatgcataagtttgattgtcgacatcgtccgatggacttatcttctatgttgatgtcgattctcctccactttattgtcattctctgcaaaatgttagtagacctaattctagtagaatattattattctgacatatttatgcattgcaagcatcactagttctcctctattttggtaatattgacggtcgaaactgatcgataacgactgtcaacacctgtaccggtggcgcggtgggaagtcggaggtgggcatgatctgggagggcggtgtagaaccagtcgttcttccggtcgtcccactttttgcgcagcatgcagttgatgtagcggtgcagcgtgtgggcgtgtggctggaagaagctgccgcaaacctccatcgctggggacaccagctacaaggtgaagaaccagcggaagaggcccaatgaacatctcgcacagatgtgcgaagatggccagtatcatcatggtgttgggggtgtggtgcgccatctggataccatagaaatccaggacgtcgtagaaggaggagaagggcaggatcagccccgccatggcgaatgagaggaagaagactgactttccggggtagcacagagccgggcgcg

SEQ ID NO: 10283 - DNA, 1501 bp, Oryza sativa
ggatggttacggaaaaaaatttggtgcataccggatgcaaacctcaatccgtgcgtacccgagtcagatgtgcgacgcgtggatgaggcgtgcatccgacggccggcacgcacggctggagccgcagcatgataagggtcagctcagctcgctcgtatcggctccaacaaccagaacgaagcggagtcaacgagctggacggctcgcctttcctccggccgcaactccgctttccccttcccgctgccgccgcgatctccctccctatctcgactccatcggatcgtaattgcctctcctcgacgtcgccggctcgctctttcactatctcctccgttatctatcgatgcggccacctctccgtatgccgccgctgcctcatcccctgtgttctcgtcctgaccacgggcgttgtaggtgacggcagtggcggcaaggtcatgttcagtgcaaagcatttgctgctcatgtagatgattccaccaatgaaaacaatgctcattctcttgcaggttcttatcctggattcggcaatcagtaagatggctgatcattctaaaaaaataatagctgatcattctcaaaccatgaatttggtagctatgtatgaaatgtgaaaacatctatattgtttcagaaaatttctagacatgacatcacattccagattgaacatcaagactttagattacacaatattgcatattttctttttgaaaggaatcagataaacaaccacaatttttttatcacatcaatccactgcagatttcatagcatccaacacgtcatacttatttcagataaaaaaaaaactgcattgtacagatatttgcaatttgaaccaaaaaaatgggtttcaaatttatagcatctggactacaatccttgcaaactcttaaccatgtacaggctatacatagtacatattacaaagaaagactacatacatcaggcaaaactaactacttccacacacatcagctcccagaataaattccttcagaaagcagcatgtcttcactctattgttctgtctttggttgttctatggtatttcttaagcggcctcttgttcattttagtctttctaatcttgaatcaccagcaatgctgcaccccacatatctcacctgcaaagatggtgtatgtaaaaatgtaatgagcaatttacttgggaaccaactcccatgaccggaagaatcaacctgtatgactaaagaatatacaatcaattttttagggcacgcaaactctaagaatcaggatggtgcaatcgatttgagggcatgcttgcatcaattgactgtatatggaaaaaaattgagtgtatatgaacaagcagtacatcaatggcataccacctatcaggcaggaagaatcatactacatctgaagctatttgttattcctgaaacaattgaatataaatgatactgggatgtcaagcagccaccttcacgaggaatgacagcagcggcctcctgcacgaggaggaaga

SEQ ID NO: 10284 - DNA, 1157 bp, Oryza sativa
ccttcctccacgcgcgggacggtgctacctacctgcccgccggccgcttctctccgtcgaaccgcaccaccgctttacgaacgcctccagccggatagcccacggcgatgccatcttcctcctcgtgcaggaggccgctgctgtcattcctcgtgaaggtggctgcttgacatcccagtatcatttatattcaattgtttcaggaataacaaatagcttcagatgtagtatgattcttcctgcctgataggtggtatgccattgatgtactgcttgttcatatacactcaatttttttccatatacagtcaattgatgcaagcatgccctcaaatcgattgcaccatcctgattcttagagtttgcgtgccctaaaaaattgattgtatattctttagtcatacaggttgattcttccggtcatgggagttggttcccaagtaaattgctcattacatttttacatacaccatctttgcaggtgagatatgtggggtgcagcattgctggtgattcaagattagaaagactaaaatgaacaagaggccgcttaagaaataccatagaacaaccaaagacagaacaatagagtgaagacatgctgctttctgaaggaatttattctgggagctgatgtgtgtggaagtagttagttttgcctgatgtatgtagtctttctttgtaatatgtactatgtatagcctgtacatggttaagagtttgcaaggattgtagtccagatgctataaatttgaaacccatttttttggttcaaattgcaaatatctgtacaatgcagttttttttttatctgaaataagtatgacgtgttggatgctatgaaatctgcagtggattgatgtgataaaaaaattgtggttgtttatctgattcctttcaaaaagaaaatatgcaatattgtgtaatctaaagtcttgatgttcaatctggaatgtgatgtcatgtctagaaattttctgaaacaatatagatgttttcacatttcatacatagctaccaaattcatggtttgagaatgatcagctattatttttttagaatgatcagccatcttactgattgccgaatccaggataagaacctgcaagagaatgagcattgttttcattggtggaatcatctacatgagcagcaaa

SEQ ID NO: 10285 - DNA, 1501 bp, Oryza sativa
gtagtctatgatatggagtttatagtataaacagatgtctaaaaacttgaatattttctgatggaaaatatagcaccatcaatatgaatatttcttgatgaaaatttgagtagtatttataaagttcaaagcctaaaataatgaactatacatgggccattctcatcacaattgggctgggctctgggcctgctcggcccaccattcagtgactcggtgaacgttggtgtgaagcatagaaggcgtgaacgtgcacgtgccccgcgccgccgagaggaaacacgacaactcaaaccaatcctgtccgtccattcatcccgtagacaatctgacccgtccatccagatctgcgacgccgaataaatagccctcctcctcccacatcccgagctccgcccttctgacagccgccgcatccgcgccgcccccgacctaggatttcgccgccattctcctccaaggttcgagatcctcctccccgagctccggatttttttttctcaatttttctctcgctgttgttcgattccgttcctgcacgcgcgcgcgcgcgcgctcgccgtaggttcgtttgtttcatcgattatagcaacctagtgtggggaaggaagggataggagcgaaatcggaatcgaacatgtcagatttggaggccatcgaccatggctgccccatcgatcgccggcgcgggtttgtagagcttcgcgtcgcctgtgtgccgctcgcagagaggatttggtcatgttgcatctgattggatttacttttcgccgagggcaacaagtaacaagctctagataatttttgacctgaaatcagaaagctcaagtaaaaagggtaaagctgtgaagcctcttaaacccatatgtttaaacccccacccttgtgcttaaacccctcttatgtataggtttatgtgagtattaatgatagcatagactgttggtgacgcgctgctttctttgtaagtggacattgatgattctatcatatagtgcaagcgccccagtttttagtctctgctatgtgttaattagttcatgcaacctaagatgctacaattgctcatattgtgattctttgtagttacattgaattgtttgcaggcacgtcaagtagatttatttcatgttagtcctaagattacaggttcttataggggatgctatggctagacttgccttaactgattctttgtgaactttaatggctgcatctatgcctgttgatcttgtgtatgctgctctgggcggcaaggcctatctaatcatgccatagctcatcctctaatgtgattacttgctaggccccctaaatatgagtctattctgtagtgaaatggatgttgtaattatcaaaaacttctattccgttagtttttcctgcataaaaaagcatccactaactgtagatcttcatttgtaccagtattcatcctccttccaatcattcattagattttgaatagtactgatgtatttttgctgttgtcttcaggaga

SEQ ID NO: 10286 - DNA, 1501 bp, Oryza sativa
cctataagaacctgtaatcttaggactaacatgaaataaatctacttgacgtgcctgcaaacaattcaatgtaactacaaagaatcacaatatgagcaattgtagcatcttaggttgcatgaactaattaacacatagcagagactaaaaactggggcgcttgcactatatgatagaatcatcaatgtccacttacaaagaaagcagcgcgtcaccaacagtctatgctatcattaatactcacataaacctatacataagaggggtttaagcacaagggtgggggtttaaacatatgggtttaagaggcttcacagctttaccctttttacttgagctttctgatttcaggtcaaaaattatctagagcttgttacttgttgccctcggcgaaaagtaaatccaatcagatgcaacatgaccaaatcctctctgcgagcggcacacaggcgacgcgaagctctacaaacccgcgccggcgatcgatggggcagccatggtcgatggcctccaaatctgacatgttcgattccgatttcgctcctatcccttccttccccacactaggttgctataatcgatgaaacaaacgaacctacggcgagcgcgcgcgcgcgcgcgtgcaggaacggaatcgaacaacagcgagagaaaaattgagaaaaaaaaatccggagctcggggaggaggatctcgaaccttggaggagaatggcggcgaaatcctaggtcgggggcggcgcggatgcggcggctgtcagaagggcggagctcgggatgtgggaggaggagggctatttattcggcgtcgcagatctggatggacgggtcagattgtctacgggatgaatggacggacaggattggtttgagttgtcgtgtttcctctcggcggcgcggggcacgtgcacgttcacgccttctatgcttcacaccaacgttcaccgagtcactgaatggtgggccgagcaggcccagagcccagcccaattgtgatgagaatggcccatgtatagttcattattttaggctttgaactttataaatactactcaaattttcatcaagaaatattcatattgatggtgctatattttccatcagaaaatattcaagtttttagacatctgtttatactataaactccatatcatagactacaaattttttatatacttacgatgcaaattccaaattgtacgctacaaatttaaaatctcacactataatttccgtaattctccgtatatagaacagttgtaagaaaagcaattgattgcgcacttgatccataccttacattcttgattacacattgctgactttatcgtgatgagtaaattaaatttgcacagtcgattgtttagcctgacacgagtcttcaagtctgaacccaaatcgagccaaccaaacacgctcctatataaaggccgcgaccaacacgcaccgcaccgcaaactaacaccgcggtgtgatccattctgcaagtgatccgttctgca

SEQ ID NO: 10287 - DNA, 1501 bp, Oryza sativa
cagattcttaacaagctcctcggtttcacggtttttactctcctcgctctctgcagtcgaatcaagcagtcctttcaagcggacaacttcactggagaggatctccaccttctccgcattgacctcagcgatcttcatggcatcgtctgcgtggccaagtgcagctttcttggcctcattcgccatcgcaagctcacgcctgaatctctccagctcctccgtcgtagtgaccaacgtctccaaatcggcggcgtgctggccacgcacgcactcgatctccctctgccactcctcctcccgcttctgcgcctcatcgatgcccgcctgctcgagctcatccgcccggaacttctcgatctccgttgcctcctcggcccacctcttcgccatgagcgcatcctggagcttctcatgcgtctcatcagcaaccctcttcgcctcattcagctccccgacaaggcgatccctctcgccaacggcgaaggccagctgatccttggccttcttgagatcctcctgcgcggactcgagccgcgcctgcagctccgcctccttcctcggctgcttctgcattccaccaaatttcacacaatcaccatcaacaactcacacaacaaaaatttcacacaatcaccatcaacaactcacacaacaaaaatttcactcaattagcatcaacaactcacacaacaaaaaattcacacaattagcatcaacaactcacacaacaatgcttgcatatatgaatgcacttacatcaggtggagtgccgatcttgggaacccggcgctcgacgacgggcttggagtcgacggatctcggcgagcggtcgaaggagaggcgggggcgggcggtggccgacggcggcgagttgggctcggacttgaacgggccgccgccgccgccgccgacgccgttgttgcgggagcgcggcgtggacggcgtgccgccgatgctcctcctggtggcgccgggagtggaggggcggtggatggaggacggcgtggatggccggtggttggacgacggcgtgctcggccgccccctgctgatgggggactcgttcggcccagatctgtcaatgtcaccgccattaattgcgattcacggaaagctccaatccaaatcaacgaggttcgagcaagccgcattttcatcccgcgatcgatgggataaaaaacagaaacttcagcaagaacaagaggaatcgagcggatcaagaagccgttccaactgaaacctatccaattcgttcaagatgccacattttccagattccgagagcgagcacaatccagtactcaattggaacgaacagcgcgagggaaaaaaaataaaaacaaatctgagtgaacgcagtgaccggtttagatctgccaagaacacaaggcaacaaaaaacaaatcccccaaccaaacaaaccaacatcaaccaatccatacacacacaaagagagaactaccaagaacacacctggatttggagggcagcattgtggaca

SEQ ID NO: 10288 - DNA, 1501 bp, Oryza sativa
gcactcgtgtgtacatagtattcgacgacatcaaaatttttatctttgatagattaagtcatgcacccacgactgcactataataccagcggtgctttctctcatttttttcaaatccaccatgatgaaaaccttacatttctaactctattttttatggtatttaccggattgtgagagcgtacataatggctttctttagcttgtgtcaattgtattataatatagatttattctacctccgtcccaagaaaattgcatttctagctctaaggctttgtcccataaaaattgtatttctagccatgtgggtcctaacaaattgattcatctagataagtttccttaagttctctcagcttgtaattaaagtatgctaattatatgggttaattctctcaaacttccttttaatcatttatatatatggaatgtgtgtatgcaatgggttcattaaataaggtcattggggtcatttttcaatcctattgttttgtcctaaattagctagaaatgtaatttttatgggatggagggagtaaattctctactatacacaaaccccagtatttatatagatatggttgatcaaccttacctcacttagccaaatgcctccaaagatcagtccaaatggtttcccaccatcttaattaaagaaaaagaagaagagttgagagtccaaacagtgccactactcactagtactactactgcttgtttctacttaccaccacagttccataataatcaatttaatcatgcatacaatggtttggtgggcaatgctaattgctatggcatcgggatgcaatcaccatcagtaggtgaagggagttgatccatgattagcactcaccagctagcttagctaatcgctcgccgctgccgctgccgctgctggtggtggccgtgacggtggcgctggtggtggtggtagcatcatccatcatctttgtctttggcatgtgcctccttttgcctttggctccctcctctccttccttccttcccttgtttgccttttgcctttgcagcctttttcgcaagggagcccacgcctccctctcgcttcttctcctcctcctccttctttgaagagcgaagagtgaagtgtgaagagttctctcttcttcttcttcctcagccatgtccacaatgctgccctccaaatccaggtgtgttcttggtagttctctctttgtgtgtgtatggattggttgatgttggtttgtttggttgggggatttgttttttgttgccttgtgttcttggcagatctaaaccggtcactgcgttcactcagatttgtttttattttttttccctcgcgctgttcgttccaattgagtactggattgtgctcgctctcggaatctggaaaatgtggcatcttgaacgaattggataggtttcagttggaacggcttcttgatccgctcgattcctcttgttcttgctgaagtttctgttttttatcccatcgatcgcgggatgaaaa

SEQ ID NO: 10289 - DNA, 1501 bp, Oryza sativa
tgagatgagagaaataacaacagagaatgttgtagcttactctctgtttctgttttccaatatacttttacagggggagaagggatagatctcattactctgcttaaagatatgtacgcctgaatcattctgaataacagtgctacctgattattacctacctgaactttcagaaagtccctctatgtaatgtaacacttgacccctgcatatcacacacaatagaatcatcaatgaaacacaagcacacatgtacacaatgcaatagtgttcatgtccaccctataaatatattgacaaatgacagctgatctaagcacctggaaatgctgtcttgcacaacagaaattacttcattgattgatatccccagtctgaataaactaaaccagatcaaaatgctgataaatctagctcttattcctgctgtttttgagattcattttacttttagtccatgcatgaaaaaaaggcatgctacagagacctgttactttcagacttcagtgctggaaattacttaaaaggtgtaccagacttttgtctgtcctgatagctgctcatgcttaatgtttctttcctgcaattgtgcagtactactgctagctattgctcgctggcctaccattaattagtatactgtcctatcccctaactaagccaaataagcaaaggtttataagtagtgttcattgttaatagtcagcgtggttctcggtatacgcaccggcttatggtaattagtacttaaccacaagtgtcaatcatgtcaatccctgctcaattgttccataagcctaccatattttacagatcaatattactctgcaccatcacacagtgttgttgattgcacttgcatgaactgcacaaagttattacacacacaacattacaagctaatgcaaattccacgcaactacgtttaattaactgcacatgttgaataacaatcctgtcattcaatggatcaaaactagcatgacaatgacagtgctctgcttctataacctctcttgtttacttaagctcaaagattcagacagttcaggcagtttgcagaaggccacaaaatttgaccatggttaatcaatcaatcagttaattacacaattactcacatgtatgcatgggccgaccaggatggcattggcattggcatgcatccatgagcagcaatgcagcatcattggaggggatgcagccaccatcatgacaacacataattctcacagcctaaatcgcaacacctttccttgcaaccaaagccaaccttctagctagctagctaatctaagctatagtgtgttgttgtgaagtggagtactagctagctaccactctatcttcttcttcttctacctcctcctttatatcttgcccctcacatgcacgcatgcctctccatctccattgccgtcctagctagctagctaagctagtacactagctaggccatggcatggtggtgatcaagaaagcgagagaggtggagcggcaa

SEQ ID NO: 10290 - DNA, 1501 bp, Oryza sativa
aaccatgtcacgatcataaattgctcggtttttcgaccaagtctaaaaaaatgaaactaaaattttagttttttataagatttatctagatttcacccatttggatccaacgaaatgagaatatcgtgaggcggtttttctgtgtttcttcgtacacactaaaaatttatctattctgaatgtaaaacatgatagttattatagtatattaattaagtataagcttaaaaaaattaatatgatgtttttaagtaaatttttataaatttattttggaaaagtaatgtttaacagtttaaattaaggtcaacaaagagataggagcgaggtttacgttaccgctggtaaccgcgcggttaccgggcttaccgcggagtacagtaatataaatacgtggtaaccttcttagattcaaataaatttaaaaaataatttaaatgtttgataaattttacacggttttgtatgatttcacggttaccgtggtaatcgtgtctaccgctggggcgcggtagcctcggccccaggcggttttgggaaaccctggtaggagctgagaaggatgcgaaaccaacggtgctggctgctctgaacgctgttggttgctgctgccccgtggcgacgacacctcaccggaggcaacacaacgcaacgcatcgaaatcgaaccgcagcgatccagcgagcggttgagtgttgccgcatcaccgagtcaccgagacatttttccttttttctttttttgtaattgcagccgcctcgcgaagcttcgtgccaccttcctcccgtcgccactgcgtcaccttccctcttttcaactctctccctctcacacaccgcattgcagatttcatttgctgcaccgccctcccctcccctgcaaatactactagtagcacaagagccccgcatgccgttcacacctgcccaccaccaccactcgtagcccccaccgcaaccacccacacccacaccactctcgatccttcttccccgactccggccggcattggcggtggtggaggaggaggaggaggggaggactctgggctgtgtctctgtcttgcgcggcggcggcgcgagagggagagattggttgtgattttgggagtcccgacgtcgcacgcgcgcgcgtgtggagtggaggaagaagagatcgcgtctcttcgcccgaggatttctcgggatatttttatttgttagttagtatttataaagacgccgccgcggcgagggcgaggtccccgattcagtttggtttttcttctcgccgacgcgcagatcgatcgcgtcgtggactgggaattcttccccccgcattgttgtttgaggtgaggtggtggtggtggtgatcacgatgggcgaggccgggcaggacgcgccgccgccgccggagaagggcgtcgaggtggaggtgttcccggcgtgggcgcggggcgtggaggagtgcagcgcggctgggggtctcggcgtcgcggggcttgtcgtcgcggaggcggcgg

SEQ ID NO: 10291 - DNA, 1501 bp, Oryza sativa
caaaggacaattagttgtggaaaataaaaatctatgttgatcaaacaagacattgcgcacatacgtaaatcagctatgtgctctttattttgccacatagcacacatcgcaagttgaactaagccttatatagcatgctgacccaatcaattttatacactttttgagaaacataacacttaataaagtgtgaaaaccacactgacgtgccctagttcattggtttttgccctagagcattcgcatccagcttccggtttgctttagcacaaaattagcaaggagacacttcagtcttcagcaatagaccagtagcatttcacagcacaatccaaatagaacacagctggattagccattaccatcaatgaacccggagaactgggtgaggaaggtgttgatctggtccttgtacacgtatcccgccgccccgaacccccctacgactccaaccagcagcgccccggcgaggagcgtcccggtgatggcccccgcgccgccgtctcccttatcctccgccgcctcctcctcctcctcctcctcctggtcagcggcgggtcgccggtccttgctgctgccgccgccctgaccgccgccgccgaggcggaaggggacgttgggcgaggccttgcggagcgtggccttgtcggggtcacgcagcgacgagagcggcgggtggaacgcccgccggtggtggtggtgtcggccccgccgccacgccggcgagcccccgggcgccggcggcgagaagtgggaggagaggaccggggacggggagagctgctgcggcgagaggaggtgcggctgcctcatggggagcggcggcgccggcgccggcggctgcgtgggtggggcccgaggctggctgcttcagctagcgcgcggggcgtgcggccatgggagctcggaagcgataaggcgtggaggggaaggagcagcagaggagggagggaggaaagcggaggagaggagaggggagggggaggagacgaggcacgtggcggcgtgtggggcagtggtgcgcacggaggctggcaggtgggccccatcgcctggtatcttctagggtagcagcaaagcacctggcgcgattcctactgtgtggtttcaaaattcatcatcaaatttcctccacgtagttttgtacaattttaaatgatgctagtggtgatatcctagtatgcctccaacaacataaactgacatacacaaactgatatatgagattctcgcaacaagtgaatagccatagaattgttaattctagacatttataagacgttgcgtacaaaccttcaaattcacattccactcgtagataaattatagacgtttgatcttgtattatatgatcgtttggcttgtagaaatagacaaagaggataaaaaaaatatagcaacatattttagtactgtgtcttttaaaatgacattatgatcatgtttagggagcttaagattgtgagaatttactggttggtacttggtagctaatatgctg

SEQ ID NO: 10292 - DNA, 1501 bp, Oryza sativa
gaaaaacctcaatatttgcttcaaatttaaggttaaaaattcaaattttggctgataagcataagcataagcgaaaagatgaggccgttactctttttttaagaggaaatttgaatgaattttgaaaccatgccaagatataattaggcatatagggcagagattttagtagctacagtttcactgaatcttcgacttaaaccaaataattcatattgtcatctatattttaagagtctaaagttgtaaaatctaaaaactgaattaaagctgtaagcttaaaaaacccaagttcttcatactcttataaaaataacatctaatatgctagctatgaatgcatccaataatcctttttctcaccgctgaatgctgatctcgatcaagagcagtcatggcatgtaccctttcccctgtgggggattacttggctcccttaagttcacagtgccccgcgccggcggtcatcgagctgtcgccgtcctcgatgtgatgtggagtcgaaagtccattggagatttttggagcagcgaacggcggaggaagaaacgcggcggcggcgccgcgcgctctttagcagcgctgcgcaggtagcaaagtaccgtattagggcaatagcaatagcactctttagcagcgctgcgcaggtagcaaagtaccgtattagggcaatagcaatacgtcttgcattttgttagtcctgaactgccaagtaggatgaggaccttccaaggacacaagactcacggtgcgaaatcaaggcgggtggaaaggcgaggcgaagccctgcgcactgcaatggccttgatatcgtcgaaaaccgggtggcaggttttggtcacaggttcttcattttggtggacccatcaagaaacgtggcatggaatcttgagttttggcggacgtggagagctcaggctgaatgccagctccttgcattgtgaacggccttagcgacaagttttatcccacctcgacaaatttgatgttttgtgacctatacaaaagagtttccacctcatgatgcgttgcctcttcggagacaccttatatttataggtcacagcatattagctaccaagtaccaaccagtaaattctcacaatcttaagctccctaaacatgatcataatgtcattttaaaagacacagtactaaaatatgttgctatattttttttatcctctttgtctatttctacaagccaaacgatcatataatacaagatcaaacgtctataatttatctacgagtggaatgtgaatttgaaggtttgtacgcaacgtcttataaatgtctagaattaacaattctatggctattcacttgttgcgagaatctcatatatcagtttgtgtatgtcagtttatgttgttggaggcatactaggatatcaccactagcatcatttaaaattgtacaaaactacgtggaggaaatttgatgatgaattttgaaaccacacagtaggaatcgcgccaggtgctttgctgctacccta

SEQ ID NO: 10293 - DNA, 246 bp, Oryza sativa
aggagggggtggcgtccggcaacgcgagctgggtggagcccgaccccgacgacctcgtcttccccggccctgaccgcgcggcgctgtggtcggactcgtcggacgacggggagaggcgggaggaggccgaggccaccgagccgctgccggtggaggcggcagcggcggaggtggaggcgggcgagggcgcggtgacgaagggcggaggggctggggcgggggtggtgcggtggtggcacctgccga

SEQ ID NO: 10294 - DNA, 1501 bp, Oryza sativa
agttaattagcaagttatgtcgtgattcctagtacacggacaggtttcaacattctgcgtgcattgtcctttggatcaaataaatgctaattaagctggctactttagttacttgattaattagccccgtgtgtcgtttcttaacagcagctcatcgtttcagagttatctgtgggtatatgtatacattctatggaaaagatgctcataattttcacaagcatgagaatgtttctacggttgattttctacctaaatgaacctatcgaaattcttttgttgcagaaaaatatattaataattcaactaggactactatactactttatccgtcctaatatatagtcatttttaaggttggcacgtgtattgagaaagtaggagagaatgattgaaggaagtatgtgattggttgaaaagagaaaggagatgaagaataatgattgtaattggttgagaagaggaggtaggtgaagaaatagctttattttggaactaagttactgtgctagaaatagctacattagagcagataaaatagcagattataagtcagctataaacatattttaagaagataaaataggatagagaagaacagcgggctacagatttacaaccagctgcagcacagacttcaagatgcaatgtgtgtatgacaagtgggattaggtattaatattatagtaactattgtatgaattggctattaaattgactatagatgatttggagctagtaattggctatactgttaaacttgctctttgctcctgtaatatcaggctctgtttagttcccaaaaacttttcgcaaaaacatcacatcgaatctttggacatatgtatggagcattaaatatagataaaaagaaaaactaattgcacagtttgcatgtaaatcgcgagacgaatcttttgagtttaattagtccatgattagccataagtgttatagtaactcacatgtactaatgacggtttaattaggctcaaaagattcgtctcgcgattttcagacgagctatgaaattagttttttcattcatgtccaaaaatctcttcccacatccgatcaaacgtccaatgtgacaacccatcatttcaccgactaaacgagccctcgtatgcgctcaatttttgaatcctgacgctagcagagtagggccagaactagtgattctccgggcccaccagccagccacagccgagcacacaaacctcggtccgtacacggcggctcacgcgctgactcgacgcatgagcacaaaaaagcgatgtcgaggtggggatcccacctcctgagggaggaacacggtgggcccacccgtcagtcggcgcaggtccggtactacagcactgcgagactgccggtggggccctcgggtctcaggtggggagcagttgctgccgtcctgcagccgcatccgcccaccccgtgcacccggtctaccgtacgcctccccctacctgcagatgggccctacctgtcagtgaaagta

SEQ ID NO: 10295 - DNA, 1501 bp, Oryza sativa
caagtaactaaagtagccagcttaattagcatttatttgatccaaaggacaatgcacgcagaatgttgaaacctgtccgtgtactaggaatcacgacataacttgctaattaactacggtatcctgccctgtcccccattagttcatgtatgcatgcatccagacttacttaacatgcaatgccactaattaaagcagagttagactaatctgatgtgctgtacctcatcaccaaggcaattgaggcaagtaggcataaaactaatcatatggaatcatccagatcgccaatacaaaattacccccaaactgagatcatggagtgttcggttaaccgatgctttcatctctggagccaaacgctaatcaggctgcatataatatgcacttccttgtgccgagtgatcaagagacagcctgagtgaatgattaaactagctaatgcaaaagagctttgattgctttcatctttggaagcatcagttggtcatgaatttaaaattaagcctgtagcttgcagagagcagcttaatttagctgacacatattatatattgatccattgatcaggataacaaagtcatggtggttaaattaatttaagctgtttggatattatatatacgtggtagtggatatgatgatgcccccagtacttcatgcatacgtaaacacgttgcttctagatataatgcatgttaaatatgattctctctcttggtagctgatacaaacttttaccgtagttggttaacgtgtctttcttgacaagttaactacataaccatattgatcatgatgcatgactgacttaagcccctacacgctaattaaaggtttgctaactgaattgagtagtatatctttcttacagaataatatatatgaattaattgaacctgatagttatatatcgttcctccgtttcgaataacttttgttttagctttattttaagccaagcatttctatctttgacttccaacttctagattttttttaacatcgtatttatatattttaattcatcataataaatactttcaaaatatgtaactttcatgttgttaaactgtacaaactcttagaaattaatagttaaagataaatatgaaatgtttaatttaggacgaagctagaatgacaagtattaattttatttttcctagcttgtaaattaaatagtctctttagtttcatagtttgaagtgagttcattggattaaattaattactgtgatgggtacttggaatatatggtagatagaaaatgtgtggacattaccaaatgcgttatatatatgaccgaccggatttatatatcgcaatacagttctgggcgtttggagttcaattaaaccatgcatccattgtaaattttttagatactagtagtagctaaatgccagtgcgttacagcggagcatgaaaatagcaaaattaaggccttgttaaaaaaatattttaattgattgaaacacaacctttcatcttaacaaaa

SEQ ID NO: 10296 - DNA, 1501 bp, Oryza sativa
ggtgtagtgataagaaaaatcgagaaggattggtacaagttaacaacttaatcaatagattgtgcatatagcaaacaagtctatataataacacaaagagaaagaaagaagacccattttagttgatagtggtattattacccaaaaattaaaaatacgttcaatttagacctacttttataagcatcatgccagctacagctacagtcacagcctctttcatccctttttctttcttccaaaaaacgctcacctgtagtgatggatctatgtgaaagttgtgaggtcgaatgtcgaatgaccctacagcttcttcacattcattcttgagtactaaatttttcatggaaatccattcaaatctacacaaataatcccactgaaatatttaataataataatcgatctcacaaagtaactttatctaataatttattgactccgccactgaatttaagtgtagtgataaaaaatcgagaagaaggtttggtgcaaattaacaacttaaacatgaaattaaattgtacatgtagcaaacaacctttataataacacaaaaaaaaccattttagttgaaagtggtattgctaaaagagttaaaagtatttcaatttagagcaacatgccagctacggctacagtcacaacccctttatcctttttctttcttccaaaatacaaacgcttaccttacagtgatggttctatgtcaaagctgtggggtccgttgaccccatagtttcttaccatcatcgtttagagtttcttaaattttctatatttatccgttgaaatttacacaaataatcccactaaaatatatagtaatgataatcgatgtcacagagtaaatttgctggctctgccactactcacctgtaaccccccaactatgccaccaaacacacataactcatcgcctcatcatcgtcatctatctccgcatgagaccgcatccttatcccaccacgtccccctcgcgctcacgcgcacagcaacaaagaaaaaaaaaaaaacccgtcccttttccctcgccgccccaccgctcccccaccccacgtgtcgccggcccatcggcggcggcgcctgcgtgggccgtgtggcccaccctgcggccccttcccgaaaacggaacgccccccccctcctcccctctccacgtcactgcgcggtgggcccgcgcgtgcgtccaagaagcgtgacgtaagcagtgacagaatccgcgccgcctctcggggcgcccacgtgtcgcggtcaaacggtcagcgcggggcgggggctcgcatcgcatctgctccacgtgtgcgctatcgcggctgcggccgcacgggccacacgtgtcgcttgcccccggctctataaatgcccggctcctcacccggaacaagtttcaagccctcctctcctcttcccaacactagtaggataaagccacagagagagcagtagtagtagcgagctcgccggagaacggacgatcaccggagaagggggagagaga

SEQ ID NO: 10297 - DNA, 729 bp, Oryza sativa
ttggatggagtagtatttgcttttctttgcgccattttgtgctgttcttttggggcagatttgttgagaaacagcaagccctagggcctgcaacgagctgatggaaaggggaaattgaaacataagcagctgcagcaagctgcttgctagatcttgttgtgttgccatttctgcggttctctcctttgccctcttctagctatgcttcttgttcttggaacttgtggttcttttgggggggttgggggggggggttcttcaagtgctatatatggatgaggtgttcaaatggataatttgctcctgaaatttcttcttttgctctaaagtcttgtccatctttgatgaagttatgttaattatttccccttcttgaatctttgagttaaggttcttttcgtgttagatcgttcagaacttcagatcgatgctgatgaagattcaaatggtgaacttgagactgaagtttagcgattgaactaagtaataacgataagacatgaatttgtaaaaatccgtgattattcaagattttggttggaccaatatttcctctgaacaaaccaaaaacaatatatgttgtgctttcctagctagatagctaggaatttcttgctttattatatgctgataagtttatgcgcttttactccctttatcttgcttaattgcttctgccatgaattgctaagagggaggtgttgcatggttgtacatgtacatgtttaa

SEQ ID NO: 10298 - DNA, 1501 bp, Oryza sativa
tgaatctattctagctaggaatggagagagatcagaacatttgtggtgttagtttttttttattttggatttgtggtgctagctgaatatgcatgtctgcatacagcacccctctgtttgtgtctgtctacatatatatatacatgaccaatgtgcaaacgtacaaatattagagttcgttaattaccagctgcctgaatcttaatctccatccatatttgcatcaatgtcagttcaaaaattcagcagcagaccatagctatcatatcaaccatagaatgatagtaatcaataggtcatcaaatatacatcatgtatatatgcaggtcgttggatggcaatcatcagtatcattgaggaactaaacaaggctagcttgagctgcgactttttctgtagcgtctgaattcgtgcatcactctgttgtgtgtgtgttattcagaaaaagcttagccttgattagtgcatagtagaaacatcgtgtacgcatcttaatctgtgctatttatatgatcgacagcttttacgactttacagttcagtttgggatgtccatatataataagtgaagaaagttacttcgttgattaagttcagtttgagatggttatgaagaacttgcccccgcacaccgttgtatatatagacagacaccttcaaatttaattgattgaatcggaacctataaaaaattggccagacaaacaactagcacccttgtggacatgcagatatctgcaccctgattcctctaattaaggactaaaaatgcttctgcagttctatgtactactactactttcacatttttgttcaggggctggctgaaaagcatatcctggattgccttttttttttccagtggaaagtttagcaaataaagtaatttatcagtagtcagttcaattttaatcaaattaaggagtccacccatttttttttcagtggaaagtttagcaaacaacgtattttctcaatagtcagtacaattttaatctctactattataaaaattgaagatgtttttgtcggtactttcatacgtcatctatgtatgagtcggtttttaagtttgtttgattttagaaatacaaatacgtatttgaatcgggttttaagtttgtttgcttttgaaaatacggaaggaaccgtataagatatattttttaaaaaactcatatactaacttgagatgatcggactcctaactacagctcatgattttctagaaaaatatatatacaatcaaattcccacaatgaatttcactttaactaaacagcataacaataataagattaaaataaccttctagtcaaattaaaattaaggtgttcacagcctacactagtcatggctccgtgtgttgcaatgagactgaattggatgaacacggctcaatttttttgttcctttttttggtacaccaatttctttgaagcggtttttttatacttggcattgagatgggaagaaaagaaggacgcctgtgcttttaaga

SEQ ID NO: 10299 - DNA, 1501 bp, Oryza sativa
gtcccgaatccgattgtgaatctgcgtcgtgagtcgtgacggactcggagatcaaattgtgcgtgtttctttcgaaaacgctaataaagtggcgacagtttttccctttaaaatatgtcggtttgatgtgttgcaagtgacgtccttgtgagttgggtcgccagcccaaccataggtccatagacccgtcagatgggccgtctatcatctgagttatttgtttcgtttttttctcctggtccctgcagcgtccttgttttcttttccttttacactaaaataaaacttgctaatattccgtacatgtcaatgcgtttctacatattctgaagcagataaatcgtgatctttttcgatggatggtgctcttggcaatatttacattaatattataatggttaaattagcatgcatatatatgagtatactagtatattgcccgtgcattgcaatggaattctaattttaaaaaatcacattgtcaccaatctatttttgccatcactttctacatatacgtaacaattttatcaatatgataccaataatatataggactactaatattaaaacaaaatgagcacttagtggaataagtacgatagaactggtaagatgcctaaattcatgaccggcgccgatatgttttcttcttttatcattgtttaactttaagccacccaactcttctttaacacatcaatagccttgagcacatcgacttctacacgccaaagaactcccctacctatgcatgtaagaaagtttagaatgatccaaaatataacaatggtaaaattatcattgccaaagtgaaattataagataaggatagtccaaaaggaaattttagtaataaaaaatggtaactgctttattttgacagtcctgctttaacatttggctggtatactgttacgtgacacgttatttgagctcatttcattgctaccctgctcaaaacaacaccacagaaaggaagtggacgacacttagcctgagttctttgggtcactttcccaactcaccaatctaactatcttgtttttttcgcatgttttcaaactactaaatgatatctttttttgcaaaaaaaaatatatacaaaagttgttttttaaaaaaaacatattaatatattttcagagaaaattaggtaatacttgattaatcattccataatgagttaccaaagaacatagccttatatatgattggtcttgaactcttgctatacatgattggtctgttgcaaaattcacaatattgacacatatataccttccatgaattaatctacaggagaagcagagctcaaacaaaatttccaggcctcgaagacgatgtctagccaaacgagagggtccaaattaacagccgaccaataaccggtcgaccagtcgagagctgccgaccacaactccccaaatagtccaatgcccgtttttaaccgtcaaactaccagtgatatattcccagcaaaaaaaaaaactaccagtga

SEQ ID NO: 10300 - DNA, 1501 bp, Oryza sativa
tgtgcaccacgtcggtgccacgtgtgcgccacgtggtgcgccggttttccccggtccgtggactcggtccgccgtggaccgccctcccgagtcactgtcaggtggggcccgcatgtcggcgccgccctctctctcgtcgggatttaattattgcgcaataattcaattaaggatttttctgtttatagtaaaaacacagtgaatcttctaaaatttataactaattcatccgagctccgtttaagcccattcaagtctcagtaaatcaagaaaaatgcgtagaatccattaaaaatggttttgttccctgtttcagtagtcttatagcctgtttgcattgtttgccttgtatgtcgttagattccggcttttccgacgctccggtgtacttcgagatagtcgccgaggttcctccagcagcaaagcaaggcaagtcatgcttgtcacttgaccatgttaatcctatattgcaaatgtcctaatgtttttctttcaaatactgcatttgttttgcaataatactatgggatgattacctattgttacaaccatgctattttgataccatgctcctttgttagctggggttataacatgaatagtttttggactaggaattgcttagccatgcttagttcaactagcacacaatggggaaatctcatttaaaacatagactgtaggtttgtatgataatgttggattagtaccaccgctctggtgttggttaattaaaatgaatcacatggcgggctgtgggtgcatggttttgctagtcgcacccatggcaattaaggaccggttcgcaggaaaccctggaagaattcctcgtacttaccacaagccagcgtgggcaacggctgggcttgtagtgtagctttcctctagctgacgcatccaggcaagggtgggcatgatggagcgggacgggccctgcgacggcctctgtcgctttcggatccacctaggcacgagaggggactgcccgtcgcccgctggggacgggggtgaaacctgaggtgtggtgtgcttggctagagggggttatgcgaagggtcctgtcacggcctctttccggtatgtcatggtggcatgtcagcacacggaaacgtgtcgtggggctatgtcttgtgggtacagttgtacacctcttatcatagtaaaactattcgaataaccgtgcccgcggttatgggcggtcaaccagactcaccgtgattagactcatcttagtttagtctaatgaaattggatggtataggtggatggttgggcctgttgcaacgtggtggaacgttggacagtggatgattaatactgcttaattattacaactattttcgcatacgacttctgtttataaatgccagtattgtgcaaatgaacctgtttagctctcccttgttaaatccctgcatcataccactattccggtatgacctgctgagtacagtggatagtactcagtcttgctctatttttcccccaaccccagagtatg

SEQ ID NO: 10301 - DNA, 1501 bp, Oryza sativa
cctccccgagcagtgacgacgaccggagcgacggcggcgcacggctggagcggtggcgacggcggcggcgcgaagcggcacggcgctagagctctaccggcgacgagagactaaggcgagggtggcagcgggtagaggggagctcgggggtcaatttataggggctagggagcggcggcgaaggcccacggcgaccggcgacgggaaggaaagtttagggttcggaggagagagatcgatccgaattgaactcaaatccggcgatttccaaagcgatttagacgatgtttccaaaagggaaaaggtagagtggatcacggggatcctttcccctcaatcaattcgaccggagacagaaaggggcggccggatttggaatggcggcggcggcgcagctcggctagggtttcgactagaggaagacgacgactgacgggtgggacccacatgtcagcggcggtcgcacgcgcgcgagcgggcgggcgctcggcttgggccgacttgggccgagcgagagagagagatctttgggcccaaagccaaaagagaattttaaaaacctttttccatttaaattattcattaaatgcaattccatttattaaaaatacttccttagctcaaataaatcccagaaaaatctaggaattatagaattaagcaaagtatttaatgaaattttatctggccccattttatattggaatttattaattaaaattagatcttatcttctaggcttttacaataaattctaataattccaattaaacaacaatttatatttttgggatttttagggtatgacaatgacattgaaaaaaactcgatgttccatgaaataggattttctactatttaaaataaaatatgttactaatatacgtagttaaactagatcttctataatataaaataaaatatcctatcaatgtttttaaaaatatatatgtaatttgtgttccggtcagatttctcaaattaaataaactattaatgtctatgttcctaaatacatcataatacatgaggccgatatataataaataatattatgataatattttaaaggaaaaataacgaattacctctaaactattatgatagaccgaattatccccataaacctaaaaaccagacatctcacaccctaaactattaataccgaacgaattacccctgactcaacccgaagtggtttcggttctaccttgtagtcccgtcagcattttcttaaaaaaaaaatctctctttcttctccctccgatccacgtctgtcaatcggcaaggctaggggcggcgagcgggtggatcggaggagctcgagtgaagagcggtggaggcggctcgtcctcagcctccatcggcacgcacctccttgatggacacgtgacctcttcttggcctccactggcgcgtgaagaggacgatagtggcggggcggaggagctcgagctccgtaggcggcttgggggcggtgagcagcggaggcggctcctcc

SEQ ID NO: 10302 - DNA, 1501 bp, Oryza sativa
gtcgggatcaggtcgggatcaatcaggattgtccatcagatcagacggccccaacttctcccgcgtcgcgctgggcgccgttctgtaacaccctgaaaatttgaccaacgaaatcaaaacaccaaaaatacggattttcaaaaacttttcaagaaataaattgcatcatgccgattatattcgcctgtttcattggattttgatctgggaatttattaatcgcgaataatgaataactaactaggaataaaccctaaaaatcaagttggctaaataaataattaaaatataaattaaaataaagattaggtgggattggaaataaataaaatattatcgcaaccatattagcaataattaaattttagtacgatggaatgagaattaaccctaattaaaaattcaaataaattatataaacaaaatatgagtgatattaaattagggtgaatttttagttaggataacacaaatatggagtaaacttcatttatgtaaaaattaggaattgtggaatcaaatttataaaagaaatagactaaaatgagaaaaataggaaagtgcactgttcattgcactctaggtgctcgacgtggttcccctagccctagcccctcctctgccacgctgcctcgcgcaccgcgcgccgcgcgccgctccgcctcccctctgccgtcgccgctgtcgccgtcgcggtcgacgtcctgtcgccgctcgcgcgtcccatcgccgcctcgcgccccgagccgccgcgcgccgtcgccatcgtcgcttgccgccgtgcgccgccgtcccattgccgctgccgcaccgcgtcgccgtcgtgtcgccgtcgccctcgagccccgcgccgccccgtcgccatcacgtcgcccgtcgccgtcgtgtcgtcgtcgccgcgcgccaagccccgcgccgcgccgcgccgtcccgtcgtcgccccgcctgtcacgccgctcccacgccacccgtcgcgtcgcccgtctcccgtcgcgtcgcccgtctcgagccccgcaccgcagcccgtcgcatcgccgttccgagccccgcgccgccatagcgtcgccgcccgcgtgtcgccgtcgtcccgccccgagcgccgccgtcgcgtcgccattacgccgccgcccctcctcctctcctttccccctctctacaaatacccccccctctctccattttcccccaccccatctcacccttcctcccctcttccctctccactgcgccgccgctctcgtgccaccgcgccgccgttcctgtgccgccgcgccgtcgctctcgtgccgccgcgccgccgttcccgtgctgccgcgttgtcgttcccgtgccgccgcgccgccgttcccgcgccgccgttcccgtgccgccgtgtcgccgctcctgcgtcgccgtgcgccaccgtcgccgccatcgtcgtcgccgctgccgccgctggtgagccgccctccttcccccttgcgtccaccgccgccgctcgtgtgggagagagccgagagag

SEQ ID NO: 10303 - DNA, 1251 bp, Oryza sativa
catgtgaccccgaagacttgttactcggcttccccaccatgtgacccatgaaaattgttccgggtttggcatgtgaccccgaagacttgttactcggcttccccaccatgtgacccatgaaaattgttccgggtttggcatgtgaccctgaagacttgttactcggcctccccaccatgtgacccatggaaattattccgggtttcaaaccttgggctctgataccacttgttagagtgcgcagcccggcccactaaccgtgggccacacaggtcacatttggcctgctccaccacaggcccaaccagagccacaactttaggccctgagcctacacaacccaaaagactagtctgatgaatgaggaccgcccccaccttttaaatcatgttcctccatcatcaattaccgatgtgggactaaacccaacaggatctccgagtttcagtttttgagtctgcatgtaaatactgctatttaagtttcagagataaggtcaggaaagctgcaagctttgcgcagcaccaaaacttcctatgttctactgattttcgcgtttgtgagttcttggttgagttgggaaattgcgagcgcggctgacaatgggtatcagagcgtgatgtcggctcccgccggcgggcaatcgcatacccctcggcgcaccgggcggcagcactagccgttgcctccacggcaacgcggccgataactcgtcgtgcagtgcctggtcaaggagagcggcgccgtctcctaccccacccttacacgctccaattactccatttgatcggtgtcgatgcgcgtgaacctgcaggcccaaggatataaatgatcggtgtttgatcggtgttgataaaaatgaaaaagaaaataactgaaaatattaggttgataactattcggggaggaaacctatcggccatactagcggctggtcttttctcgtaactactcatgatttaatatcttctaatctaaactaagaactcttgcagttcaaaattcggttcggttttggctctcataaaacacttttgtttttatctgtttatgtgttccatctaccctatatttgcatgcatatagcaaaggcaaaatttgctacatggcaccaaataaacgcgtatttgttaaaggacactgtaaaaagtagtaattgactgttggacatcggtgatattattttattatttctgctataaatggagagagaagcaatgatgaaagtacgaatttgcccttctctcaaga

SEQ ID NO: 10304 - DNA, 310 bp, Oryza sativa
cccatcaaccccccccccgctatcagaggcgaattgtgcgcctttattcttgcagaaataatgaacaagaaaggacgttttcatgccaaatagattcatgaaattggctagataatttattgtgatgtaaaaaagatgtttttataatttctggcgatgtaaaaaattatgtttttatagagtgcaatgtaattaactttcatatgtgcaatatttatggtactttactaaattgtcatcacatttgatcaactacgatttatgttgtactattcatctgttttctcctttttttttccttattgacagg

SEQ ID NO: 10305 - DNA, 1501 bp, Oryza sativa
ctaggatgtaacatcgtagttacactgtaactacacattctaagcagaagtacaatgtaattgtatatttggatatggttaaattcttatatttgagtaattgtatattcggatatggttaaattcttacatttgaattattatggtgttaaattaggtataaatatagattgtatgttgaaatagaagagaatgagaaacgagggctgagaaatgaacgcctttggtgccagcttgtaaagggtcataggtgccggtttttcatgcaacactaattcaacaatgcgtactggcaccaatgataaatttagaatcagcacctttatgttccaggagccttaaaaaaggccgactctcaaccagctcgaattgagtcgattcgttgaaccctcatgtccttaagatatcatatcccccaaaatgatgcctcagatccctgaaataaagatgaatacatgaacaaccatcaatattctatataggactttgtatatggtgagcccgcctagccataatacataagtataaggtatctcatatctagaacattgacacaatcaatcctttgttttaaaatgcttcataattatttcccatatataggatttaaatcctctacaacttttatgtttttctgttttgttctagaagggacctaagtagtagcatgccatgcatgggaccaactgaattactagtagaccaagaagaaacaaagcttctgtactcctttttgcctttgccacaaccacaaagacggccgttttcgtttttaggctgaccgaattggctttttggaagcttgatagggtttcagattgctagctagtgctgcatttagataggggagaagaaattgcagtgtgtagagtagtagtagataggaacaattgtactagtacatgttaaattggtcctagattgttcgtttttctccctggagtggtagggatgctgagattttgggggcatatgcttttggaatggctggaatggaagggatgaagtgtgtctgctagctgctgccacccatcttctctgctgtgatgtgaagacaaactaacaaaagggctaaaggcataaagattacggatatttaactaactaattaattaagtttattctttgtcaattactcacttcgttctaaaatataagaatttttgttatttaaattttgtgtcacaataagcattcaagcactggcatcttcattttgtgtgtgtgtggggggggggggggttgttatgcaaataataaaaaacatcttggtaaaataacgattttgtaggccatggtgctgaaaatatactgcatgcgacgatgtggcaaccaagcattttccataaatagccaattatgtacaatttaactgtgacaattaaatggggacggcctatacaactttagcaagaaaatcctctcccatctcaatctattttatcatccctcaaataaagattattcaacgggctagatcaactctcaaacactgatacac

SEQ ID NO: 10306 - DNA, 1501 bp, Oryza sativa
caaccgagataactacaaagggtaaggcgtgaaacgccccctctgacctagctcgtcgacgtcgagggcaccatttgtgcctcgaaattatcttcccagcttttagttctattcgatttgcaaggaagtttagcttcattgcacagaataattgcctaccaattaggcttctaattcgattcgatttgcaaggcgtttagctccatttgcacagaattgtcgcctactagtaccaatttagcagtcgcacacactacccccaatcgaatcgatcatacgggcaggacgtcgagtcacctggctctggctctggctctggctcgccgccgacgtcgagtgcgcggggctgccttctactccgccgccgcctcctccgccgttgaagcgatgcgagggcacggtgaactgctcgtagagcgccatcttgttccggggcggcgcccgcgggcctccgcccttggccgcgtcgttgacgtggacccgcgggaacagcgggcccatcaccttccccttcgcctccttccctcctcttcctccgcctcttcccctcgttggcatcgcctcccgccgcagcagcttctcgggggcgtcaggccatggcggggtggaggaggtcgccggtttttgtggccatggaaatggaagctacgggattgttttgctttttttttttttctcttggatctggatgccatgctcatccatacgcccattggaggagtgaaaggtgggcccaccgtgagtgagacattgggaaaaaagaaccggtcactgagccggtttataggctttatgatcaccgattcagtagtgtgacaaccggtttaaaccgtgatcatgaagcacatttttctgactgagcatgtataatcagtggcaggtctagaaaatcaattcattggtgtcataacatatatatcggtgtcatagtatgctagttatgcttagatcatgatgttataatatatggataagcagttttgctatagcttttgtcaaaagtcgtcggtgtcgtctggcaccggcccatatactgtagatccgcccctgtgtataatagtatgctataacccagctataactttataagaatatgtaaaaaggtaagagaagagagtgaagaaaagtgagatttctagccagctatagcatgaattttaagatgttgtctgtgtatgagagggtaggatcagtcattaatggtataatatatatttatagataactattgtatgaataaattattagattggatataaatgatttggagctagtagttagctatgctattaacttgctcttaggcttcattagatttgtctcttttgaattagctacttctttatcgctctccatgagcatactattttgaattgttgaatggtatctttttttaaaatatatattatatggaaatttgtaccgcaccataatcatctgttcccgctatcgacacccaacccctattttaccggatcaagaagacagagtgcgacggtga

SEQ ID NO: 10307 - DNA, 1217 bp, Oryza sativa
ttggcacgggcaacaacgttgggctctttctacaatgaagatgatggccttctctttgacctcatctacgcccgtccaaccgtcgtcatgagcacctcccatcccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctctttctgccgccaggagcagttccatcaccgtcgcactctgtcttcttgatccggtaaaataggggttgggtgtcgatagcgggaacagatgattatggtgcggtacaaatttccatataatatatattttaaaaaaagataccattcaacaattcaaaatagtatgctcatggagagcgataaagaagtagctaattcaaaagagacaaatctaatgaagcctaagagcaagttaatagcatagctaactactagctccaaatcatttatatccaatctaataatttattcatacaatagttatctataaatatatattataccattaatgactgatcctaccctctcatacacagacaacatcttaaaattcatgctatagctggctagaaatctcacttttcttcactctcttctcttacctttttacatattcttataaagttatagctgggttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcga

SEQ ID NO: 10308 - DNA, 172 bp, Oryza sativa
ctcaccacacgccacatcgtaagctaatagctaccacaccttcctagtagcgtatcacctgcagagatgatgcatgctctcttgattgattagttaattattgcctgttcttcgctaatcgcgtggtgattagaaggtaatcagggggttaattgctattactatttataga

SEQ ID NO: 10309 - DNA, 1501 bp, Oryza sativa
tgctgcttggaattgacacgaagaggaagacggtgctgtactgcggtgacgacgaggaggctgaggccgtcggacttgcggcgggcgtggctgtggcgacgactcagccggccgtcttccttgtagtggcgcagagactacggccttagtctggtagtggtcgtcaatcttcaaggtgtggacgacgatgcaggagtggaagacgatggcgccgcgcttgtcggcggcggcggcggtgaggtcagggacatcgctgttgttgacggtggctgcgtgcaccggcggaggagacagatgcgggcgatgatgttgtttcttctctgattggctggccatgttgccatgtattgcatgctcctatttggttcgatttgctcttcttggtgttggacgcatggttctgtagcatgcatggtgatgacgtgtcttcatgcaacatgaatggtgatgatgtgtctccatgatccaagatcaatctcctgcatgtacagatgcaggatccacccatgcatgtgtgttgtcggtgaaagacttcacgctatcgatgacgagcatgcgtcagcactccagggtgttttggccgcagtgacgaccagtgcacgtgcagcaacggatcggccggtagtcatgctggtgaccatcgagcaccctggccccgctcgtggaggcaaccacgacaatgcccatgcataatcatatatcaatctacattagccactaggaaaaacgacaaacccgacggtgttgaggccatctcctccttgaagaaacgatcaagcgccccctacctggcgcaccaattgtcgatttctactatcggcaatatattttttggggtgtgctagatcaatgagagatggtgacgcaggtgtttatcctagttcatgaccacgggaagaggtaataccctacgtccagtgtgttgttctctgtatcggggtggaaaaatgaactaagcagcccccctaggattgccgccagcgctctttatatagagctagggctgccggcgccatacatggcagggtatctcttatagtctaggtacctgccatctatttacaagcgataggatagacttccttatcttttatctcttactatgtatacaagtgtgccgcatgggcatagggcacttggcccaccccatgtggtgcagcccaaggcttgtcgttgggtacccgggtaccatgtaccccacaatcatcttcgaataaaatcaacagagggcactatttacctcctggaatagagccgaaaccaaggtgaatgcctaaggatttaacggctactcaaaagagaaggttgcaacatcttcaggcccaagaattaagagagagagaggccgaagaggaaagagatagaaagttcaacaagttgcgaccaccgcgtacaaaggtatggaggcataaatccatatatggagaaaaaccggttgttgtgcaaaaggaaaaggaagaacaatcggttgctaaagaaaattcatctccaaaggaagaca

SEQ ID NO: 10310 - DNA, 1501 bp, Oryza sativa
tcgggggcttcaccaccctcactgcctgggcgctacgccgcacgctgagagcttcgtccttcacctggctagcacgcttcgccgacttcgccacgggctcgggggcttcaactccctcgccgcctgggcgctactccgcccgccgggaatcttacgcctccacccggctggcacgcttcgccgacctcgctacgggctcaggggcttcacctgcctcaccgcccaggcactacaccgcccgccggggctcttcaccttcacccgactagcacgcttcaccaacctcgccacgggcttaggggcttcacctccctcttcacccatcaggcacgcttcgccgaccttgccacaggattactgcgcccaggggctacgccgcatgttaggggctccgcctacacccggccgaaacgactccgctccgggcgtgactactacgccagggggctacaccgcatgctgtgggctccaatcgcacacggccggcacgactccgccctaggcaagactactatgcccaggggcttcgccgcacctggaatattgccacgggcacaagggcttaaccccaatcgccgcctgggcgctacgccgcccgccggggatcttcgtccttcactcgcttggcacccttcgccgacctacccacgaggtcagggtctacaccgcacgctaggggctccgccttcacctggccggcacgactccgccctgggtgttaatgctacgcccagggggtacgctgcacgccgggggctccgccttcacccggccgacacgactcagccctaggcacgacggctatgcccgggggctacgccgcacactgagggctccgccttcacctggccggcacgagtccgccctaggtgttattgctacgcccggggctacgccgcacgccgagggctccgccttcacccagccgacacgtctcggccttggccatgactgctacgcccgggggctacgccgcatgctaggggctccgccttcacctggccggcacgactccgccctgggcattactgctatgcccggaggctacacctcacgccgggggctctgccttcagccagccgacacgactcggccatgggcacgactactacgcccgggagctgcaccacacgctgggggctccgccttcacccggtcggcacgactccgccccaagcaggactactgcgccggagggctacgccgtatgctgggggctccacctgcacccggccggcacgactccgcccttggtgcgactactacgcccgggggctacgccgcatgctgggggctccgccttcacctagggggtgagcgaagacctcggggtcttgcgcatcgagttcgtcaagtcaactccaccccgcgaagaccctagtcatcccggcatggagtcaggaggctaccctaaatctagactaaagtgaggagaattatgtatccatacaaggatgggttgtgaacttcatcaaaacactagagaattagcccaaaattt

SEQ ID NO: 10311 - DNA, 1501 bp, Oryza sativa
agtgacaaaatatgcactatgggtcactttccatttttaggtacgaatgggtcgtatactcaaaaatttggtatgaaacggaaaaaaaatcccatgcaatgaaaaaatttcaattttagtctatgttaattttatggcaaaaaaaactgggtattagaagtacatttttttgtaattatatgatgtacgaatatgtgaaaaaaactttggtacagttgtgcatcacgccgcctagccgttcgatttaatatatgttggatacttgaaaaatctagtatatactatctaaaatatcagtatataccggagaaaaaataagtacaatataaccagtaaacagaattgatttaggtatatacccattaaaaattgcatatttcggatacccatttttagttaggtatatacctatctaaatgggcgtgaaaaaattttgactttcaagtagcttacattttttttcttgaactgaatttgaaactagccaggccttttagttaagttttttttatactctcgctaggtagctgaccagatgtaattaggtacatgtagatgtgatgtatgtatataagtctcgtgtgttgtgctttttaattttttgggtatgtgacgtgcatgcgtttcaaacgtactacaagctaggtatttacatgcatgcatttcatatgtacatttaattgggtataataccatttaggatacacatttttaggtatttaaacacgtatgttgggtatgtgtgacataccagattctatttgggtatataccggtctaaacacacatactaggtatatacccattaaaaattgcatattgtagtttggtatatacctatctaaatgcgcatgaaaaaagtttaattttcaagtaggtttttttttcttgaactgaatttgaagctagctaggccttttagttaagtttttttatactctaactaggtagcttggccagatgcaattagatacatgtagatgtaagtataagtctagttgggtatatacctataaactatttatagatttaggtatataagtctcgtgtgctatgtatattctaccgatgtagattaagtaggtggtgacatttatggaatagtaggatggtaggtatatacatagtaccaaaatattctgtattaatttgcatgattacaacgtgcaaatttcatgttaatacactgtcaagaacatcagtttaaaaaaacttgtgttgatacactagctcttagcgcgtgcatccaactggtgtttcttctgcccacgaccatcttctccacatgatcccagggcaacatacgtacgtacagtctttggctcaataggaagatgaaccaaaaacttattagcaggatacatttccatcttaaggtcttgacaacgaaatgaaattgttacagtactcagtctgcgaaaacggtagaacagggacttgtcaaaatataagaataaattgaaataaattacacacgaaccacacgcgcagtgaccgtcga

SEQ ID NO: 10312 - DNA, 1501 bp, Oryza sativa; identical to SEQ ID NO: 1788

SEQ ID NO: 10313 - DNA, 1207 bp, Oryza sativa
cctcgccgatctcgtccacctctccgtttcggtcgccgaccgccggaacgccgtcgaccccgtcaacccgagccgcgccgccgcctccctccgctccgaccgccccctccgtcgtcgccgtcaccccggggtaagccgtggaccgtcgcctcctttcccccttccctcccctctctcggccgccgctccgccgcgccggtggtcgccggcggcgaccatcggggcacgggcgcgccgcctcccgccgaccgcgccggcgtggccgcccgcgtgcgcgccgagtggctgccgcgtggggcccggccgtcagccgcccgcgccctcgggtgcggctgacgtgtggggcccacggcgccgaccggtgcgagccgggtgcgcccagtccaccgtggaccgtgaggctgccgcgtgggccccactcccgtggacccggtgcgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggt

SEQ ID NO: 10314 - DNA, 1501 bp, Oryza sativa
gataccgagaggcctcaactccaccgtggacacgaacggcgtgccctggccgatgttgatgaggcaaaccggcgcctagctcgcccatgccacgaacaccgcttcgtgaacattataaccatcatttccgtcggtggtgtctatactcacggtgtcccagtgtttcacaccaagggtaaggttgaattttagcgatgggttgtccatgccgtcgtagttgccatacaagaaatccagcctgaccaagtacttcgacccgatatgggtgggcagcgagtagcagttgcgctgacccttggcagatgggaagctcctgaccgtgtggagagtacgtgtgtcagggccccaccagcgattgcggtatacggtggtcaccttctgattctcgccgccgtcgatgtacgggccgtctgggacgtaagtgaggccggtcaggtcgcccaggtagctgctgtctgcctccaggccgcagtcaatgcttatgaaacctattgcccaaagagaaatgccataaaaaatttttaatctccacctgttagtatagaagctaacgtggtaacttctttgtttaatttcttaaggcagcctccatacaatatgtcccaattataggtctattactcttctaattctacactctccagatgttaggtctcaactcaatggtactgatttctcccacctcatcaaccccattacaattccttctttctactaacatgtcctcattatagcatagaaacggtattccgagccaacactaatgttcataacaataaacagcaatgatacttcaattatcactgtcggttctcgatatgaaccaacaatgatatgatttgaaaataccaacccacagtggtataaattgaaaatatcactgctgattcataatagaaacaggcactatgcttaacggaccacatagtctggcccatgtcacaccctgaagttctcctcccaagcctaaaatttaatttataaatgaccctaagaaaatgccggtacaaatcaagagaaaaccctaataaagtaatgcaaataataatcgaaactggcatgtggaatttttctggagttctacatatcgaaattcgctaacaagatttttattggaattttcagagccctagagataattttaaccaattcaaattgagcaagcaatattttaattccagggaaaatccttttcttcctttttctttttctttttccccttttcttttcgaatgggccgccgacccattctctccctctccccctcccccgctgggccggccgcaggccgaggcccagccagcccgcccgcctccctcctctcccggggacgccgacagatggggcccacctgtcgggtccttccccaacctccggccgtcaccgccgccgccgaaaccgccgccccgcctcctctgagccacttcggccacgccgcgtgtgctccccgacttccccacgcccacccccctctctctctcgcccgcgccctcaaccgaga

SEQ ID NO: 10315 - DNA, 1501 bp, Oryza sativa
agaggagatgaatgcctcaccgcgagtggccggcgctaagggagacgatggctaacggcgacggcgagccacgggaagacggcggcgacgggcggacgagcttcgggatgccctaaggaaggaagagagagagattagagggagggagatgaaccacgcgggccggcatccatggccgaaggcggcggtaggggtagggctcacctgagcgcgaggggatgcgggttccggcgacgaatctcgacggaggagcggcggacgaggtggagttcggcctcgcgaacccgacggcagcgacggcgcggtgcgacggcgaccctagcagcggctagcggcggccggagtagcgggagcggcggcggcgagtggttacacggcgtgggggcgatggagagctcgggagaggccggcggcaaaaggaaaagcgaggaggaggacgcggggatggattttataggggcgggaaggtcgggaacggcctaggtgctcccgatttcgccggcgacgtgggaggtgggaggtggggagagagagagagagagtgggggaattcaaaaaacgaatcccgcccatctcggttgagggcgcgggcgagagagagaggggggtgggcgtggggaagtcggggagcacacgcggcgtggccgaagtggctcagaggaggcggggcggcggtttcggcggcggcggtgacggccggaggttggggaaggacccgacaggtgggccccatctgtcggcgtccccgggagaggagggaggcgggcgggctggctgggcctcggcctgcggccggcccagcgggggagggggagagggagagaatgggtcggcggcccattcgaaaagaaaaggggaaaaagaaaaagaaaaaggaagaaaaggattttccctggaattaaaatattgcttgctcaatttgaattggttaaaattatctctagggctctgaaaattccaataaaaatcttgttagcgaatttcgatatgtagaactccagaaaaattccacatgccagtttcgattattatttgcattactttattagggttttctcttgatttgtaccggcattttcttagggtcatttataaattaaattttaggcttgggaggagaacttcagggtgtgacatgggccagactatgtggtccgttaagcatagtgcctgtttctattatgaatcagcagtgatattttcaatttataccactgtgggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaa

SEQ ID NO: 10316 - DNA, 564 bp, Oryza sativa
taatatgaatattaattaactaaacacgactaaccatcatgagctatcattaattaaccatcattaatcataagtgattcattagttattcatgcataaaatgatactaatgtttctaagcatgactaagcaattatacaaagcatctagttgaaccaataaaaaatgtccaagctggttaaaaagaataaggtaatcaatacaaactagtcagcaccccacgcgttgctgcgggcaaaaaggagatctaaatttgattcatattcaagtatttcaaattgtcatatggcaaggtctatttgaattttgtaaattgagaaagaaaaacttgacaccaaatatcaagtatggcacatgaaaattcgtaagcaaacagtaatgtttcatgaaacctgaaggtatgctagttcttcaattatacacttaaccaacattagaattgatgtttctcaaatgctataccacaaagaaagattgaagcaagagtatgtccaccaatgagatattcacctacttaaaaccatagcccatatagctgcatatatgcgattgagtttgaaataa

SEQ ID NO: 10317 - DNA, 1501 bp, Oryza sativa
aacattacaggactgtgtgtgcatgtgcacgtcgtcgttaaagttacgcccaacagtaatatgatagtcctttccgaagaaggagcacaatttgtcaaattgctagtgtcagtcaaaaccggtacggaaggtcattaatttgtcaacagtaaattaaataattcagtcgttcggtgctcccctggattactcttgtaatacgtgatttaatactcgctcagtcgagaatgttgtcaaagattaataaaaaaatctgttacatttagaaaaacggagagtttatgtgtgtgcctgtgtgtgtatatatacggtccaaactccaaactcgatagcttcgctccagcatcgtcccaggttatcactcatcaggtctccatggctctcctggttttggtcgctgtactggtgtttgaagcagcggttcgagccgacggccagacaggtcagcttattttttctattctgttgtcccttccactacaaaatactcttactatctaattttgcaaggcctggttttatcaagcatgatcttaaaaaagtgttctatgcttatacacataaatgagtaaatttcataaaagtatagatattattttatagatatttctttttgaaaaaaatataaaacacagatttaaggtggtgatgtatcacgacgtacatacatatttaacattgagttcattgtgaaaagtcactgtatatatggtaaaactataggtcgagcgttaatttgaacacaaaactgcagcttcctggctgtgctgttaacgtgatgacttcaaatgtaaacgttaaggtcatcaactataaaattacaaaactatagatcttagatgtacaattttgatatagtgtttgtgtctacttcaattcatttgaaaattttaaagcatttatcaattagatcagataatttctaacacatatatgaccatataaactatgtcaaataataaattgttcagcaaccatgttgtagatcttgtcaagaaatataactttggcataaagtttatattcatcgacttcatataaaaatattattaatttcttaataatttcacttcgatgctcagttaatggtgggccgaactatatatgtggtccattaagcatagtgtcagattctattatgaatcagcagtgatattttcaattcataccactgttaattggttggtattttcaaatcatatcattgttagttcatatcgagaaccgacagtgatagttgaagtatcattgctgtttattgttatgaaacggcaatgatacattagtgttggctaggaaggcggtttttacactttagtgaggacgtgttagtagaaaaatgaagtatagcggcgttgatgaggtgggagaaatcagtaccattgagttgagacctaacatctggagaatgtagaattagaagagtattagacctatatttgtaacattttgtacagaggctgccttaataaattgaacaaaagaacttaaacaaagaagt

SEQ ID NO: 10318 - DNA, 1501 bp, Oryza sativa
ttcttcaatatgatggctctctacggccgatggagtttggtcactcgatgattgttgtacaggagaagaaggaggaggaggaggctgtaaaagagacaagtgttagacaaaatcggctgagatcaactagtgaaagcattaaagatatcttattggtggagccggttttagagttgttgatgccgatttcttcttcacagcaattctctttttttgcaaggaaaagattagtgagaaatcgggtgaggacgaatagttataaaaagagaatcaaggaaagatatttaacctagagaagtaagctggagcagagggggtcggaggagttagcttaggtgaagtcgatggagttatttcagtattgcttatttcatctgtggcttgatcaacatcctcgccgatttcttcttcatccagagcttgttaaatggatggatctagggcaggcagatcatcggttggtttaggcttctttaatttggccttctttggagcaggagccgatgtatccacagccgataatctggttcttctctttttactagcatcggctggttctctgatgagcccttgaagaagagttgaagtctcgggggcattatagccgatgacaggaggagatggaccacctccatttggaataaggcctagagcatactctatgtccctgccactattgctctggtgaggaaggaagaactcccttatctgcaagtcaggaaagaaaattaattacgttatgaatcggctaagcaattatttaaacggagttaattaaatgaaggcatacctaagggataacatctggaaagagatctgtcatgtacatagaagccgattgatggaatagatgcagtttccattcaccctaccatctgtcaaagtttttgctcctgaactttgccagccctatattttcaatgctgcccagaggaggtccttggagattgagcagccgatccatcatcaaggctgatgagatttcccctcggcacaggatcttatcggcaaagaataagctgattaggagttggcccattccaagttgtctagctaagctcattggatgatagaactcataagagacttggatgtttttcccctgatggatgccgacagaaagcatgcatgggctgattgcagctgagaaaacttccctggacttttggtatctttcatgattgatatcttcaaatctaaagtccgatgggagctcaaggtttgctgaatcttcataaggaaaccaaactcgaacatctttttgaaagccatcatagaaactgcagaaccagtccttgagcagttcagccgataattttgctccggcatcggttggtgtggatgcatattctccatatgacatgcatctgcgatgagtgcgctcttctccatcatcttctacaatcggctccagtcttgggaattcggcttctgtcaaagatggccgattgacaactttcatgaccatcagatttaacgaagtctgcaatagccaccatgg

SEQ ID NO: 10319 - DNA, 310 bp, Oryza sativa
tctgaacagggtaacaagcagagtggatagaagtagttttaggaaagggttaatttgatgcatgccactataaatattataaatatgacatattaaaaaaatagcgtactagaggagctggtctgaacagggtaacaagcagagtggatagaagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcagg

SEQ ID NO: 10320 - DNA, 601 bp, Oryza sativa
caacttgctttatataatatcttgaacgtaaattccaggaaattggtgcatatacactattaatttctgtttgcaggtagtggtgatggtaaatctatcatcatttttactattaccacctaataactactgtacgtgaccaataaacagttagataagatttatcttatttccagccaatttttatttatagtaattaattatttggaaattaaataaccagtaaattatccgcattggctccacctctctcctcccctctccgcgtgggacggtgtccgtggcgtcgcggcatcggccacgggcgggacaactgttcctgtgattaatccggccgtttccgcggcggatccagcatcagtggtgggcgagaaactgaaggcggccgttcttgcagcgaacccagtgttggcggcatcggcaatgggcgggggtagtatcggtcatgttggcggcaggcgaggcggtcgttcttgtgtcagatccggtgtcgacagtgggtggggcggcctatttaatgctatagatactattctaattattgggttaggaatggccttagtcgtcctctgctgctcaaccttctcttcagtctttttta

SEQ ID NO: 10321 - DNA, 1501 bp, Oryza sativa
gagatatgcagtcgacttccacgcaaaccgcccgacacttgaactggtaaaatatggtgaagataagatggtgttgtctggccaacaccaacaggtatgcaccccaggttgcctatctgattctaatccctagttggttactgtgaatcccattaatttggttcaacgcctcttctgcaataccatctctaggtctgaagaaattctaccatgttgttttgagtcaagattgtcaaagtggtagcacaggagtctcagtactgtcttgagcagaacagggagccgctgcactgcagatcgagccgaagaacatttgatgtaatcctgatcagaacaccattttgacttccattttatttgagaacaccgcaaattttactctgcaacctgtaataaaatgtacttgtaagctcaatcttatttccgattgatggctagttggcacgattgctgcgcagtcttgattaaaatgtgtccctagaaatggtaccagactattttttgaacagaatgaaatggtaccagactagttagcacggttactgtacaatttgcaacatgtctatttatatatatacctctactccccagttagagtgtgctctttactctatctttccaatctcgactctcttgttttctacacatacgcttttcgaaccgttaaacgatatatttttaatataaatttgttttaaataatcacattaatctattttataattttaaagcgaatatttacataattagttattcgttaatccatgctttgttttgcatgctgtaggaaggggtttccagtcccttttttttagactcgcactagacagtgcgaaattctattgtatagcaggagaaaaatacaagattacaaccctaggaggtcgtaatcagaaaaaaaaaaagtataccaccatctacacactgacaacgccaacacacagacccaggagaaggctagccccagaccggtcgccgccaagcgggaccgaccggcgctaagccaacaacggaaaacatccgagatcgctcaaaacccaacccttaccactaacacataactatgctctatccaaatacttgggaatgagggagagagcatgagagagaataatggaaccgctctcccccctaggcccttcgacgtggccaacttgcggaagctaggacgccgacacaagaggataagactctagtgcgagattgcacccattgcttgggaggttttggcaagggggtgcctagaagacgtctccaaggaaagtagcgacgaaagaaccgccgccgccgtctatcaaggtcttaaagagaaccaagactggctttcacccggcagccacactagagggggtgagacggcacggcaacgccctcaggaggctcgaacgccaccattgccggcccggccaaggccgggcttggttttcacccgtcgtccaccgcctgctgatcaaaagctgttctccattgctccaactaccaacccttcaccgtcagtacg

SEQ ID NO: 10322 - DNA, 1501 bp, Oryza sativa
catccgatacggataagttacctgtgaaccgtatctgggtatccttaggtgtagctgcttcctttcgatatgtttggagctacgattaccaggaatacgtgaaaaatactcacgtagtatagggtatccatcccccctatgaatactattagattcggtaattattcaaacgccctattagatttgcacttattatttttcccctcttaactatttgccattttgcttacgtggcatgccaacatggtaacgtagggtagaaactgacgtgaaacccactagtcagccttttctctccccttcctctctccctctagtccggcgtgcatcggagaacctccaagcaactcgtcaccgtcctgaggtccgctcgctgctccgcctcctccaccaccacgaggagcccctccaccgctgctgggcctccttcactgttgctctgtctcctccaatgtcaccctccttctcagtcaccgccgctgctccaccccctccagcatcgcgaggagcccgtctgtcgccgtctccactgccacgagaagcccctccgacgctgctcggcctcctttgccgccgcttcgcctcctccatcaccgccctcctcttccgccgcttcgcctcctctaccaccgcaaggaatctgtccgccgctgctctgcctccttcgtcactgtcactgctctgcaccgcaagttttgctgtcatcgtatgccagaccgaaggaagaggggaggaggagatgagaggatgactagtgggtaacacaacggtttctactatgcattgccatgttgctatgccacatgggaaaaagtggaaaataattaagaaggcatctcttaaaagaggaaaaaaaataagtgcaaatctaaggggtatttgaattattgttgaaactaatagttgcaaatagttaaattccacatccatccatccatccatgatttttttcacgattttcaacaccacacggcaaatacaaccggatcttaaaaaatgataaaagtgaagcataaacacatgtacaaatccatttgtaaaatttgctacatgacactaaaaaatcatataattggctgagagataccgaaaaacgtgacactgtcgatagatactacaaaagttatgtaattgattgtagcacaccataggcattattttataatttccgtgctgaaagaggtgagagatttcgaaatgatgggaatgcctagcggcgcctcgtcaccccgtgcgcctctccacttctccaccgaacttgaggatgggactgcaacagcatcagttggggacgccggggcggtcgcggcgtcgaccagatctcacgcttctgctaccgcagcaggacctcacgtccctcgccgtgctgctcccgctcctgccatagtcgacgtcctcatttaggcccttctcgcttagcggcgtcctcaccccgccgaattcagtcggctccgtggcgccggccccgtcttcgttgtcggagatggagcgtgtccgccac

SEQ ID NO: 10323 - DNA, 1501 bp, Oryza sativa
gtacttacaattgctcatagaacaagtccataagcattgtcttcccagtaccaacacctccatacatatacagcccctgcaccggagaataggtagaaggctgggtaatgaggcgggaccatagccatctacgcctgccaaacataataataaggtttaggacttaggaacattcactaccaggtaaacaatgagaactccgtgttttctaactgcatttaccttccagatttctcagatgactggtatctgtccagttggcaagcttcttcattctcaaccagctcctcatagagcctttgtaaatgttgaatagtatcaatctgtataatgaggaaaaatggcaagaaaaatcttacaccaaacattaaaggaaaatagacaagaagaaaggaaacattcaggagcggtgcaacaacctgaaagttatcaccatccacaagctcccctgatgctattctcctttcatattccaccatcggaccacctcttgcaacatctgacacaaattgggaaagaaaatatgttgaatgaaatgccgctaccagaatacaaatgagtgcaagaatgtacctttgattgaatcagctgccacagtggaaaagctggacctcagtatttccacacttgggctcacatatctgccaatttctctattacaacataatgtgctcattgaactggaagctgaactgcacagcactagagcattctgctgcttgatcaatctattcgttgatgagtgtctctctgcatggagctggccgaatcgccggagctggcgaagcgaccgaactactgatctcatattcctttatttgttttactttctagggaaagctcagcaagtattttcttgaagctacaaacatagcaaaacaagaacacattaaagaaaccataatgaggacatctccaagaatatgacagtactgaccatgtgatgaaacacacatgattcgtgcagtagcataaacagggaaacctcaaagcaaacaaataaagtaaagaaaaatgggggagggagcatgtgctttggaatctgtaagcatgtaaggctactagaaaagtgatggtaggaacgagtggccaataatgaaatgagacagcaccactacacatgagctagcctccaatacccaccaatcaaattcaattaataaaaaaaaagtgagcctaaactttacttggagattcatcacatatcctttgatcgagcaacaaaattgacagaaacatggaatattttgccctaagtcgccaaatcgaaagcgggatatcaacaaattttaggacagcgagctgaggttagaagctccaaggttatcggaatactactatcagccacgattttccgatggcggacaagacaaccgggcgcgtctcaagattggagcttttccgcggctcgaaatctctggtcgaagcaaaaccaatttgaatccgcatgctccaagtcccaatatagcaaaagaagaacaaagatcgaggaattccatat

SEQ ID NO: 10324 - DNA, 1501 bp, Oryza sativa
atatatatatatatatatagacgtattcctgtatccgcctatccgtatcttggtatcaagttaacatactgctctcctctgccacagaaaatcccaccccaacaaacccagcgcatcctcatcgtcgtcatcaggagagagagacccagcgtgcaagcgtcatcaacctccctccaccttcattccacctcaccacgcctcctcccattcccgtttcctcggccgcaaatccagtcccggcgcccgcatttcccgttcccaaactcacctgctcctcccctccctgtttgcaatccagcctctaatcgggatcggcggcggcggcgtcgctgtcgagggcgacgtagggaggagtcgcggtttcggctccgcggtttggagagtttgattcggtctctcccctttttctcatcctttaatccggtgtgtatattcctataagccgtcttggttcgctgcatgttcgatttttttttcctttctcacatcctttttattcggattcgattaggaaatttgcttgctctgtttcttggtccaccctcgccgccgctggacaggtggacgctgcggcggtgcggctccggcgccggttcgcctcccgtagagaatcgcgcggcggcaggatccagcaaggccgccgccgccgccgctgggaatcttctcttccgcgtccgggatttccggctcaggtgaggacggtggctgcgtctttcgttggaattcgctgcttttgcttattgggaagaagaatcctgttttcctgggtgttcttggtcacctcgtccgctcccaaatttatggaccatatggaattcctcgatctttgttcttcttttgctatattgggacttggagcatgcggattcaaattggttttgcttcgaccagagatttcgagccgcggaaaagctccaatcttgagacgcgcccggttgtcttgtccgccatcggaaaatcgtggctgatagtagtattccgataaccttggagcttctaacctcagctcgctgtcctaaaatttgttgatatcccgctttcgatttggcgacttagggcaaaatattccatgtttctgtcaattttgttgctcgatcaaaggatatgtgatgaatctccaagtaaagtttaggctcactttttttttattaattgaatttgattggtgggtattggaggctagctcatgtgtagtggtgctgtctcatttcattattggccactcgttcctaccatcacttttctagtagccttacatgcttacagattccaaagcacatgctccctcccccatttttctttactttatttgtttgctttgaggtttccctgtttatgctactgcacgaatcatgtgtgtttcatcacatggtcagtactgtcatattcttggagatgtcctcattatggtttctttaatgtgttcttgttttgctatgtttgtagcttcaagaaaatacttgctgagctttccctagaaagtaaaacaaataaaggaata

SEQ ID NO: 10325 - DNA, 1501 bp, Oryza sativa
cgtcaaatttttacatacatcaccgttagttagatataggtgaccaaaactagctgcggattgaatgacttaattaggtacatagtacagcaaaactgtgtactaatgggttaattaccgactagttccttctaattggtgtagtacgaagaaaggtcacggtgcaaatagatatgcccaaatcaatatgtttgaatagtgcattgtttaatttaacatgaaacttgtgtcaaataatacaaaaatttgacttcaaacaagctaagtctgttgtgtgtcgtctctggtgtggattcactatattatattagtagtggcaaaagaaaatcatatgctaagaaattaaaggtaaaccggtgtgcaatctcattttgggctgaaatgttagccccagcggaaatttatatatatcatccaacattcagattcataaaccacttcaatcatcatgtcgaactttaattaaaattcggtgaacattgaataaaaaattcgacatagccaagtgatttagggctccaaattaatttggaatgacatataaaattcgaataaatttgtgacgtaatagaacattacatgtacgatgatatttgaacaaatgtgcgagtctaaaaaggctatatatgatgtacttcctccgtaaaaaatacctaacctaggagggggaatacaatgaatctagacaaatgattgtccagattcattttatgtcgcatcccctttcaagttgagttttttttatggagagactaggatataatctaaccacgcgttcaaaatttagttacttgtgtagtataaatgaattgctagtacaactaaaaggggaacctgtcacatttgaatcatgcgatgttttaaaatggaatccattgataactattcatctttttttataatccaatagtttattctatttatactacacctcaactcaaatcaatagcatgaataatattttttcctagcaatagtacatactccctctgtcgataaaaagacaacctagctatatatgatatgatgcatgggatgtgttttatagaacaacaaagacggttcagattcattatattagaaaatatccaatccatatcccatcctatcaaatgttgggctttttttttacgggggagtacgtagaactcataatcaatggtccatgtacttctattgatataactccatccgtcctaaaatataatcaattgaatttggacatatttatccagtttcatagctagaatttaatgcttatattttgggacggatgtccagatttatagctagaaatgattatattttggaacggagggagtaatatataccacccgagattaccattaagatacctatatatacatttaaatatgtctaaacgaaaagatataggccgggacctataatttactttttacggtgccaaactttcaagttaaacatatatatacaacatgcaaattaattaatctagtcgttgttgtttaacgacatgcag

SEQ ID NO: 10326 - DNA, 1501 bp, Oryza sativa
tgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaataatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaagg

SEQ ID NO: 10327 - DNA, 273 bp, Oryza sativa
  unsure (1)..(273): unsure at all n locations
gggtcggcccgctcccgtttcggccccgagggctgggacgcnccgaccccctgtgttttggcgccacgtgtgtggataggtgagcccagcggggctcacctaccggcatttatagcgggttggacgagcgcgccacgccgcatttaatgcggcgcagcgcacgcttatccggtccgtgaccagtcccggtatgtgaccggtcacagaccggtcagatcgcgggttaggtggcaacaggcgtcctgtcgcacgcctcgcctcgtcccgtcggaa

SEQ ID NO: 10328 - DNA, 1501 bp, Oryza sativa
cggcgtccgggcagcggtggaagggtacgacggcggcgtctgggcggcggcggaaggggacgacggcggcgtgcgccacgcgaggaggagtgaggaggcgaggaggaggagagggggagcgaagcaaggggacgacggcggagcggcgccacgcagggaggagcgaggaggcgaggaggaccgaggcggagtggaggtagcagcgacgacgcttgggagagagcgtcggatatgaggatttgtcgttgtggcgatgatgcgcgacggattgaatgcggcggaggcgaggtgcgcggcaaagatggcgcatgcggagtaatcgcgcgtggacggtggagaggataaggtcgctataatcgttggaatcggtggagcgaggaggatagcgaaacgaattagatgagatgagatggtagatggacggatgagatgggaggaggtgatttcacctgtaggattgctagacacaacttatactttttatattagtatagatagaccagagactgacagatgtgctctctatgccctccacctgctgctggcccaaatatccaacagcgagagaacaaaatctacattaattttattacggcaaggagaaattctctttgattacatcgatttggtggactcatgtagagttaaaagtactctagtaatttggttgggagtaacgttaatctggttaatttcgattaagagcaaccaaaatactgtattttctctctgtaaaaaaactccaaaaatacattttttttaatttgagaaacaacattacaaacgtagatactcacaatacacatacacccatataaacgcacatatacacccaacctttattagcacctcgaaaagactgaacttgtatatcttgagagtgataaagttatctctagcacctcgttgttaataagtacgtcgcctagaattgaaaaaaataattagccgtaaatacgagtactcaaaatatattgtactccatgttctatctattatatgcaatacaactattttcagttatgttatcctaaattcgattgccccaatgtgcaaaactctccataggataaacacatcactctaatcctccattacctatgataaacacattcattccgtgtgaaccacgtctcatttagccacacattcaccaaggcaaatttggagcactcaaattccaattttgtattcatattcccattcaacaaacccccacagcataatttaaaatgtaggcgtctgtgttctgcaggaaacgtacgtcctatgcacaataatttatttatacgcgtatatacttcacggctacgcagactgccgtttacacagaaacacaacatcgtacacgcaccgtatgtgcttacataagttcgtaccactgactatatataccaatgcatcctagttccaattcaccaaaccaaaagcagagttcacagaagcagcagcagagcagcaaccaacagcagctggatcacaggtcacaaagcctgatcga

SEQ ID NO: 10329 - DNA, 1501 bp, Oryza sativa
  unsure (1)..(1501): unsure at all n locations
aacttaaattagcattggttacaacaattaattctataggttagcacacttgtatgtaaaaaactgtgcatgaaaaaaaaaagctaagacgattttgataataatatgtagagcttttagtttaatttaaaatcaaaaactcataacatgtcctttcaaagcagacacaccaatagaaattaagggaaagataagagggtcaagcagcaatggagaccgtgaaaaataatgaaccacactagagaagatggcacaaataataattatgtaagtttagtttgacatctaaatgtaaattttgcaacaatttttttcattatgaatcaaaaataaatctagattttcttttatctaaacttccagctaattttattctctaaacatttaaaagaatataagctaaataaaaatatatagatttgctttaggaaatactataataaaaataaaaaattatttatttattatatattataataagaaaaatatagttaaatatatattttggagatggtataattctaaaaaatgttaagaattattttacaaaattgtcttttctaacactgaaaagaaaacacaattttgtaaaataattttctagaagaaaaaccaaaaatggtaggatggactagtcttggactatgcatcatgtcccggcctcccgggcgacacagagagaagaaaaaacgaaacagccgagatggagagcgcaccggccaccaccacctcctcctccacccaacacggcggcggcggcggccatatcttcctcctcgctttccccgaggcgcatggccacgtcaacccgatcctgcagctcggccgccacctcgcggcgcaccacggcctcctccccacgctcgtcaccacccgccacgtcctcttcacccttccaccccctcccgccccctttcgcgtcgccggcatctccgacggcttcgacttcggcggcatggcggcctgcggggacgccagggagtacacccggcggctggcggaggtgggctccgagacgctgcgcgcccttctccgctctgaggccgacgcggggaggcccccccgcgtgctggtgtacgacccgcacctcccgtgggcggggcgcgtggcgcgcggcgcctgtgtgcctgccgtcgcattcttctcgcagccgtgcgccgtggacgtcatctacggggaggtctgggcggtgcgcgttgggttgcccgtcaggaccgnggcgcgctccgnggttgctgagtgtggatattatgggtaccccatacccatacggaatggttattcgactagtataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcacga

SEQ ID NO: 10330 - DNA, 1501 bp, Oryza sativa
catttggcatgttttagaaagctctaatgagattatatatgccatgttatcatatctgtaattatatataacttcaatgtcattcaaaccttgaggaaaagtagatcaaatcatcatgaccttttaatatcccatttagagttagttaagtacaaagatagtcatggaggttaatcgatgtattttatgagcattttaaattacagcgtatttatattagtaaacgtgttctcgatgtcttcattctaacagaaatagttacacaacttgaattctaactcagaaatagagcttgaatcctgaaaggtaaagtccagaatcaattgtaaattggtaacttatccaacttaaaatagaaggtgacaatatatacaagtctatatagaaatgagctaattaggtttcaatgtagaatcttatatgttgcacagactatgaacctagaagcatagataccaagaaagatctgcttatgttaatgaagcaaaaagtcatttataggataacttcctcctaaaatagtttcaaacttttttttacttgccgataccaatgttacatttatcaggcaaacttgatttgacaacaaactaaagagtgttcatgtctaaatagaaacaaagaattttgggatgtaaggttccaaatgtacaaatggtttagcaagtaacacatatagtataaatgagcattcaaacttgtgggatatgatatggaaccttcagtaggtacatcttaactaaccaagtgaacttcatcacacaatcatttgcaaaattgaaacttacatgagtttctagctttgtcataaacttaagagattcttcatttgaaagaagcaaaatataaacccacaaaataactgtgtaataagtaaaagagtaaacaacaattaattcacttcccattgctcaaatcccactactgcaccgaaatgcagaatgccaggatccctcagcagagcaggaggggcgtatgaaattccttgtacttgcaatatggatgcaaaaccgtaccgatagtcagcagagctaacaaactgaaattagcggctgagatggtcgcgagcaattagtaccaggggtgaccacagccagtaactgataagagagaagaggctgcaagtaactggcatgccagcagcggacagagaacaggaggccagatcatgagtcgatccagcattaaggagatgaatatctggcccttgctacaccataacaccacaatcatctttcccagtagcaaaactgtgccctatcgacctcaagccctcaccgtgccatgggattatcgtcaacgctggaggcacggcatcacaggcaaatgtgtgcaccatttgcagagctgcacgccgccacctcgaacctttgcttcactgctccgctgcgccgagtcgctgaatcgaccgctcgcgtagtcgcagtcgaggttgagcgttccccgttcgagcaaggctccatcccctggattgagtgttgcgcactccagttagcctctc

SEQ ID NO: 10331 - DNA, 1501 bp, Oryza sativa
acaaaagaagcagctcagaagattatggtgcaaaccctatctctcgtagagcaaggactatgagcaagagtgggcattttcgactatgattcactgagcagatgacccaaagagtacggtaatacggtgcaccgaatactgcggaaactcttgatgttctacccgaacgtgacgaaagtcgcacgcaagcattactggtgcacacacaagaagtatgcctaactagttgataaatggaattgcgtaatgttcatgacagtgctcactagaagagcattgtcttccaaaaccaactagcacagttgataacgaatacaacacgagcagctagcctggtacacttacctcaacgaaagaagaggaaagaggggaggggtagaacacaggtcaaggtgaaacaatctagaactatgaacatttaaagaaaagaacaatcctaatagaacactcatcatgaattgagggggagagctcctagcctatttgcatggctatggacaaagaatctcctatgctatatcggatcggccctaaaattgatgtcaggatagtaaataattgccatagctgtcgagcaagaagctcactatgaagttaattgaatccgaagtaccaggatacctcgttgaatcaatatacttcgtcatcacttgttgcaatttttcaatagagcattgcatcgaaaaatgatccttgcccaagtagagcacacattttccctgcaatagagaattatttccagtataaaatagcatatttaaggcatttactattttgtcgctcctttctagcacatagttataatgctttgaattttgtgtagcgtccaaacataaaagagaaaaacaatgaattgtggtctgcataaccacaaataacactttaagagaaagagtatttccagacccatagaactggaaatattatgaccgttgctagcagcaacaactgaatttgtcggcctagaaagtgccatggtcatattccctatggaacaaatgatgcactttatagaagcatctattgtccgtcaaccccgttgaactttctaaaagtgtgacgatttgggctacacccttttagcaatggattttcagccattttcggtcttagaattataagaataaatattacaactcatatggttatagcacatatatgcataattttcccaaatcatgaagatttgtgtgccagtatgcaccgacaggagattagtgcataaaccgcatatagttctagcattcctgaactggattgcgaggaatatctgcggctcccgtttggtactgtatggatatatgcgcttccgaagcagcaaacatccagtgtctcatagacaccgtgtctttgccaagactgatccagcaagatcacgtgaactccaatagaactcaccaaatcatcctcagaagtccgcaaggacaatgctagcattacatttgatgattggtgaattggcagcacgaagtaccaaatatccgcataggcggactaagta

SEQ ID NO: 10332 - DNA, 1501 bp, Oryza sativa
tatttgctgctgcaacaatcaaatcataggtaactaattactcttttcgattcatagtattgtcgtttgaccttttttcttgttaaacatatttaagtttaaccaagtttataggcaaatatagtagtatttgcaatacaaaacaaacatgttatcaaaatatatttaatgttaaatttaatatataaaactaatttagtgctgtagatgttgctttttttctactccatccatcccaaaatataaatttttttagcatagtgacaagtcaaatatttttaactttgactattaataaaaaaccaattaaaaaagatcaatcaagtaaaattgatgctactatatttattattaaacaatctatcagaatatgcaacttttttaaaaaatatcttacttttatagatattattagtcaaagtagcatcttgagtccaaatatgcttatattttagacaaaggaattataaatttagccaaatataaaaaacttttactaagaaaaaagtcaaactgacatgaaacatgagcgagtaactatatgaaacatgagcaactaattaagttgctcgtcaattacttcttcctcccatgtaaatatttggcttttaccccatagagtcagtcaaacttttatatttctggcatcgataatttctcaaacgcttactttacggacaaaacaatagtagcaaacatatactctttgtctaaaaaaatactattatatataattgcataaatttattgtattttgcaagcttgttctagtatatataacttaatttatgtatacacactactgttataatttatattaaatataattttgttatatttaatagaacgcatatgctatcgtatataatattatattctcatgatagtatatatatgagtaaatacattgcattgacttactggagcaccgtggttgtcgcaggatgacggaggagaggcaccggcggcagcgtcgccgccggagttctccttctggatcagctcgtcttctagggctccggcggcgtggtcggcggcggacttctcgcccgcggccgcgttgtgcttgagactgcggctaccgttgctgccgcccaggaatggagaagaacaggctagacgaatcgcgctgccggcgccagggacggggaggcggtgagcgtgagccgggcggcggcggcggcgagcgtgcacaagctgctgcttgccggcgccggcggccaccgtcgagacgtcgaggcgagcgagcgccgggcgggccgccatggatgagctagctagctagttcgctatggctgctcagcaactatgagaagcgctctatttatagcctgcctgcatgtcgttaaacaacaacgactagattaattaatttgcatgttgtatatatatgtttaacttgaaagtttggcaccgtaaaaagtaaattataggtcccggcctatatcttttcgtttagacatatttaaatgtatatataggtatcttaatggtaatctcg

SEQ ID NO: 10333 - DNA, 1501 bp, Oryza sativa
tggcgggtaaacgggcacgcccccgagcataagacacccgcgggcaatgggcatgggcaaccatccttacccgtcatgtagtaatgggtatacccacgggcacaaataatctcacgggcatgggtatgggtaggcactacccgtgcccgtcgcgcccgattgccatccctactctctcgttgtctcgtttactctctctctctcctgcctttatccatctctctgtgtcgccggcgagatccaccgcacctctctcctgtctttctccgactctctctatgtcccggccagatccaccatggctccacgccgtcgttgctgctgccgttgatccgtcctctctctccttgttgctgctggatggtgcttcctcgatggcgcagttcagtgacaagccgattggagcaacctcgctcctcctcatttggatccagccaccggcacggccacatcaccggttcctctgccgctctatctcctccatctccctgtgctcgcccttcccaacgagggcacggcgactcgaagtgacggcggcggcgactcagtcttctcctcctgccatcggcaactacctcaacgggcaatgacgggcgacctggccgatagaaccatcggcgtcgaggtcgggggacgctagatctagtcacctccgacctccatggtgacgtgctgatctctactctactttcccccggtggcttggccggtggatccatcagtgtgtaggtcagagacgggcggatctgggaggtgagatggtgacgccgccccctctcgttcatccttccacaccaaaagcaggagcagtatctggtaatgataatgaattactcttgtgattttttgatgttaattcatgattttttttctttttatattgaggatttgcatgtgttgttcatatggtaaaataaggatatggagattattgtttgttgttcatatattcatcttcaatttggggatttggggcattgtattggggaatctggggctttcaaagactcaatgaacaaaatcgatttatctttctcgctgggttttctacccgattggattttatatccatctttgaatttgtgctttatctgtcttacaggatgtgttacgggagcgtgtgggaaaagaggccatagctcaatcggacttgcagacgagaattggtgtgacgaacggaaagttatcaattttttaagtagttaagataatatttataatcgtacttactattgtatgtacggagtacttatgtacatacggagttctttttccagcccataggaaggtactaatttttagaaatagtatatctaatctaatggtctaaaatattgggtccactgatttaagtgaaaatcgacggtgagagtggacagtgtcatgtggtgttatagaagtatttataggaacgccacgtgacggtttaagagcgtttgtagaaagtttaatagatttttagatagatagatagatagatagatagatagatagatagaaa

SEQ ID NO: 10334 - DNA, 1501 bp, Oryza sativa; identical to SEQ ID NO: 337

SEQ ID NO: 10335 - DNA, 707 bp, Oryza sativa
aagttttcactacatatgtggtttttactacatattttccctacttaaaggattataaaaaataaacgattaaatgatcaggatcgatatgtcttaattagaataataggaggcatatatgttttttttttgacgagaaaccgcagtagtggctcctactgtggtaataatattaaataaaggaaagttatttacaaagaaacaaaataaaagaaaatatgctacatgattaaagcatcaatgtgtctagccatgattgaaaggaggcatatatgttgatctttacctcttcagtttctgaagtttaaacttaagatccggtgtacttgactcttacaagtcttaacttatgtgtcaattctatgtcacactcaaacgcatgtatcagttctacataggtactgctatccaccaatcattgaggcaagaatattattatatactaaaagtccattgaacaacatataaattctcctaagctgccacatggcactcctaagctgccacatggcactgctacaaataattttaagccaccacatcgtgctgtaataaattagagaaaaaccaaaaaagttctaacaaaaaaagaaaacatctgacgattgatttatagttaacattttatttttaacaattagattggatctgttaaactaatcacaccctcctaatctctacaaacgctcctaaggcaacacacctga

SEQ ID NO: 10336 - DNA, 1501 bp, Oryza sativa
ggctgatctaaagtcgtagttgggcggagagcatgagcttgagtcaaggatgacttcaattcaaacaatgggaggataataaggacatctctaccatggatactgttgacagtcattgtcgaccagtttcgaccgtcaatattacccaattaatgaacactagctatgcttgcaatgcattattccataaataaaatattctattccactatatgcttggaaaattaaccatgcaggagaagctatcaaaatggaggagaatcgacagtacaacaatcgatcaatcaaacggacgctgtcgagaatcagacttatggatggatgggccaagaactcggaaatgagcaatcattctgagccaaaacattgtgtaccataaagtggggcccacatgtcagcatcctgaagaaggctgtgggccaggggagccagctaaggttcggcggaacccctggttcgtccgaacccccagctggcccaatcctgcccatcttcggccaggcggttactaccggcatcctatgacggttggagctaattctacctgaagaaaacatcgtggacacatggcaagaagagatgaaatatgctctttggatgcttcatcatgccacatgtcatgacgagagcaaagatgctcctaggatgcttgaagcatctccacactcccaaggcacctctccacctataaataccccacctctcattcattccctcacacaccttaagaagaagatcatgagctctcccaagttagtttagtagttctagtgctagtggagtaggaaataaaatagtcttcatagtcctcaagtcttcagttgatttctggtatggctctagtagcttccctctcttcttttgtaagacttattgaattaatagaatattcttctttatacaagttcggtattttattccattcatattacttgagtaccgactttactttatactcgaatcaatatagtcatgtaactagctttccagataggtgtattggtgtgggtttagtgtccgagtatccggttgctctatgtcggttgcaaggatgtagagtagtatttagtaatgtaagcgcggtgcttagattattagataccattaattggggtaatatacagtggttcagaggctggccgctaatggtgacgactcagtacgggtgccctctgcatgagtatattatcctaagtgcaatttcctggggagggtactcctccgtatttagccccggttgtatggccatgacaggttgtcgtatggaactcggcaactaggggtggtctctcgagaggacactgggtacggggtattggttgcatgagtgtataatagcaagtatagactaaagatgtatgtatactagaagtacaggaatgatacttttcttgttctttctctacttagcttagactgtattttagtgagagtagttcttagttctttcttctgtgtgtcaccctaccctttgaagtgaattaacccatgcatagacttt

SEQ ID NO: 10337 - DNA, 1501 bp, Oryza sativa
aagatgagagaaaccccagaacccttttgtggctgattttacccctaaacgattggaaaaggttcgctttacaccttaatatcatttctcttattttactctttatacaagttgtattttaagttcaaattagttatagccataaacggtactgttatcaaagttgaaaaatggtactattaccagtaaagttttgtatttaaatcagtcttaagtgcttttaacctacgtaaacagtgagaaaaaaaatcaaaaataaaatgttgacacataagtatagagaaggaaaaatagtgtaagaggagtgaagagtgaaccattttcaatagttcgggagtgaaatgagaaaaagaatggtttagagggttaagtggtccagtgaaatagaagtaaggaaatggaatggacttttttttccaaaatataaagcaacttaacaagtaaatttatgtcatagaaaaattgtactgttctttttatattgcgcaaattttgggcatatcttttgtaaacctcgctgatttaaaaaaaaaaatcattataagtcgattgagaaatactttctccgtctcaaaatatataagtattttttagatggttacaagtagcaagaaagtaggtgaaaataattggagaaatattatgattggttgagaagataaagttggtgaagaaattgaatagagaacggttgtgattggtgagacttgagaggatgataagtacagaaatagttttattttgggacaaggcactgtaatagaaataactatattttataattgtgatggtagcaaagttaattttggatcaaatcaattttctctatgccactttatatttatgaacaagtggatcatgagcattgactttccaagatgtgaacaagactgcaataaataacaaacgaattgaaggatcgatcggcccggccgggtcgaaggtagttgccgtataagaatgccctatggcggcatggctcatccatccatcgactagtcattgtacgtagccacaccggtccaacctaagcgagagctaatggaagctctaactagctcgccaaattagctagtcaccatcactatatcttcctctatgtgtaatatgtacttgcaataactaataagaagatttgcctcctaatcagacaactaattagcttgatctgacagcgtgcattctgacgagtcgtacgtgcatcctgacacggcgtcgatcgttcgaatatataaacacagctgcgctctacgccaacaactaactgtccgtgtgcgagttgcgaccttgctggaaaacttgtacctagagctagctgaaggaagcaatatggccaccgtggatggcacaacggcgccgagctccggcggcaagacggcgacggtggcgttggagtcgggcggcggccgctacggtgggccggctccggcgaaatgctccggcgccaacctggccctgagggcgctgctcttcgccgtgtcgctgtccgcgctcgtggtgc

SEQ ID NO: 10338 - DNA, 1501 bp, Oryza sativa
cagaaggacaagctatatgctcaggggctcatcaactcaagcgtgaggattatatctccaatttggacttgttccggatacatgcaacatgaatttgatgatcatgggtctattttctatgctcaaagactagactatttattattccccgtatgggttatcagcctaatacttgcgccagtcggaattcaattgttatatctattttggagtatcccataaaggataatcactcagatcagaagctattcatatgagctacacttggtctatatcacctgaaagatttattactcgagagcatgttacatgcgtaatcctttaaagggtgtcaaaggtatattttttggcctaggcctaatatgtctgcagctcatattttcaggtgtggcctgtcacgttcttttagggacttaggcatctttttgctttggcaaaagtgcgcgtgattatgtgcccaataccttaaaatccttttataccgcagttactcaactttttaggagttggtacaatacattttaaaaggtgccaaacagtaatgctttatatagctccccgctgactttttatataagtcaaggcgctgtttgggttcataaagcaattgattggatacaatatcattgctttttgccacgtaagtgtgcatttttattgaccaatattatggcttaggctgattatatattttggtcattttccaaacgattgataaatccttatgagttcatttactcggattttataccacatatgctatatatttccaggtgtggtgaaaccatgtgtcttttaggggctcaagcacatctgttaaagcagtgtgcgcatggtgtatgcccaatactttggaaatttatttattcacaacatacaagcttctttatagctgttttgctatgtgtattcaatgatgtagtcagctttaggttgcacgcatcatattttacaaagcagtcggtatatcactcgatcatgttattcagggattcacactgcatatgctatatattaatattaagtcacttggttgactacaattatcaaaaccattcagttggtgcatctattaggtacatctattcgatgcacctgactttatttttcagccctccacagtcttcatatttggtaaaagtactcgggaaatcatggcgaagatgattgaagcactcggctttggagtaatctagttcgagagaagattatttttctgactgtgaaggtctcaggggctactgtggagattatgggtaccccatacccacatggcatggttatccgactagtcataggggataacttatatctatggaatatgtaaccgatcatgacttaggtattacgtttccttttatattatggagcggcctaaagtcctgatttgataatattataaaatagatttaggaaaccgataccgtattggttaaggtttctatcttgtaatcctgccccccatcctatataaggtgggcaggaggccctctgaggggca

SEQ ID NO: 10339 - DNA, 1501 bp, Oryza sativa; identical to SEQ ID NO: 9210

SEQ ID NO: 10340 - DNA, 1501 bp, Oryza sativa; identical to SEQ ID NO: 2703

SEQ ID NO: 10341 - DNA, 1501 bp, Oryza sativa
ggatgcaaagaaaaaatgaacacgttcaatcgctgacgttgccgtctcctgatcatcggagcaccagcgccctcctcttgtttcatggaagaagaaaaaagaatgagtagagaaggagagagaataggaaaaaaatattccctgacaggtggatcctagcatgggagtgaggctcgattgggttcatggggtaaaactatactttcatagttgtttctttctccaattcctctgaatataataaaatagtcccatgggtgtctaacagctaattaccacctttttacagtatactatagcataaacgcgtttttgcggtgtccctagttaattacacttttttggatgtcctgtaacaaattttgcggactatatatatagagggatgttatgccttcgcaacgatacaaactgattaagtagaataccttgactaggatgctgatattattttttaggtgatattataatgtaatttctattcatagaaaagcatgggtactcagctagcttgctagtatcgtgtaaattgtacaactggacatgattgtttgattggtgctgtgcatgactgcatagctctattcatcgaaattaagaattcaacttgcatatctctcgccaactactggcccatgcttgcatgcaaatccatccatgaaaaccaagcaattatcacccatgcatcatgcacgcaactatctataccaagcaagcgtactatagttcagctataaatagcagatgacaccccaagcaaaaatcaacccaaagcgacacgagctagatagcagccaagaccacttattcactgagtaacactagctcattcgatcccagacaccaatggcttccaaggtcatcgctcccttccttgcccttagcctcctcctcttcgccgtcattgtgcagggttgcacacccaactgctccggcgagcaggtcgtcccgactccacccattgcagtcccgacgccatcacaccatggtgggcacggtgagcacggccgttgcccgatcaacaccttgaagctgagagtgtgcgccaacgtgctaaacgggctggtcgatgcgaagatcggacatggcaccgacgattgctgctcgctgctatctgggatcgccgatctcgacgctgccgtctgcctctgcacggccgttaaagcgaatgtgcttggcattagggtgaacctccccgtcgatctcagcatcatgctcaacaagtgcggcaagacctgcccgtccgatttcacttgctgagctgagctgcatgattataatgttctggagtttaatttcgtgtgatttttggttgtcgattgagcctttttttcatgattccgcgtgaataagtcttgtttcttttggcaaattgatgtgcggatctatcatccattaaattactttaattcaattgttgtaagttgatttttttttgagattgtaatatgtaaaacccattatatatattgttatctggagataattgtggcttatatgt

SEQ ID NO: 10342 - DNA, 1501 bp, Oryza sativa; identical to SEQ ID NO: 9208

SEQ ID NO: 10343 - DNA, 1501 bp, Oryza sativa
atacaatataatataatcttatgattatgtgccttgttgtttgtttggttataaaggaaaggatgatcttatagtagatctagtggttgcaatgcagtgtggaccatcttattctcagggctaagttttagtaaccccttcacgctgggctggaatggcaatccaaccaacgggattgcatagtttggcctaaacgagagtacatagtttggcccatgtactgtgggccattttgactaaattcaatcggtcatattacatttcaagaatttcagcgtcgccattgcttaggtgcaaggtccatattggtatacgtgacacaatttgaggacatcatcatatcaaatacagatctattttcatgctttcgtgggtgacatagcaaacatataagccacaattatctccagataacaatatatataatgggttttacatattacaatctcaaaaaaaaatcaacttacaacaattgaattaaagtaatttaatggatgatagatccgcacatcaatttgccaaaagaaacaagacttattcacgcggaatcatgaaaaaaaggctcaatcgacaaccaaaaatcacacgaaattaaactccagaacattataatcatgcagctcagctcagcaagtgaaatcggacgggcaggtcttgccgcacttgttgagcatgatgctgagatcgacggggaggttcaccctaatgccaagcacattcgctttaacggccgtgcagaggcagacggcagcgtcgagatcggcgatcccagatagcagcgagcagcaatcgtcggtgccatgtccgatcttcgcatcgaccagcccgtttagcacgttggcgcacactctcagcttcaaggtgttgatcgggcaacggccgtgctcaccgtgcccaccatggtgtgatggcgtcgggactgcaatgggtggagtcgggacgacctgctcgccggagcagttgggtgtgcaaccctgcacaatgacggcgaagaggaggaggctaagggcaaggaagggagcgatgaccttggaagccattggtgtctgggatcgaatgagctagtgttactcagtgaataagtggtcttggctgctatctagctcgtgtcgctttgggttgatttttgcttggggtgtcatctgctatttatagctgaactatagtacgcttgcttggtatagatagttgcgtgcatgatgcatgggtgataattgcttggttttcatggatggatttgcatgcaagcatgggccagtagttggcgagagatatgcaagttgaattcttaatttcgatgaatagagctatgcagtcatgcacagcaccaatcaaacaatcatgtccagttgtacaatttacacgatactagcaagctagctgagtacccatgcttttctatgaatagaaattacattataatatcacctaaaaaataatatcagcatcctagtcaaggtattctacttaatcagtttgtatcgttgcgaaggcataacat

SEQ ID NO: 10344 - DNA, 1427 bp, Oryza sativa
gccgcccacctcaccgtctccacgcccgacttcgacaccgcggcgggagccctcttcgcgcgccacggctgccgcatgcgtcacgcggttgaggagggtggggccgccacgctcgttttcgacgaggcgacgaggccgatgccgtgtcgcccgccgccgtattgtcgctgccgttcctctgcctcgtgggcggtggccggtgggggagcccgcgcgccgcttctccccccaccgtctgcgcgctgctcctcgccgccctgcgcgccacccctccccgccgaccatccgcgcgctgctcctcagcgcccacgcgccgcctctccccgccgcccgctcgcccgtagctcctccccccaccgctgtcgcgtcgcccatggccgccatcaccgccgtcgcgtcgtccgtcgccggccgccgacgcccttcttctcccgccggttgaggaagggagagaagaggggaaaagggagagggatgaggctgatgtggtagcctgacatgtggggcccacgtgggtgccacgctgactcagccaccacgtagaacaaaaccgggtcattaccaccaaaggactatttgtgaccggttttggttagttaagggacgttggataccaggttttgtggttgggggacgattttgtaactcgatgacaagttgagggaccttcggtatactttttcctatatgcaaactagtaaaaaagaacatggagccatttatcccacttggatcagatattagccctaaacactagacaaagcctaaagaggtgttgatgtgaaatttcatcgtgacacatgaagacctcggagatcttcttagctctaatgcaggtcctaaactttgatgagatacaaacgtgtcagttactttgattctataactgacaagaagtaaagctgatcggcaaaaaagccgatgtctatcaaacaatgccttggtcctactgaccgatccaaaagatacgtgtcagctgatagccgatagcttgatgtagaatcggctgaagatccaatgttaaatccaaatgattaaataatcaataaaacttttactactatcagctaaaaccaacttgtatataatccttataagccgatgcaacacttaaacaatatccagatgactcatcgactaaaaccccgataaaacaatgattgatgcctactgacttaaataaatctaacttacgaaagcaatcgcataggtcgaatccaacctatcgatgttgtatatcacgactatggtatttgcatggtatggggatcgttgatactaggatatatgcaagattgagataaaagagacagagacaagtatttttatacaggttcgggccccttatccgcaaggtaatagccctactcctattggccgaagccagtgttgctcttattcatcagaatcacacgagtacaatattt

SEQ ID NO: 10345 - DNA, 1501 bp, Oryza sativa
ccatgtgtggggcccaagcccaggttgccccacacgtggctccgcccctgggattttttttttggacggagggagtacaaattcaagtaaataaaaacgattactaaagtcatagtagtaaatgattattagtattctttgacattgaatagtagtaatgttattgtgttaactttgtgcgttgtatcaattttcgcataagttgtacggcaattgattatcgcactattaaatattgataattgttttctaacattgtaaaacaaagaatatatcataaatatctatgaatccgatgattgtaattacttttatatttttctcactttttcctagcattagtttcaatagcagtcacactttttttttatgaatgtcgtcgctataaataagactctcaccacatagtaccttgcccactccgactaagccttcacatttcttctctagcgttacgctgtcccttctctcggtgattcctcgatctctcaggctacgttttgatggcttactgcatccgccactctccgggccgttgccagtgctatccgtcgccacctaccaccttacaacggtaagcagatctctctatgccttgccgttattctcaatccccggaggtgccccttttgaacatagctcaactctcaggtcatcgtcggcgacccacacaggcaacttccatcgaatggatgaaagccctcgagtcacgacggcgcctcctcctcagcggcataccaacaacagcagatctatagtggttatactcaaatcagaatctccgataaccggctatgtgtaagttcattccagatctattcattttgcgattcaccctagatctagagtcttctgcaacctttaagctcaaaagtgttagatccacaaatgtgtactctatccgcccgaaaatattataacctttgagtggatgggacactttctgctactacgaatctggacatgtgtttgtccagattcacagtattaggatgtgtcccatccactcaaatactgctatattttaggacgaatgaaaattatggtttatctaaatcagccttccttttttttttcttttttacaaccataggttgggcttgcccaatccaaattctatactgccagggactgtaagggaaaacgggcagggcatggtgctgcaaataaacattcccccaggtaccccgacgaaaaaaaccccaactttttatttcctgccgttttctttttctttttctttccttttccttttttattctcgtctagtattatttttgcctaatatttctggtggacggacacggagcagatagccagcaggagtccgtcgccgttggtgggaacgagacggttgccgcgcccgcgcgcgagatcggagctccggggaggcgaggcgcaggcgcaggtgggcgcgtgttcttcgtcgggggcaccccgttcgcgctctaccgggagggatccgcggggcggggagtggtggggaacgccgcgagcgcag

SEQ ID NO: 10346 - DNA, 1501 bp, Oryza sativa
gctttactttttgcaaaaatagtgcataggcgtacctttgtgctaatgtttttttcataattgtcatacggataagtctgtacaagacataccaaatcggccttcgtcaaaacgacgtcatcaatatggattatcgtctcagtaggctttgcacacaatatacgcaacgcaatgcgtgtttcgtccgtagtgcaaacaaaatcgaagtcatcattaccgtctaccaagcatcttttgtaacaatcaaatttcttgttacttacaacggccctaccattgactcctcgaaccctctttcctatagtgctaggatactcgacctcgatgtatcttttccttggaaaatgttgttctccatgcgttatatcctgcacaaaagaaagatatgtgtcaaagcattttgccatgtggaaaaaacaaacataaatgttcagaaaatgtaccgtgacttgctgtaattgtagctgttgaatgtgttcaacgtttgtcattctatcattcatattttcctgaaattcagtgttatcatgggccatctttatcaacatcttttgcgtttcacaaatttggctcgaaaggtcccccagtgaaagcaaaatctgtgtttgcaatccagagacctgaacaaataaaaacattaatttattattcatgcacaaaaccagaaaacaaacattcatttattcccgtatacaaaatcacgtactaaaaaaacaatcacaatcatttgcttcatattgtcagtacgtcattatagcttccggctaatatggtggatacaacacagaggtgctagacatggatttgcaatgttatataattgactagtttatgattaaaaaatggatatagaggacgtagcagcctcacagacaaaacaccatggcgagatgtcccaagaaatatgggcctgctacatgggataatacaggcaacagtttaaaggggtcaggtttaactcatactgcagcaccatacacttttgttacccaacatatagctgattttcccacctaacagagcgtatatagaatcaattttttagtaatgctaaagctcccataacagaacttggcagcaagttgaaatgctaaagctccccctggtacatgtacaagctccaactttgagagatctggatccttggattcagctaccattcttcgtattgttccacacatacatactagagggaactgcaaaaacaggacagaagtatactatgattatacccattttgcaactgtactttagtatataaaatctgttattaatcttgcagagataaatatgaaatacatttacaaccttaaccctgattttcccgtgaaccaattaatgctttgtctccaattacgcactcttatattgactaacaccttcatcctatatgttcagaaatccctgtcgagccaaacccccaccccacccccactaagaaagatatagtacaaaaaaaaatatgcttgcataattatcacatcagcaagaatatagtaca

SEQ ID NO: 10347 - DNA, 1501 bp, Oryza sativa
ttatatgtctaagaaataatttagtcaaatctaaaagtacttatatatatgataaaagtaacttaaatatataataaaagtaatttacaaatataaatattttttcatcgtaacataatcatgtaagatcttgttgtgaagatttaattgtaacgaatataatggtgtaatcggattatagataggataagtaatttgagagaaaaactttgtttgaagagaaaattaacatgggggagaaactgtagcctttctctttgtgactctctctctctcaaacaggaattacgtgtgcgtgtggttggagtggtttcatctcgattcttattcagaaatgcccacgcagatggactccatgatgacgcgagcgatcggatggctctgccagcgtcgcacgatagcgctaaaacgagagggctctcgaattagattttacgcacttcatagggttgtgccttttgtagtgaatttcttgatccttgtgaccaagtcacatcatgtggcattgtgatcttttggtcgatttatattgtttagattagatgtgaggttttggaatatgcctttatgaattctctttgtatgtgtttgatgaatgtattgaaattcggagtaatttactacttgctgaaatctgcagtgaattgctaccgacagatgaaattattaatggaaattgatcctgttttggaagggtgtcagcagaagtactatttctccacatatcatctgtcatgaaagattcatctgtgggttaaggtctgcctgtcggacaaggattatctattggtaaagctctagatatcatagtcagacaatatgtcggtaaacggtatgtctgtcgtgaaagcccttcgctggctgagtgttttcagctacaaacacaatctgccgggaaaggtctctacccactgatggtgtgacgctgtagggacctttgacgacagatggactgccgctacatttaggacatggtgtggtgacatggaagctagagaatgtgatcggccggattgtgcgatccatgcatggcagctgtgataaggaaggaatgaaactgagttccttttggccaacagaggtttttgcagtataataaatcaatgcggctatagtttatttccttatgccctccatccctattacaatttcgatcaccgaaaaccgcatgttgatttatgttgtatggctgataggaagggaacaaagaaccttgtgagcacttggggtatatatatagatcacctccggatatgggtgcaatggtggtagttggccatatgaactttaaaatagtatcagagagttgaccatgtagaacagataaatagcatgttggcctcatcagaggtccacacatgttttgaagtactaatagtaagtttgaaaacagtacaatattttactagagtaagtagtaatatcataaacagactataaatatcatatgaagcacggaaaaataacatagtttcaatttgttagagaaaaaaagtcatac

SEQ ID NO: 10348 - DNA, 1501 bp, Oryza sativa
tatggctcatttactacatttgtattttttttctagcttggtacaaatttaatgcttattagcttaatccttggtatggttcgtgttggtggacattgagcgcatctccttcagacacatgcttggacgctttacagacgattaggagttggcagacgcgttagagcaaggcgcttgggatgcctaaagattctaacttcgtggtgttgagatttaatctgtttcatgaattcttctgttttgattggatgttaagttgtgtttttgctgtttcatggttttatcaacgagtttgaactggtacatggtacatagttgttgaatagtcccacattggttgtgtaagggtaagcgacctaataaataattgtgggagcccctcacctcattagctagctttttagggtggggaaggccctttacgatcctacaattgttattagagcctaactagttcaacatctctggcccgagagacatagtgtgtaaaggcctgatggaccgtgggtgcctgcaagccccgtataccttagggaccgtggggaaacggtgaagggctgagggacactaatgtgtgtgaaggggagattgttgaatggttccatattggttgtagaaggactagagacctaatatataattgggggagcctctcgcctcattggccagttatcatcctacaataatattgtttggtccacatgaaaaagtacaaggcggaatttttcatatagtcttaaaatacgtttttattacaaagatcaggggcggacacatggtgcgacatgggggtacagttgtacccccaaattttttggtaaaaaaaattatatataatatatatacaatacttgggccaaaataccagtaggagcaatcttaattggtggcccaatagcccacaaagaaaccctatcccagtatcccctccctctctgcctcggcaccacccacacggcgtatcgcttctaaaaaaaagaaaaagaaagcgcgagttcgagctgagggccatgaggagcggtggcggtggccgagcaactcgccgcgggcagggaacagggccccggcgtgccgcgccagcgctaccgcggagctcctgcgatgctccacctccgaggtgggacggcccctctgatccggctcctcctctcgccccttctctcacgcccaaccctaacccggctatggcgcccttgttgccggcgcctctcttgctgccgctggtgccacatccgagggagcaagagcagcaggagaatgctgaggaaggagaagaacagaggccgaggccgacgccgacaaccatggaaaagaaggtcagtaaattagtgtctttgtagtttgtattttaatcttgtcctccaattgattgggaaaaattaagaattgagcgattgattgatttgttacacacataattttgtgatttaggttgtagagccttcaaagaagaagaaatttgtggatttgaaatcaatgtggggtagagctgaaaagaaac

SEQ ID NO: 10349 - DNA, 1501 bp, Oryza sativa
aactaaacacccccttaatccaaattttcaagttatataatattgaacggagggagtatatttttaaagtcaaattgttaatccagatagattagtataatttgaatgttttcgatttatggataatgttaattactcatggatggaggatttttcgttcggcgcctaaacctaccgccaatgacagccccaaaacattccattgccgcccatttgcccaaatcagaatgggaaatgtcacttttatcctccatctaacgaagagcaaaacaacacccaggggcatttgtgcaaccactatatatttacaaagcctctcacccaccaaaccctaatccccaaatccagccgccacaccatcggggcgccactctaccagagccgccgccgactaccgccgcaccggagccttcccccgcaaccccgtcgacgacgaccgctgcgccggagccttcccgtgcaaaccgatcgacgacgaccgctgcaccagatccgtcccctacttcctcgtcgtcgacagccgccgcaacgacgccttccgctgcaaccccgtcgacgacgaccgctgcactagatccttcccccactacgccgtcgatgacttccgctgcatcggagccggtaccccgtcgacgactactgccgcaccgaagccatctcccacaacaccgtcgacgcctaccgccgcaccggagccgggtaccccatcgacaaggtccctgcaccgtcgccgtacctagccgatgggaagacgtcgacgtccagtagcacgaggtacgcaaaattatcttgttgtctcaagctcagatgtttatgtgtactgtctcaagctattagatgttatacatcatgtggattgatttgccgtccaacttctattaagaattttctgtgtgcaatccgattgaggtcactatctacaataacagttgatgctattgctagtttgctactgcatatggcattgtttctgtgttattcaggcgcacctttaaattaatcatgctatgttgattctcaaataaatttgtgcctcaagttgccataagcatcttccagagtgtggatttcagatcaacaatggaaattttatttagattctgctttgtttgtgtttatgaatgtaccaataatttgagttagtcgtatatatagatacagtttattaggtgaaagagaatgatataatggctatatcatttatatgaccaatgttgttcactgtaaaagtgtttccagagttctcatcaaaattgtcttttaaaatggaaaagtgaatcaccctgttgtttttactagatattgaagtaaagttgtttttcaccattgatcattaaatccccaatgttgatgagcatggtctctttttttttcatcccaaatgcctagatactttattgtttctatttctgaaaatgcttatatgcttaggaaatgccatcaaaatgccatctagtattctgaccattaaaatatgtgtattcatgtaagaacctacaca

SEQ ID NO: 10350 - DNA, 1501 bp, Oryza sativa
acagagacgaacgaccatgtaagatctggttatgtaagagttctcaccgagcatattaaccaagctgtgtaatcggaaattgggttttccaaattcactgttgggggctactgtaagcgctttttcaaccaaggcaggtcaagggtccaagagccttatccttcgagaacgattctccgatgacaaggctgggggctagggagagtgtatgactcaacaaattgactgatcgaagtccataaaagagaagatgctcgtacacaaaacattggtctgtaaatttttatttattttagttttccatacatattataacatgtcaccctttgagcgttcgcttaggggctatttctatctaatattcttttctaagtattgatttcaggaaaattctattcgacattcttgaagactccatgtctctatggttctacaccaagatcgactaaggcgagtacgacaaatgttgacaaggcttcgtcatagattctacgccttctcgatcgctcgagaacggttggtggatctcgacaaggaatacggaatgaagagatggtgtacccgccgagataaaatttcttgacttcaatccaaattctcgattacagcaagacggaagacttagtcgtatgctctgtaccttcttggttgacatcagagattgactcagacaaaccctatacgatgcccgcacgaggcagataagggaagtctaacgttatctccgaactcaccgagaacggtcacgtgagctcgacaacagttattccaaggtctttggattgagaatatgaacttgttaatttgcattgaagtcgtgggctactgtcagggttatggataccacatagctgggaaccggctcatctgacgttgtggaggaacgtcacagcgtaacgtagccgaggcaatccaccgtccaatctaatccaacgcctctctgctcattgctctgtttgttaacttaattagtgttttggagggaaaataaacatggtaactatgtttgccgccaaaatcacagatcgcttccccttctcttatgtgctcctcctaacagaaccttgaattgacaaggtttggttctaatcattactctgcatctctgccacaagcccataacatctcgcctcattcatatcctgaaatcctgattggtggagacaagctgcaaattccgatggaaaaccagatcaatgctgattaaaaccaggagggaaatcataatggtgactagttcgattatgcttcacaataatgttgatttcatcacctgtttactcgtataataaagatcaaaatgatccggtagataaaatcataatggtatatactctgaacaacatattatttggagcatgggttcagagagcatgaaccggcagtgaagtgcaacatatatactagtccgtagtcatacaataaacatatctttgaaaattattatgcatcaatagtttttttttctgtgtgttttcgcagagcaaatcccatacctagt

SEQ ID NO: 10351 - DNA, 836 bp, Oryza sativa
atattgttcaatattattaatctatagcattctagattatgtttagcaaaaaatatcttttttagttcttaaacctagtcaagtaacttcagtgttgtgtaagacggaatatggttgtcggacggaaaaggtagcgttcaccgattaatcggaatacggacaattaattggaattatacggaaatttaacattcatgaatatatgtacaaattttataacattatatacgatttagatgtgtacaactatataaatcaaatatgttcatgttgtttttttaattaaatagataagtaaaatattaactcttttaacacaagatttatatatcacatggtggtagaattggttgcattaaataagtaaaacataaaaatatatgttacaaaacaaaaaaaatctaaattaagtaaaaaaactacgctaaattatcatcaaatacaatatacaaacgattatttggatgattaaatggaaaaggaccaactaatcgttaaaaacaaagttttaacattcatgaacgataaatgtacaccgtatcacgttaacgaactgttatactaccgttaacgtatatacggccaattaatcgatcggtacgaccgttttccacgatactgagtaccttatataaatacaacaaaaataataataattatttactcatgtaaaaacaaagataatatatattacggaggacacacatgagctagctactagtattcatgtgcaagtaatagtgctgattttagcaatattattatcgaaaataatgaaggacgagaaaacaagaagatggaacaaaggaagaatataatctttctctagaggaaca

SEQ ID NO: 10352 - DNA, 693 bp, Oryza sativa
attactagattatagtaatcgggcttatagattataataatctatcataataggctatatatatatatatatatatatatatgtgtgttcaagcttatttctaataatccggattataataatgctaaggtaaatcaaacatggccttacattagtcttgttttttgacggaagagggtagagggtgctctgttagatttaatggggtaattgatccatttaaatcaattaaatcaaataaattccaaggctcattatactaggaattcatgggtatttattcttttatgggatatcaataggatgaagagttttgagaattaatccatttgattagggaattggtaacttatatcaattagtcctaattgatggatggttgatggttgtatagtggaggatggttcatggctagttgatgacaattagttgctctattcttctttctattccattggtaacttacatcaattactcctaattgattgttggttgatggttgtgtagtggaggatggttgatggctaattgatgagaattagttactctattcctcttcctattccatgactcttactcttcatattccattcctcttataaaatgagaatgaatttgatctccagcgagagaagtgagacacactttcatccattttccaacgttgttgctgctacggtaatcccatcccga

SEQ ID NO: 10353 - DNA, 442 bp, Oryza sativa
ttgcacggcgcgggagcaatggggagcacgagggagttcggcgagatggggaaaaagcgagagggagcgacggggaagcctaaataggggaggggagccctagacgtggccggtaggggcgggattttgccggccaacgtggggagtgggggaggagagagagtcgggattcgaaaatcgaatcccggccatctcgggcgcgggcgcgggcgggagagagagaggagaagtgggtgcggttgatgaggcgcacgcgcgggcgtggctgacgtggcccggaggaggcggaggcgtggacgcggcggcggttgcgggcgcgccggcgccgactggaggaaggagacgggcccaacaggtggggcccacctgtcggcgtcccggggagagagggagggcggcttgggccggcccacaaggaggagggcgcgcgcggcggggtggt

SEQ ID NO: 10354 - DNA, 1501 bp, Oryza sativa
tactagaaaaaaaatacccgtgtgttgcaacgggtaaatactatgctagaatagggtaggatcgggtttatttctctttcttgccacgggaatgacacacgcgataacatgcacatgaatttttgagcaactatagacagaaaattttttgacgcacgtggcaaatattctaacgcaagcaaagccggacaaaaaaaaacaacaggaaaccttacgtattagatatataaattcgatcttatctttttgtgattaagaatttagattgtttatttatttttttaggaaaaaaaaggagaattgaaggtgccaagagggggccggggcttgcgctcgcgcttctgggaggggatttctcgcgggtaatgtcgaaacatgaattcggcaataataaaaggggtagcgcacgagacctaaaagtggatggatatggagacaaaggatttagacaggttcaggccctctcaatgagaggtaataccctactcctgtttggagatttgaatccgccgagtgtagtatagatctaacgatcatatgtgctcatgccccctagagggcctcctgcccaccttatataggatgagggcaggattacaagacagaaatcttaaccaatacggcaatattatcaaaccaggacttaaggccgttccgtaatatacagaaaacgtaatacccaagtcatgatctgttacatattccatagatataagttatcccctataactagtcggataaccatgccgtgtgggtatggggtacccataatctccacagtagcccctgagaccttcacagtcaaaaagataatcttctctcgaactagattactccaaagccgagtgcttcaatcatctttgccatggtctcccgagtacttttaccaaatctgaagactgtggagggctgaaaaataaagtcaggtgcatctagtctatgcacctaataggtgtagccctcgactatgtggttaattgaacaaaccaagcatatagtgaaggaataaataatccaaccaaccgagtggtttcgataattgtagtcaaccaagcgacttgatattaatatgtagcatatgcggtgtgaatccctaaataatataaaccaagtgatataccgactgctttaacatgatgcgtacaacctaaagttgactacatcattgaaaatttacatagcaaaaatagctataaagaaccttgtatgctgtgaataaagaatttccaaagtattgggcatatgccatgcgcacactgctttaacagatgtgcttaagtccctaaaagacacatggtttcaccacacccagaaatatatggcatatgtggtgtaaaatccgagtaaataaactcatgaggatttaccaaccgtctggaaaatgaccaaaatatataatcagcctaagccataatattggtcaataaaaatgcacatttacgtggcaaaaagcaatgatattgtatccaatcaattgcttgataaacccaaacagcgccat

SEQ ID NO: 10355 - DNA, 1501 bp, Oryza sativa
ctaggcgtgacaaaaaccctcaaccaattttgaaagattaagaaagattcgatcggatttgatggaaggatcggttttagcatgtacagacacgacattgtctttcggaagttgaagaggacaggctatgcgagccggacctacagctccacttgacgaggaatgaaatgagattttggtccaaaaccaaagagtaaaatatataacgatacaaaaataattttacctgttacaatgcatgagcaatttttctataacaataataagattaaaatatacttcacccgttgcaacgcacgggcattttttctaatctatatctatatctatatatatatctatatctatatctatatctatatctatatctatatatctatatctcgtaaaggaagtcgtttaggacatcgacacggtctccaaaacacaactttgacttcttttttctataaaaatatgtattgaaaagtgatatatgtatacttttatgaaaatattttttaagacaaatctattcatatactttttatattttcaaactaaagaacttgagagttattcatgatttatattctcaaggtttagcttaaacattgttctaaacgacttcctttatgagtatggagggagtacctaatatatctatatctatatatacctaattaaaaaaatacgcaaggcttctgattttattttcgtccgtccccgttttttttcgccccttttctcttttttttggccctttttctcggttttattcctttccgcattcttttcaggggctgggacggttgctgggcccgagcggacacttggatggtggcccaagagagaggagaggaagtggggtggctgctgggcccgaacagagagagggatggtggcccaagatggaggagtggaagcacggctcagggaggaggagggaagaatgggccagatttggcccagttttagaagagggttttagtttgtttgtatttaaaattaattattaaaattatctttgtattattaaaattaacaattcatctttgcaaaattaatataaaatatagagagtgtggttaatcatgaagaatttaattaaaattaaattcaagtaattaaggcttccgggtattattttggtctgtccctttgttttactgtcgttgttttcctttttttttcctttttacgttgaggtcttttttttttcctttttttctcggtgtcaatttcctaatccctcgtctcctaattacctgtggagattatgggtaacccacacggcatggttatccaactagtcatagtggataacttatatctatgaaatatgtaacagatcatgacttgggtattacgtttccttatatattacggaacgacctgaagtcctggtttgataatattgtaaagtagatttaggaaaccgataccgtattggttaaggtttctatcttgtaatcctgtcccccatcctatataagatgggcaagaggccctctagggggta

SEQ ID NO: 10356 - DNA, 819 bp, Oryza sativa
tgtcagggatgaatggattacaaggagatagagaggggggggggaggacagggagggagttcagggtttataagtgttatacatatcttggaacaataataatgataatgacagtaaagaaatgaacatatataaccagttgatggataaatacacaaccccgattcgttatcatcttatccatcatttgagaccaatgttggaaacgaggtattgagcccctacaccacaacagatgataggataggaatatttgtagtatgttggtaaagaaaaggattatctgtaataaagttttagccaagtgtgtgtgtcggtgatatgggaccgggagtatcgtgactagaggcttgaggcagacacaaccgcccacgtggcctggcaccttcggggacgtcgggcccgagggtgaggtgaccgccctcctcctgatttccccgagggaggggtcgggtgactccagcctcgcccccgagggccgaggcgccccgacccctcgcgttttgtactccacgtgtatgggttaggtgagcacagcagggctcacctaaccgcatttattgcgcctcggctaagcgtgtcacgccgcacgaagtgcagtgcagtgctctcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaaga

SEQ ID NO: 10357 - DNA, 763 bp, Oryza sativa
gctattgtgtagttctgtggccccccaatctcctcctccgccgatccgccccctccaagtaccattgccgcatccagtcgccggagcaatttccgatgcgccgccgtcgccgctgctcaatcgccggagtggagcagctccggctacagactcattgcttagcgatgaatgacgagtccctttgacagaaggtagctaggggcctcttgagttagcatttcaagcgattttgtttgatgaaatttgggatctttagatgggagcgtttggaatttctgtaaaattttttttacctagttggaattgtgggcttccaatagctgggacatttttgttgtcactcactgtgaaagtgatctgctagtattagtctagttgggctttgtgaggtttgagttggaagctgttagaaattagagctaaacatgcttcaggtttctggttgatactcctacttgatagttgaaattgagttagagatttgagagttttgaagttcagataaaaccgagtgaagtgctttttagggagcgagttgaaatttcatataaaattcgagtaaaaaaatatttctttcattaaaagatccttatcttggctgtgactgaaaaaggagagggggggggggggggtgagaagtctgagaagatgaggtacaggaagctgccatacaattagcagaggataacaccaaaaacactaccacactattagcattgttcaattatccatcaactcaacctgcttgatcaagcttgaatca

SEQ ID NO: 10358 - DNA, 1501 bp, Oryza sativa
actttgctgctcgctagctctttcttatttttttccctcaataattcagaggcgttatggtgctcttgctctatataaaccctccaagcctctggccgacgatcaagaaccactttgcccacgtacatacaccgacagccatggacaccccggcgttgctcccgttggcgcttgcccttgttgccatcccgatcaccatccttcttgatcttcaatcggatccgcctcggcaggctgtcccccgggccccgggcgtggccggtggtaacctgttcgacatcacgctggtgcggtgccggtgcttcatggagtgggcaggcaagtacggacccatcatgacggtctggctgggcacgtcgccgtcgatcgtggtgtcgacgtcgcagctagccagagaggtgttcaagaacgtacaatgatcagcagctcgccgaccgcccgcggaaccactcggcggagcggttaagccgcggcggcacggacctcatctgggcggactatggcccgcactacgtcaaggtgcggaagctgtgcaacctggagctctttgcgccgcgtcggatggaggctctcaggcccatcagcgaggacgaggtcaatgccatggtagagtccatctacagagccgtcactgctcctggtaggttgtacagcacgatgaatgaatttaatgtgttttgcacgcaacatcatgtgtcttaacaaacgctattattagattgattcataattacatagttgagtgtggcccgtgtaattgcgcggcaagcatccgtataaaatattttgtttacatatatttttctttaaaatttgttaagtagccatatagttatattaggatttcaaaagatcaaattttatcattgtcaagttttttattttataatttttaaatgtcacgttagccgccaatccttttctcctgcccgacctgccacagcttttattatactttaaaaattggatagtttgtctagttcattgtcttgtcgaattttgatttgtagttttggaagtccctttaaacgtcaacattgtactcctctacggtgtactaactttcaacctctttattatcattaggatttatgaaatggaacatgattatagttggattttcgttttctttttacttccaagaagtcctgtcaaccatcaccaccgttctcttttaatttacagcctacccaaaatctttccttctaatcatcctttggtttctaaatattgaatctagtaatcattaggagttttggtttttatttttaatatcccatcaacctctaccaaccctatctttatggtttgtctgatgtcccttttgcatttatggtcacttaccaccgttatgttatagatgtaatatgttctattaaaatatcttatctgttatttataatttatattcctactcaaccctcattttagtttttctaatcacataatttaatttatttttatttctaactttagttaattccgtattgtagtctatatg

SEQ ID NO: 10359 - DNA, 339 bp, Oryza sativa
caagtaaatatccactgcctgattttattatgtgtgtttctcgagttgtagatcaaatttaatcttacatgtttgtctatagactcatagcatcccaatagatgttacttttttttaactttttataactatttaagtcgtatagaaataatggttgccatgatatctagataaaaaacctatccgccctctacttctactttgctgctcgctagctctttcttatttttttccctcaataattcagaggcgttatggtgctcttgctctatataaaccctccaagcctctggccgacgatcaagaaccactttgcccacgtacatacaccgacagcca

SEQ ID NO: 10360 - DNA, 1501 bp, Oryza sativa
acgatgcatatcatagaggatattcaaggaatggttaaaggttctttttgtgtaaagctcattttgtaattcttttcataagcctaagacctagcatagactgatcaggttttaataccattattcattaaacagtaacgcttctgtccaccatccgttgtgatcccaaggatagcttccggccactggaccatcatggttttctagggtctaccctttctcgcttttcgagaagttcatccaccagtacaaaatcatcatgcatatcccacccatcattttaagaatttagattctaggcaagtgtaacacatgtcccggtgctcaatatccacgcgcacagctattcgaatatgttggtttactcacactgtagtggatatacactccacctgtacgccgtgacttgcccaacacatgagccaaagtccgaacgaatgagatgcgtcatggcaaagcctttcaataacctcactttggcagtacccgctccatgaacttgagccctcatgcactctaggcatacatggtttctagtagtgagaggagttctggcgttcccgaggagggaaaaactcacacatgcgttaagttatagttaagttaggttttaatttggttgcccacagatggttacccaccgtaggctccccgcctattcacacacctagatgaaaaccagtgcacttgggtaccacctctgctcggctatttactccgctaggtctatacccatacgagaagtatggttgtactagggtcatttcatgcttagcttcaaggcacggtccttaacagaccaaggacggcactagcctttaccggacaccacccaagtcatccagccactagtctaaaaacatttgtttagtttagatttcctttcacaaaccattttgttcatgttatatcaaagtggcgctcatgtctccacatgccgtatatcaactagcttccccaaagtagatgcccaagcatttaggggctgtttggatgggactaaaaatttagttcctatcatatcggatgcttggatactaattagaagtattaaatgtagattattgacaaaacctattccataaccctagactaattcgtgaaacgaatctattgagcctaattaatccatgacagtaaacttgtgctaattatggattaattagacttaaaaaatttgtcatgtgaattagatctcatttttgtaattagttttgtaagtagtctatgtttaatactccaaattaatgtctaaacatccgataagtccctggatccaaacaccaccatagcatttgataaacatggatgtgcatgaatctaagtggcattgactaagcagttattagatttacgagacacaatattgcggatacaaataattgcagggaatcaacatcaaagtatggtgtgtgtgtatatatatatagcatgcaaattttacttaaatcaacataacttcacaataggtttaacatgctcaaagattagagatgacttg

SEQ ID NO: 10361 - DNA, 536 bp, Oryza sativa
cattttcgtgagataggcgccagttttggggtctatttatatatatatatatatggtttcatacatttccactaaataagttaggtacggcattgttatttctccgaaataggctctttcaaaatagagcaattttacggtccttaagaaggtaccatgaggtaccacttttttctattgtaaatttggtacctcttgatatctatgtactattaggtaccaaattttacactgaatttttttttgtaccttatggtacctcctgaaggaccgtagaattgctcatggtcctcattgctcccatgttacctatttaaagaaagttaatttttgttagaaaaataagttattctaacccaaacatggaataaactttacagttcatatttttttccaaaaaaaatacatgtgaaaatattcaaacttgggtaaaataaaaccaaaccaaatataccattagaactgtagttaaataaacttaaattacaaattaacaccatgggttttaggcttgacattgtgtagtttttggtgaa

SEQ ID NO: 10362 - DNA, 1501 bp, Oryza sativa
cctccctcccctcagcgtattttccatatatttttttcattcttttttttaaaatttgaaagtttttaaatttgagttgaaagtttttaaatatggacttgaaagttttcaatctcgagttgaaagttttcaaatctgacttgaagtttttaaaatttgtcttacaaatttaaatttcgagtttaaaattttcaaagtttaagttgaaattttttaaattttgacttcaaagttcaaatcttaagtcgaaaggtttcaaatctaagttaaaagtttaaatttctaatttaaaatattaaaaaattgaatttagattttcaaattttgagttaaatttttttttttttaaatgagaattttttttcacgtatagatttttttggatgactcctggtcggcgtccgatcaggagagggtaaatcgggcgctgacgtcagcgtccgatttacatgcaaaattactttaaactgatttatctcttaaactacttatccaaatgatgatccgattgcactattaaattcattgcaattaaatcttcaaaacaagaccacgcatggatatatttcgacgaaattttcttttatcttattattgaattatttttaaatgttgcaagatgttccaccagatatatcagaattgtttcactaagtagatcgaaaatgtttcactcgtttaaattgggtgttgtttcaccttatataaaaacaatgtttcagcaaatagcgaaagaatgtttcagttcactgcaacattagatctatacatagtgaaacatttttgagtacactcggtgaaacatttttcggtggaacaaaaaataaaccaaattctcttaataggggtttccaaaatatgtgggttttttgttgcaatggaatgtttcgttcagtgtaacattagatctatacatagtgaaatattatgagtacactaggtgaaacattttgggtggaacaaaaaataaacaaaattcccttaatagagagtttctaaaatatgtgggtttttttttttgcaaaagagtattttaatttactacaacattagatctataaatagtgaaacattgtaaatacattatgtgaaacatcttttgtggaaaaaagaggagcataaataggtgggcctaagtaggcacgtgggggagggggcgcggggggagtgcccgatccggctccctccgcaccgggcgaccggcaaagagcatttccagatttttttagtaaaaaaaattccggagaaaaggaaatattttattaattaccgtcattaacctaaactaattgagttagttacgtcctctggaatcgctaatcgagttaaatggagtcgcgcgctagcggcgcgtacgcgcgcgttagctttccgaatctggcctggtgtatggagtcccgaacaggcccataaattggcgttcggagcccaaaacctctcgcatttccagcccatcaagtcgcttcgtcctgggcttagcccaccacgtctctttctcagt

SEQ ID NO: 10363 - DNA, 1501 bp, Oryza sativa
aaggataactggagctaagccttgacttgaactgcagcgggaacaccactctacatgcatcctcgacggcacggacgaagcctactcctcggaaaagccaccatctgacgcatactcaaactctggggttttggggaaaatagagcaagactgagtacaaccaccgtactcagcaagtcataccggaataggggtatgatgcagggtataatcaaaggatagctagagcggttcatttgcataaagcgagcatttataaacagtagttgaaagcagtaaaacagttgtaataattaatcaatattaaccatccactgtccaacgctacaccacgttgcaacaggcccaaccatccacctgaactaatcaattccattagactaaactagggtgagactaatcacggcgaatctggttgatcgcccataactgcgggcacggctattcgaatagttctactctaatcagaggtgtataactgtacccacaagacacagccccacgacacgtttttgtgcgctgacatgccaccacgacagaccggaaagaggccgtgacaggacccttcgcataaccccctctaaccaagcacaacacacctcaggtttcaccgccactcctcgcaaggcagcgggcagtcccctctcatgcctaggtgaatccggaagccgcataggccgccgtagggcccatccaaactccatcacgcccacccttgcctggatgcatcagctagaggaaagctacactacaggcccagctgttgcccacgctggctagtggtaagtatgataagttcttccagggcatcccgcgaaccggtccttaagagccatgggcgcgaccagcaaaaccacgcacccacagcacaccatatggtatattttaattgaccaacacaaagacgatggctctaatccaacataacctgaagtctatgcattaatgtgattcccccattgtgtgctagttgaatggctaagcaatccctagtccaatatctagtcatgttatatcccaagctaacaaaggagcatggtacaaaaatagcatggctgtaacagtaggtaaacatcccatagtaacattgtaaaacaatgcagtatttaagggaaacaatagggcatttgcaatataggatcaacatgttcaagtgacaagcatgacttgccttgctctgcagctggaggaaccttggcgactatttcaaagtacaccggagcgtcgggagagccggaatctaagcgacatacaaagcaaacaatacaaacaggccataagactactgaaacagagaacaaaaccatttttaatggattctatgcatttttcttgatttactgagacttgaatgggcttaaacgaagcacggatgaattttcaatgaattttagaagattcactacgattttagtataaacagaaaagccctaaatgatttattgcgcaataatttaaaccctggagagacagggggcggcgccgacatgcggaccccaca

SEQ ID NO: 10364 - DNA, 1127 bp, Oryza sativa
tagcgccgcccgcgccgccgccttcctccgccaccggccggtcgccgccggttgccgccttgcgccgccgctgcgtcgagccacgccgccgcgtgccatgggcgccgggccggcttgagccgagcccgtgcgcgccggccgcgagccgcctcccccgtccgatctaccgggcggtagattggggccgcccgttccgtcgcccgcgtggtcgcccgcgtggctgccatgttggtgccgcgtccgcaccacttgtgcgccacgtggtgcgccgcccccttcccggtccgtggacccggtccatcgcggaccactaccccgagtcactgccatgtggggtccgcatgtcggcgccgccccctgtctctccagggtttaaattattgcgcaataaatcatttagggcttttctgtttatactaaaatcgtagtgaatcttctaaaattcattgaaaattcatccgtgcttcgtttaagcccattcaagtctcagtaaatcaagaaaaatgcatagaatccattaaaaatggttttgttctctgtttcagtagtcttatggcctgtttgtattgtttgctttgtatgtcgcttagattccggctctcccgacgctccggtgtactttgaaatagtcgccaaggttcctccagctgcagagcaaggcaagtcatgcttgtcacttgaacatgttgatcctatattgcaaatgccctattgtttcccttaaatactgcattgttttacaatgttactatgggatgtttacctactgttacagccatgctatttttgtaccatgctcctttgttagcttgggatataacatgactagatattggactagggattgcttagccattcaactagcacacaatgggggaatcacattaatgcatagacttcaggttatgttggattagagccatcgtctttgtgttggtcaattaaaatataccatatggtgtgctgtgggtgcgtggttttgctggtcgcgcccatggctcttaaggaccggttcgcgggatgccctggaagaacttatcatacttaccactagccagcgtgggcaacagctgggcctgtagtgtagctttcctctagctgatgcatccaggcaagggtgggcgtga

SEQ ID NO: 10365 - DNA, 413 bp, Oryza sativa
agagctacccgcgcctccctaccgccatccccacgccactcccgcgcaccggctggtttccggtgagctccgcccgcccgccaccgctgctccacccaacgccgcgccaatccgccaccaccgtcggcttcgcggcgccgtgccacagcccggcccctactccatttcccctctccgcctccggaacaccaccgtcacgcgcaccacctctctttgccgccgccgccgactccagccgggcgccaccaacactcccaccgccgccgtgctgcgccgtcgcgcgccgcacatcgtcccccatctcctttccccaaatcccccaccaaaactccctcctcactgccaacctgagaccgccgccgctttcgccgcctcggccgccgtttaccgccgctcccagccatcccgagcca

SEQ ID NO: 10366 - DNA, 332 bp, Oryza sativa
ttagagttaattcttattccatcgcatttaaatttaattcatacaaatatggtcgcaataatattttatttatttctatccttacctaatatttattttaaattatatttattttgccaatttatttttagggtttattcctaattaactattctttatttgcgattaatgaacttcgaaatcaaatccaaataaaataggcgaataaaattggcatgatgcaattaatttaaaaagttttcgaaggtccgtatttttagagttttgtttttattggtcgaattttcagggtgttacagatgctcaccaagcggcacggcaccggacggagg

SEQ ID NO: 10367 - DNA, 1018 bp, Oryza sativa
cggatttattaagcctaattaatttgtcattagcacttgtgggttactgtagaactttatggctaatcatggactaattaggctcaaaagattcgtcttgccatttccatgcaaactgtgtaattagttttttaatcaatatttaatacaccatgcttgtgtccaaagattagatttagtgtttttgagcaaaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcga

SEQ ID NO: 10368 - DNA, 1501 bp, Oryza sativa
atgtccatttgcaaaacctatttataaatggaccatggtttatttagcggaagatgaggctcaataatttatgctttaaaaataagtatatttcaaacgatgttacaattacataaaaactctttttaataaatccaacataaatagatgaaaatatgataatttttaattaaataactccacatgttgaattaagaatgtaaggaaattgacctaatcctactaaaaatctttcgaaatttctaaattgatgtatgtataaggatgggttaaaaagggcgtgccaaatggctcgccgattttctagtcaaatcatctcaagctggctggttaccgaccaactattagtccacgtggcagggataacttgttagataaatatgagattatcatcaaggaaaaaattgtaaaagtaaaaaaaacaaaagtcatccagattctagagtcttccgaaccatcctcccccttcaagtaaactatctgccccattcaatcaaaccaaatacaatatccatttctacagataaacgcatagagatttttcggctagcttcacaaggtggtgggctagaagatctaggttcaaaacctcacccttctaattatttaaaattagatcattctctaatatttgcatatttttatatctatttctatatatgtcttctccgatcaatcaaattgaacagaaaagtttagggaaaattgaagagaaacaaaagtgaaggtgaagaaaatgtaaaaactaatggagaaaacttccaccaataagctagaggtgaactgccgatgtagctaagatgataatttctaaataaactaaaaaagcatgtacgtaaagtttcgggaaaattgaagagaaataaaagtcaaggtaaagagtaaaaactaaaggagaaaacttccaccaacaagctagaggtgagctgccaatgtagctaagatgataatttctaaataaactaaagaagcatgtactaggctctacctacgaatctttattgatggattgtggagattatggttatcccatatctatatggcggttatattccagctggatatacggtaccaaatacagataaaatatctttatgaggactcgggttaggttctaaacttgtgtgtctagaaagtacccgggattctagccggttacgattgtattttatctgtaatcccatattccgttaggatatggactgtaccttgtattacggatcccttcccttatataaggagggtccgtgtgcctcttggggcacgattcttttttctcccaatcatacaatcaataacacactcggcggaatcatccccggacaggagtagggtattacttcttgaataagaaggcctgaacctgtataaaatttcttgtctccaaacccatccactttcttagcttgatagccacccccttttattattgtcgaaatcttgtttcgacagttggcgcgccaggtagggacggcgtcaagttctcaccgactaagtgcga

SEQ ID NO: 10369 - DNA, 1501 bp, Oryza sativa
gggcgaaatttatagcagaggttttgcttaggggttaagtataatcctactttagtggggtacttgcaattggtggatagtggatgggaaagaagacgaaataaagaaaagaggagaaaggaaaaaaaggtgaatcaaacgaaaacggacgtgatagatcgtttagcgagaactagctaaaccgcataccaaaacggtgcaatggtatataaatatcagaaaaattgctagttcaaaattcgtttttttttaatctggagttcaaatatatgtttagattattaagctcacgaacgtgtgacaaatctatctatctattactacctcacgaatctggaagcatgaagagcaatctgtagagaaattttgaattgtttcccgtagcgtatcactatgcccaacgtattcggccgctctaagagcaagtttaataagtttaatagtatagcccattattagctccaattcacctatagcaaatctaatagccaattcatacaactagtcgccaacccgttgcacgggctattactacctgatgcaataaatattaaaattgtgatcatggaattggatgttttgtaattattaatttagtttttttaattatgttaatcaagtactaaaggtctgatgtcatattcattaattttgaattctaaaattattaaattctataaaaattagaactaaacaatccttggtacttctagtttgatgttttatttaacacaaattcttctagtttgatgttttatttaacacaaattctttggtacatatctacagtcattatattggtatgagttacatatatacataattaataattaataaagttgttttacaaccttattgtgtcaagagcaacactcttacaattatatatatagtttattaaaaatgttattgtgataggcaataagttttaattatttaactgtacgaactgcagtgatctgaaacataccggatagggggtatgttttgctactcattctattgaaaaaaaatcctaattcattctgttgcaaaaaagcaccagtgcatttaataaaaaaggtatgttttagttttgcttctctagtcttgatgttctgaactttgatatcgtttgaaaagctcagtttttttgtcattgttaactggatgatattctactacggatgaaaattgtgcaatgtagatcagtactgatcttttgtactattaatggcctgaacttattgacctgaattttttttatattatgtatcaatttatcatggtgccgaaccgtgaagtgcatgggttattatatagaaaaggctatatgtactaactttttctattcttactaacactgatgtgtcatgctatgtcatgctatgagtgcatctagattttttgtaacttccatctacttaaatcaaacggttgagatgattgttagtaaaagtttagtaagaaaaatttagtacgtgtagcattgctcttattttatatatatatatatatatat

SEQ ID NO: 10370 - DNA, 1501 bp, Oryza sativa
tatgtatatatatgtatatgtatgtatgtatatatatgtatatgtatgtatatatatatatatatatatgtatatatatatgtatacatatatgtatatgtatatatatatatgtatacatatatgtatatatatatatatatgtatatgtatatatatatatatacatatatatacatatatgtatacatatatatacatatatggagcaccaaacaaatttactatatataactatatatatatatatatccctgattcatatatcatctatctatcaattatattattaagacaaccttaaaagaagatattacgtttaatgtggaggttagaaattctcacattaatagaagaaaaagaaaatgatctaaacttaaagaaatataatctaatagttgtatatgaaatccagaccttatataaaaaatctaagagttgtgatataatatatacatacacacacacatacacacacacacacacacacacacacacacacatatatatatatatatatatatatatatatatatatatatatatatatatatatatatatatatataatgatacctatagaaataaaaattcagagttgtatgtaaaatccaactagttccatgcaaaacttcacatggcaattccctagttctattattaagacagccttgaaagtagatatcgcgtttgttgtgaaggctagaaagtcccacattaaacaggaaaaaattaaaaaaatagagttcaagtaaaaatataatttaaaattaactaaaatttagaatataaataaaaaatattgaaagaacaaactatctagaacacaacacgatattaattaaaagtatgaataaaataaattttgaatttacttagaaaagaaaaatgagagttcaaatatgaatacaatttagaaataattaaaactcggaataatatataaggaatattgaaataacacactatacatcatgagattgattaaaattcagaataaaaacataatatatactccatctgtttcaggttataagacgttttgactttggtcaaagtcaaactgctttaaatttgactaagtttgtaaaataaataataatattttcaatccaagacaaatttattatgaaaatatattcaattattaatttaatgaaactaatttgatattataaatattactatatttgtttataaacttagttaaacttgaagtagtttgactttaaccaaaatcaaaacgtcttataatctgaaacgaatggagtattttctaaaattagagaaagaaaatttagagttcaaagtaggaatacagtttcgaaataactaaaattaaaaaaacaaggataaaattgagaataaataaaaaaatgagagtatggtaggaataatatttggaaataatggaaatttagaataacaaaataaggagtatcaaaagataataccatctataacacaacaggagattcattaaaattcaaaataaaaaaat

SEQ ID NO: 10371 - DNA, 1501 bp, Oryza sativa
gccttgacaggatggcggccgtcgcggtccggtgtctgaaaaacaaggtggacaagagaccgaccatggcggaggtcgtcgaggagcttaagcagctgagagagcaaataagcacgcgtatgtcctagctagccggcttgctgcaagatcagctcgtgtagaagatgaatgcttttctctgcctcgttcttcagtctctctattagttaactttcctttgcctctttgttaatttctctccaccccagcagatatcacgtactcacgttggtttgagttatgtactatattccaccgtacgtttcaattgttatccatgtagtgttttggtactatgttgtttaaaaacaagtgttgttgtgctgttttttatcttttgctataccttttgtagatgtggtctgcatataagcgatatatatatataccagctcctgtaatcctgttatccctccttgtgcaataataaagtacctcatttaagtatttattgtcctacagaaaaactgaggtgccacgtaacggtactgcaaccggtgtacgtggcatatcgaaaatgggccgttaaacaaaacgtcacctgagccaggccgttaaatgtgccaaaaacgagagaagcgaccagaagaggaataagtctgcttatgtaatacttaaaaaaatggggttaaataagaacctctgatagtatgcatgactgttttagctaatgtgacatcctagtcagcaaagaagaaactactcttttcgtttcaggttacaagacattttaactttggtcaaagttaaattgttttaagtttgactaagtttatagataaatatagtaatatttatcatactaatttagtttcatcaaatcaataattgaatatattttcataataaatttatcttgatttaaaaatgatactattttttttctataaacttgaacaaacttaaagcatggttaaatcgtcttataacttaaaaaaacatatggagctcacgtgtaagtgagttatctctctcatccttcttgagctgaggctcgtcggcgccggatgcaccaacgaataggttattttcaaaaataaattacaaataggtcctcagaagctaatgatagcgcaaagcaagtcaatcttccagtgctgcaaactgatctcaatcttattttcgccgttctaattccaccggcggattgtggcgacattttgatccaactttaaaaaagaaagctcaaacaaggttccaatcaaaaccggtgcgtgcatgattggtcaacagtcaatatattcgactcatatgtacattgtatctatcaaggtcttgattggtcaagagtttgaaagaaaacaagtttcacgccccacatgtggagagaaaacatccaagagctcattgattaccgtcagtgagccaatcaggaggagcgaaatacatgtaatgtaatgctttgttagttcttagattgttgccagttaattgccacaaaagcatcacttcagcgtcgcca

SEQ ID NO: 10372 - DNA, 1501 bp, Oryza sativa
ttgtaaataaacaattatttttatagacgatctacgcatacactttagcagctgtaggtttttttaattaaatcaccaattcctgagctatattagctatatttttactactatatcatattttatcttatgtgccatttctaccaactcttgtaggccaccctgtgactttgtctaatctcatcattaatttttatttaaattggtaggactgttatcttagagcaagtaaaatagcaagctattagccagctacaaatatattttaatgagataaacgatgagagagaagagcagcgggctacagatttgtagccagctgcagcacggactacaagacgcaatatgcgtatgacaggtgggaccatatattaatagtatagtaagcaacaattatattcaatttgtgattagtttcatgctttaattaaatgaaatacttatgtcttataaaaggtatattatggtcctaaatacatcatgacacatgggaccaacatataataattaatgttgtggtaattttcaaatagtttcacattatattttaggatttctaatatcacttgataaatatacaacactaatttaaatctacaaatgtaaaaaatgataaaaaacaatttagtctattttttaagtaaatccaatttagttttaattttttggattaatttatcaaaaattttattttcgttttttttagaaaactcaacagagaaagaaagtcttggtggctacgatgggcttcacccgttagaggggcattcatgtttatctttaacggtgttatttcattaattggtataagtggtatttttaaaatatttatatattgattcggaaataagtgaaacatgaacacttagataagtagtgaatattttagtgtatcaatgatgtattaggcttattttattggtacatatccagttttatctatttatagatcataacttttaaaacaataataataagttgtggtgacaataggagaatttataagtaatcgggacagactgattttcttttaatcttggagacattcttatcatttactaagtatattaaagtcagtttatctcacagcataaaaaagatgagacatgacatcttttagcattatttcataaatcataaaacaataaattagatgcctgcgcatctgcgcgggcttccttcctagttcatacaatagttgcttactatactattaatatctggtctcacatgttatacacatattacgtcttgtaatccgtgctgcagctgactacagatatgtaatctgttgttcctctctctcttcctttatctctttaaagtatgtttatagctggtatatagcctactattgcacttgctcttaagcaggttcaatagtattgctggctgccggctccatccatgtccatattaactagagtaagctagcagttaatcccgagatgtatttctttttcttgtgggacccaactgactagcatctttcattgcatgc

SEQ ID NO: 10373 - DNA, 1501 bp, Oryza sativa
cgtctgctgctgactagtgccctcgcctctacatctggtttatacagctaccactactgatggacatcatcgtcttccgccgccgactcgtgttatgccgccgccgactggtgcttttatcttcacaactgcgcgtcttcactaccggttcacttcatcatggcaacacaactttgtcatcatggtggagcgacttcatctttattatcttcggaaccagcaaactctattgctgctacttcacaagttttgctacatcaccaaccatgacgttgttgtgaatctcgacatctcggcatgcgatgccgtgttattttactacaacaagtggctctccaatattcaggatttctacttggacatcttcaacacatatcttcaatcaagcaatgactactcgacgacaagaagctataattctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgtcgtcaattattttcttcatcttcatgattggtggattttgtcatcacctttgatctacctcgtctgtcaccgactgattattttgctgccatggctacacaattttatcgctgggttccttcatcttcattgttagttgatctgtctgccgccgactggtttcttcgcctccatggctatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattgttacacctactttggagtatcccataagggataatcattcagatcagaagctattcatatgagctacacttggtctatattacccggaa

SEQ ID NO: 10374 - DNA, 1501 bp, Oryza sativa
agattaaagctccggttagtaggtatagggccagtcagattgttcttccatataagtatggcttcaaggctagacatgttgaaaatggcaggaggcactggaccagagagctgattgtctggcaacgcaagaacacgaagcatgggcaaggagccaacacagtctggtatggaacctgacaaactattcagcccgaggtgtatctcggttacccaaggtgtgtggcgttgaatagatactctggtaccggaccactcaggtaattgctcgtgagaaccatttgcctaaggctatgtagattttgcagctcggctggtatgtgccctgagatgtggttgccatagagatttagaatctcaagctttgtaaggttccctagtgcagagggaatagtatctgacatagtattgtgggcaagacggagaatcctaagacgatgcagcctcccaagatcagctgggatggggccagtgaggtttatgccaccgaggttgaggacacggaggaaagagaggttaccgaggtgaggcgtgagctctccttgcagaggaacgtcccacagcttcaacccgacgacccgcggccgccgccggctgcacgacacgccgacccagcggcacatggacaccttggttgtccagttgccggcaaggactccgagaggatcggacagccgcgctttgaaagccagcagcgcggacaggtcgtcgccggtgccattgctgctgctaccaccgtcacgcgggatggaaccagaagcatatggtatggtaagtggcagtacaagcatgagaagacgaatgctgttgaatggtggaagaagtagccaggccatgttaggcactacatacagtgtgttcgtgatgtagcattgagagcacaacttcccccttttatttttgggagaatagctaatacggtatctaaagtttcgcttcgggcttaatttagtccttaaggtttcaaaacgtccaaataagtcctccaaattaatcatttgggttaatatagtccttggacccacaaaaaatgccacatgagcatgccaagttattcttgcatgcaacaatacaaatgaaatgaccattatagccttaccatataaaaaaaaagaaaagaaaaaaataaaggaaaagaaaaggaaacaacaggaaggaacgaacaaaaagaccggcccattactctatctgtttgttttctccatctaaaccctgattataatgtgtgaaccatttatattattgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggta

SEQ ID NO: 10375 - DNA, 1381 bp, Oryza sativa
cggttaatatattgggtcaccactttaaataaactttacggtcagatatttttctttttctcagaatattatttaaattattagagcgccatgtggcgacttaggagcgtttatatataggagtctcacgtggtagcttgagagcgtacgtagaaagtttaatgaacttttagtatataaataatagatagatagatttaggattttctctaatttgctagaacgccacgtggtggcctaggatcgttattggtccaaataatatgtaattacttatttatataaataatatgtaatttagaagtatacttattcaatatgtattgttgcagaacatagtaaagagaggaaggggaggaaaagaaacggagaggaggtactcatacatgacgcacggcaggattccttctttgttttttagaaagtaagagaataaaccaatctaatctaacggcttggagtaacgggcccactaattttaatgaaaatcaatggctagatgttttgcttttttttatagaatttctagtattttttctaatttattagaacgccacgtagcgtcgtaggagtgtttgtaggaagtttaatggacttttagtatataatagatagatagatagaagatagatagatagatagatagatagatagattatctattacgttagctatagatgatttggagctagtagcgggctatactattaaacttgctaaaactatacaatcgttgccgatctaaccacccaatcaacaaaagagtacgtaaggccgttgccgtcaaattgtttgacagaaaaaaaaaatcagtgagcgtatggctgatgacggagcgacacagctatcatatctagcgtgtcgtgcacaccgcgatctgctgaatatatattttgtgatgtctttatttttcagcgtttacctagtagtgctgtcaaatatttatgaccggaaggagtatcatttaagtttctttcgctttctgagagcaacagtcaaggtcgtcctacatgtcgaaagcaaactagcactactgtgctaaacaaagctcaacttgatcgtcactgtgaagtatgatgcatactcttgctgccaatgcatcacacacaaccagacatggcgcttgttcgattgccagtatggattttcgttgcggcgttgttgatcgcttcgtccagtactgtgccttgtgcttcctctccaggtccgatcgcgagcaagagtaacggcagcgaaaccgacctcgctgcattgctggccttcaaagcccagctctccgattctaacaacatccttgccggcaattggaccaccggaacgccgttctgccggtgggtgcgtgtctcgtgcagtagccaccgccggcgccggcagcgcgtca

SEQ ID NO: 10376 - DNA, 1120 bp, Oryza sativa
cggttaatatattgggtcaccactttaaataaactttacggtcagatatttttctttttctcagaatattatttaaattattagagcgccatgtggcgacttaggagcgtttatatataggagtctcacgtggtagcttgagagcgtacgtagaaagtttaatgaacttttagtatataaataatagatagatagatttaggattttctctaatttgctagaacgccacgtggtggcctaggatcgttattggtccaaataatatgtaattacttatttatataaataatatgtaatttagaagtatacttattcaatatgtattgttgcagaacatagtaaagagaggaaggggaggaaaagaaacggagaggaggtactcatacatgacgcacggcaggattccttctttgttttttagaaagtaagagaataaaccaatctaatctaacggcttggagtaacgggcccactaattttaatgaaaatcaatggctagatgttttgcttttttttatagaatttctagtattttttctaatttattagaacgccacgtagcgtcgtaggagtgtttgtaggaagtttaatggacttttagtatataatagatagatagatagaagatagatagatagatagatagatagatagattatctattacgttagctatagatgatttggagctagtagcgggctatactattaaacttgctaaaactatacaatcgttgccgatctaaccacccaatcaacaaaagagtacgtaaggccgttgccgtcaaattgtttgacagaaaaaaaaaatcagtgagcgtatggctgatgacggagcgacacagctatcatatctagcgtgtcgtgcacaccgcgatctgctgaatatatattttgtgatgtctttatttttcagcgtttacctagtagtgctgtcaaatatttatgaccggaaggagtatcatttaagtttctttcgctttctgagagcaacagtcaaggtcgtcctacatgtcgaaagcaaactagcactactgtgctaaacaaagctcaacttgatcgtcactgtgaagtatgatgcatactcttgctgccaatgcatcacacacaaccagacatgg

SEQ ID NO: 10377 - DNA, 1501 bp, Oryza sativa
cgagctccgtcatagtgagatgcatgcaatgaaagatgctagtcagttgggtcccacaagaaaaagaaatacatctcgggattaactgctagcttactctagttaatatggacatggatggagccggcagccagcaatactattgaacctgcttaagagcaagtgcaatagtaggctatataccagctataaacatactttaaagagataaaggaagagagagaggaacaacagattacatatctgtagtcagctgcagcacggattacaagacgtaatatgtgtataacatgtgagaccagatattaatagtatagtaagcaactattgtatgaactaggaaggaagcccgcgcagatgcgcaggcatctaatttattgttttatgatttatgaaataatgctaaaagatgtcatgtctcatcttttttatgctgtgagataaactgactttaatatacttagtaaatgataagaatgtctccaagattaaaagaaaatcagtctgtcccgattacttataaattctcctattgtcaccacaacttattattattgttttaaaagttatgatctataaatagataaaactggatatgtaccaataaaataagcctaatacatcattgatacactaaaatattcactacttatctaagtgttcatgtttcacttatttccgaatcaatatataaatattttaaaaataccacttataccaattaatgaaataacaccgttaaagataaacatgaatgcccctctaacgggtgaagcccatcgtagccaccaagactttctttctctgttgagttttctaaaaaaaacgaaaataaaatttttgataaattaatccaaaaaattaaaactaaattggatttacttaaaaaatagactaaattgttttttatcattttttacatttgtagatttaaattagtgttgtatatttatcaagtgatattagaaatcctaaaatataatgtgaaactatttgaaaattaccacaacattaattattatatgttggtcccatgtgtcatgatgtatttaggaccataatataccttttataagacataagtatttcatttaattaaagcatgaaactaatcacaaattgaatataattgttgcttactatactattaatatatggtcccacctgtcatacgcatattgcgtcttgtagtccgtgctgcagctggctacaaatctgtagcccgctgctcttctctctcatcgtttatctcattaaaatatatttgtagctggctaatagcttgctattttacttgctctaagataacagtcctaccaatttaaataaaaattaatgatgagattagacaaagtcacagggtggcctacaagagttggtagaaatggcacataagataaaatatgatatagtagtaaaaatatagctaatatagctcaggaattggtgatttaattaaaaaaacctacagctgctaaagtgtatgcgtagatcgtctata

SEQ ID NO: 10378 - DNA, 1501 bp, Oryza sativa
acgatgcccatcaacggtggtgtgaccaaccgaccgtataggcgaggacaccagtcggcggtgacggaggcaggccggtggtgaagtcgtagacgcccaacagcggcggcataatagaccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggtggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagcgaaaactcccaaagcgaaagcgaagtcggcgactcatgaaattgattccatcgcgctcgttgataggaaactcgacgcaatccctacctggcgcgccaactgtcgaaacatgaattcggcaataataaaagggggtaacgcacgagacctaaaagtggatggatgcggagacaaaggatttagacaggttcaggccctctcaatgagaggtaataccctactcctgtttggggatttgaatccgccgagtgtgtattgatctgacgatcaggttgtctcataccccctagagggcctcctgcccaccttatatagggtggggggcaggattacaagatagaaaccttaaccaatacggtatcggtttcctaaatctactttacaatattatcaaaccaggactttaggccgttccgtaacatacaaggaaacgtaatacccaagtcatgatctgttacatattccatagatataagttatcccctatagccagtcggataactatgccatgtgggtatggggtacccataatctccacaataatataaatggttcacacattataatcagggtttagatggagaaaacaaacagatagagtaatgggccggtctttttgttcgttccttcctgttgtttccttttcttttcctttatttttttcttttctttttttttatatggtaaggctataatggtcatttcatttgtattgttgcatgcaagaataacttggcatgctcatgtggcattttttgtgggtccaaggactatattaacccaaatgattaatttggaggacttatttggacgttttgaaaccttaaggactaaattaagcccgaagcgaaactttagataccgtattagctattctcccaaaaataaaagggggaagttgtgctctcaatgctacatcacgaacacactgtatgtagtgcctaacatggcc

SEQ ID NO: 10379 - DNA, 1501 bp, Oryza sativa
gggagtgcggcgctgtgcgtgctgagggagtgcggtgcggctgtgaggagtggctgagtgggagttgggtgtccatcctagggtttggtttagtgggcctattgggcctcctagcctattgggctaaaattcggttttttcggttagttcggttaactgagaccaatgaccaaattacccgaataaatttcggtctttaacatgctgagaccgaattactaaccgaatttctcggtcttggtcttttcggtctcggtctcggtcttttcggttcggttcttcggttcggtcttcttctgcccacccctatccactgggtcctgttatttttcgacttggacgcatgcagagtcactatgtatgactcaatgaataaagaggagaaggtttttgacaaggtcttctaactgatagacaggtaatataatgccatctattccaaagtcgcgggactctgttgctattatgttgatctcgggtaataattaattaatcatagcttgcaactgcacatgtagggcttgggatcggttccgtcaattggtccgcgggacttggaaagaaaaacttggacggaggtttcattttccagtgagtacatgcatgatccaaaattatattgaattgaatctctaattacagttaatataaagagtatattaaatctctcatgatttctcatgtagtgtgcaaagcaggaccagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaatctcccacacaaggattttatcacggctgttcaagaacaacagatggggttcatcaacgaagaagtccttaatcccgatggtgaattctactacgacggatcgacaattcataacatcggtccttcctcttctgacataacgccggcgtcgaagtcgtagctatagctagcgagcaaatgaattatactatacatgcatgtatatatatatatttatatatgtatgtacattttctttagtgttaatatatattttggtaacatatatgcacataaaatgttaagtggtttaaattataaatatgtgtgtaatatatgtatttatacatatacacatatgcacatacatacatatatatatatatatatatatatatatatatatatgtatatatatatatatatatatatatatatgtatgtatgtatgtatgtatgtatgtatgtatgtatgtatatatgtatgtatgtatgtatgtatgtatgtatgtatatgtattctatatatgcgcataatatatatattacaatgcatatatatgtattgtaatatatatgtattgtaatatacatacatacatacatatatatattaat

SEQ ID NO: 10380 - DNA, 1501 bp, Oryza sativa
cggagaggttgctcccgcgccgtcggccgctcgtcacagcgcccgtcccggctcggcagtgcctcctcccgttccccttcctcgctctccctcgccccctctagtctgcgtgatagctcggtggcactcccgaacgcgcgtggacatcgccccgagccccgccgccgcctggcatggcctcgcggccattgccgtccactcccggaggccaccgctcgtcgccggccctccttggtactcctttgtcccatccgtcgccggaactggattccttgaaccaaggatatgcttccaccccttttaatcgaacccccgttgctccgatgaagtttcccccttttctcgccaccggtgtgcgccttcctccagcgaatccgatccggtggttcacttcctctcgtccgtcccatcgttccgggtgtactccctctctctcgaatcgtcgcgacgagctccggtgaacttggccgccgtccgccgtccatctcggactccccttcttcctcctcccgccggcccgcgtggctgccacgtaggcgccacgtcggcgccacctcggctttgaccgggccaagccagtcagttgccccctccctccgtcttccctcccgtgcgcgctgtccatggcaagccatgcggctgcacgtaggcccaccgccattcgtccacccggcgcgccgcgcccgaaccacggaaaaaccgaggccagttgagatcagtctccctccgaaaacctagcgcccgctcccgcgtgcgccgcttccaccgtgcaccgcctcactgacaagcgggcccactcgggaccccgcgaggtgagcccggtccacccggctccccttccccctctctctccccgcgcccctctcttgggctgcctccccgtagcccgcaccggcccaataagctcggctgagccgcgcaaatcctctcgggccgcgccaagctactcgggaaagtctggttcctatccctccttccttttcttatccaaagggattaataaatccttttccctttttcacaaatcaattccttattcccaaaattccatgaatcattttctttggtcccgcacgtcagtgactgtcaataatattcttgagaatattatttctataaattccataaaccatttctcctattccaaatattccaattaaacctccgaaatccatatctcccaatccgtaactccgtttgactccgttcaacttccagtaattccataaaattgagatctatataatggcactattatttagtctaaataggatctttattttggtcttttgtttaggttttcgattgtttgcgtatagttgcggttaccggattttcgtcgattgtggttttctcgaagattcatgaagcttcgcgaagacctttagcaaggcaagtcaccctttgatcaatatctcctataattgaaaaatcattattattttgtttgcaacttgaactattagaatcacacctataacatgcttggcctcggtttgca

SEQ ID NO: 10381 - DNA, 506 bp, Oryza sativa
ccggattggaaagcggcggcggctagggtttcggccggcagcggcgcggggaggaagacgggcctgataggtggggcccacctgtcagcggctgagagagaggaggaaggggcgcggcggattgggccgactgggccggggagggagagagaaaaagagaggttttgggccggctttcggcccaaagccaaaagagacttttaaaaacctttttcaatttaaattattcatgaaatacttccttggctcaaataaatcccagaaaaatctaggaactatagaatcaagtaaagtatttaacaaaattttatctagcccaattttatattgagatttaacaaattaaaattagatcttctcttttaggcttttaagatcatttctaataattccttttaaacaacaatttataatttaaggatttttaaacaagaaaagctcttaacacttataattagatcattaatgatcaaataattactgaactgttctttgtatcatttagg

SEQ ID NO: 10382 - DNA, 1408 bp, Oryza sativa
gttgtaaatttctagttttattatacattccttaaattatagatttatgatcatttgatcaaagcatatgtaattttatgagatttactcgtatgagattaaggaagttcacattactagaaataagctcatagagatcggcactgtaggtgccggaatagttaaaaccagcacctataatgctttcctctcccccgtaggctaaaaacacataaaatcgacacctttaagcaattataggtatcggttttaaagaaaaaccggtattatagtataggtgccggtttttatacaaaaccgacacctaaattataagtgccggtttttaaaaactggcaccttaaataaattataggtgtcggttttgtataaaaaaatagcacctatatggagccgagccggccatatccatccgcccgtccttatccatccgccttatccatccatccgaccgagtcgctcacgtctctctctcgctcttgctctctcgcctctctctctcgcctccctctatccctctctctctctctctctcggcggcccggcggtggcccgtcgaggtaggcgtggcggtggctggcaacggcgcgccctcccctccgccggatctagctggaggggaggtggtggaccttggggacggccgggcggtggtccggtgaaggcggttgcggcggccgcgccctcccctccgccaaatccggccggagaggaggcagcggacctcggcggaggcggcacagcggctggcggcggacctcggcggaggcggctggcggcggccgtgccctcccctccgctagatctggacggaggggaggtggtggacgtcggggacggtcgggcggcggtccagcgaaggcggtggcgccagcggcgcccgatggatttgttggatgattttatagttcttttagatttttttgtgatttgtggatgattttatttctgaatatgtttcatctgtgatctgtgatatgtgatttgtgattcgtgatttgtgggggtttggggatggagtagtgacgatgattgtgagttccggctcgattcgagtcggctctttttttttttggctcgtgcaaacttataggtgccggttctattttggtataggggtcggttgtttttattggtgccgaccaataggtgccggttggaaaactggcacctatagccggttcccaagcggcacctatgatggtattttactagtgtcaggtgtttggaattttcgaagatatcacttagggtcttttttttttttctgggcatgtggttttgacaagccctatacatatctttgtataattttctcctattatatcaatataggaggcacaacttttgcccactcttaaaaaaagatattaaagaaagttccaaatgcatgcagatgcgaccggaa

SEQ ID NO: 10383 - DNA, 1501 bp, Oryza sativa
ccatgtccacctccctcagacgcgagagcgctccacgtccacctccctcagacgcgagagcgcaggccaccgtgggagcagcacagaggcggctaacgccggcggcgcggacgcggccggcgccgacgagctccggcgtggaggacgtggccgccggcgacgagctcccgcgtggaggacgcggccgccggcgagctctggcgtggggcatggtcgcatggacggcggaggatctgcgtggtgacagagacagtgccggcgaagagctccggcgtggggcgtggacggcggaggatcctgcgtggtgatggcggcggcgccggtcacgagctccggcgtggaggacgcggccaccgggtgaggcgtggacaacagacgcggctgccggtgacgagctcccgacagaggacgcggtcgccagcgcgcgagctccgatgtggaccatggacgggggaggatgcggctgccggcgatgaggttcgggttcagtacggagcgtggacgggggaggacgcggccgccggtgacgatgcctcgacacctcgatgcctagctcctggtatctagtaggtatcatatgaatacgatacctcacaagtatcaccccgatacgtcgtagaaatcgcacgataccttataggtatcacatgatacctcacaagtatcgtctgatacgtgataggaatcgtctgatacctgatacgtggtagaatcacatgatacctggtaggtatcacccgataccagctagttatcaggtgatacatgtagggtatcatacaattcttaccacgtagaagatgatagttgcgaggtatcaagtgatacttgagtaggatctcacggcttaggagctcagcctcgttcctatttggatgggaaatatggacgaagggtatcctgtcccgacggtataccggtatatagcatttccgaaaaaaaaaaaccttatggatgatggcatgatgcaatatttctgcattctgatacttgttcagattgcagtgcaataagccaataacaacttgtacaacaaaataaacaaagctcgttcagatttgtggttacaactggtcaaggatgcctcttcatgcagtacaagctgcatcaccacatgatagaggaccaaatcaatctggcatgctgaattaaccaaatgacaggattcacatttcgtagaagaacaaatcggaaaaatcacattacgtctattgacaattgacacgcatctctgtgcatgatcagtagagaaacagtgatgcagaacctgaaaatataacttgtagatacaaatggaatatgagaaggttatctctgactctcagaaatgagatcacaccttcacatcagcattaagccacgtacttatgtaacatcagtatcaagccttagctaaccaaagaagaggcatgaatccagaattccagatagagtagttcttactttttagttgttaggcagcaagcaaaatttacctctgtggaatggcacttgttggcta

SEQ ID NO: 10384 - DNA, 1501 bp, Oryza sativa
ttcctatgcaacacaagaattctccctccctgcagtatttcaccaaggaggctagacttcaattttcagatagctagaaagcgagtgggcgacgaagccacactacttcatgtgtaccattgtgtgccgtgtactagttgggaacggatggtaccaggaatgatatggatagctggatgttttgatgctgaagtttgtggagcctgtttcatagtagtatattggtgccatcacatgagccgctgatgatgttgtcagttgatggcaaagacagagtatgagacgttaggtgtggcactagcaggatattgttcttcttatcgacgcaggcaccaaacacgacaagttcatttctgttgtcccacaataggtatgtataataagtggatatattcaagaacttattttcatctatctgcatgattcttgtcaaactgaaaagttgttttgataaacaaaaaagaaggaaaagctattcagtcacgactacaaatcacatttttcctgatagccagaacacgttttcgctagtgagccacctgaccgccagcaaccataggctagtgaaaatagacgatcttcacaagcagacgaaaaccgcctgcgaaaattgattttcataggcgactaggttacatggtccgactgtgaaaatgattttcagcgctaaaacagaagcagtcgacgtcgtttctgccgggttggaagcttccattttccatttccattcaagccttcccattcaatctaatccaaaatttccattcacaaattcaaagttcaaagttccaaatccgtagcatcatgaatttatagaagaaatagaacaaatctacatcatcgcaaattaaaggatccaaaacagacatcacaaatctcacggcatcacaaatcacaaatcaaggtcgacatggttgttgctgtcgtcatcgtcgcacttgaggtcgtcgtggtcgacttagtggaagagcaacgccgggtggcatatctggcgctccaagctccgtagccgtccttgctccctacgctccctagcactgctaatgccatctcacttctccagggtagcgccgtggcctttcttccgcagtggctccatgctgtggcccggatctgttcgaatccgaccttcccgctggtggatttggggccccaccagtcatcacgttttatcgaattttactgtttttcatgaaaatcatcaaactgcctgtggaggctttactgagatcgcctactgtgccaccatgagaacctattatcaagtggttgcaccaatggtagagtggagccaaaaggagtttttgatgttagtgtagcgctcggatgttgttcttcttatcgtgggaggcaccacacgtgtgacaagtctattgctaattttctatggtagtgtagtcccaatcggtttgtttaaccggattggttagatagctgttttttatccaaactatagcctaaggactttccttttatccagactatatcctaaggacttccc

SEQ ID NO: 10385 - DNA, 1091 bp, Oryza sativa
tttaatactcctaaatagtaagattccggagggctgtttaatagctcggaggatccaaacaaggccgttgtaccactcttcctatattctttcccaatgaaatctgttggaatatttattatcaccaacgtcttgaaacgtacgtatagcttgttttaaaatgaagctatttcttcacatatcctctctactcaaccaatcataactattttctatttaatgtattcacatttttttctcaaccaatcacaatatttctctaattaatttcacctattttcctaatactaatatttactttaaaaatgtttatattttgggatggagaaagtacggaaataagaagtagtacacgatatactagagatcaaatcctttccgtgtaggtcttcggcaattccttaacctcatggagatattttccataacttgagacaaattcctaacggcgtatacggaaaccaatccgtatatgtgaaggtataccttatcggtatattctataagtcgtaggatagagggtatgccttatccgtaacgatacataggattctagtgtcaataaagtgagtgcataatgacagatcatcaaatccttataccttccgtccagattcgttgccacatccctctaaaatttcttatattatggaattgtggcaaatcatctaataaaaaataattcggcacttactcaccaaatattcccccacgtattcaagcccgggtcattggcaggtattcaaaccgatctggtgagctcattaagaaaagtgactaattcggtcaacatacagatcggtgagaagtaaacaaagtgatggctactaggtatataatctcttaagtggcgtctactaagtacaacaaaagtaatggctacaaagtgaccaaatgtgatattttttcgtttcatattataatactttctaacattgcttatataaatatagatattaataaatctaggcacatctatatgaatgtgggcaatgctagaaagtctaagggcccctttgaaccgtaggaatgaaaaaacggaggaataggaaaaacataggattctggcaagaatgtaagtgtaaaacaga

SEQ ID NO: 10386 - DNA, 1501 bp, Oryza sativa
agcaagagctaagaggatggttgatgaataagtcggccaaaacatgctttcgctgatgaagtatataataattatagtataattgattttagtagacttgtattagatgcaatatttttgacattttcgactcatacataattctatctaatttataatacttccaaattaaaaaaaaaaagctctcttcagtcatgaaaaattatcattgaacataaaaaaacacgaatattaagaaatgacctaatatcgaatactccctccgtaccagaatatagcaacttaggactgaattggacgtcacatccggtcctagattactatattcttagacggagggagtaaatagaaaggttaagtcttcgaacctagactgatggagctagacagaggacccgtgtacgtttctcgtcattaaacatcatcaaacctttcaaagttgagcaattgcatttttaatgtctaatctcatctacgaagattaaacatgtggatttatcttgagagttttttttttcatataactaagatttagattttgatgctctatcggtgtgaatgtgataatcgagcttggattattgccgtggagagagagaggagagcaaggggttcttggatgatgatgaaggcaatgatcacgacgagcgaggtttctgacattgcaggagtaagcctgcagttcgaaaagtcaaattccttagggcgtttacaatgtgccggataattttgctggttctaggctgctaggtacgtagtaagtcacaactgctagctagataggatgagaaacttcacaagtcacaagattcgagatcctgtgcagactatttttagcgggtcccgtcacaggtcacaagtcacttttcatcaatccctccttctctcctccctgctttctcctgataaattctagctttctcttacaaattttgaggaggttcggatggccaaatgaagctccccgttcttggctgctcctccctccatgctgacgtggtttagaatctatgcgctcgtgaggtgaggttgaacgtcacctcaccgcactgtgaatggccttaggaaacactttaaaaatatatataggctcattggatcaatttttatctgtaatttgaccaatgtttaattataatctgtttttaactcttcaaaatcgaaccattcatagtgacattaatggtaggaaaccagattctgatttgccatcgtctggaaaatctctgattgattgatgaaatttaaattagacctaaaattacgacccactatttcctttgaaaaaaactactgcccagcccatttagcctgatgggccaagccccatttggtccaaagcccgcctcgccaccgactccgatccataccttagcccgaaccaagatcgatctcccccatcatcgtcacgtctcgccgccgccgccgcggccgccaccgtcgtccacgaccgatgtcggccggagacgaccgcctgtccgccctccccgacgacctcctc

SEQ ID NO: 10387 - DNA, 1501 bp, Oryza sativa
cattaattttacaaaatgcacatattgtgcactcaaacaaaaattttaattgttcttcaagcttatattcaaacctaaatcatcaagggcataaaagacatttgcaaccagacttaacagtgaaacaaaggaaaatgtaatggcaagggtatggaagggatcaagttgaaatttcaggggtatagaagggatcgagaaaattttaggggtatgaaaggaattgagtgagttttcgagtgtatacagggaatttactcataggaaaaacacatgaatagaaaaaatataggaattgaagttgcaaatttctttaatcgtataggagtgaaaagcataggaaatatgaagatggagccctttgacagcatcaccggaaactaacaaatcaaaggaaagttttcaacatgttgtgcttcttgcttatttttctatgagattgaaccatttgaatgtagtcctaggaaaaatttcgtatctttcctatgaatcaaagggttccatagaaaaaattctttaggaaattaaatcctccaaattttctaccgcaatccttcatttcgggccctaaaaggcaggaaattcagataaatagttttttttttatcatgacatcacctaggatttaattaggctccacccatacgttgtgcttcccattttaagtattacctgtctacctcggagccaccggttctcatggctgcttccttccataggttaaaattaagtaaaaatgctagcatctctgcatcaacatgacatcccccttaagaaaagaggacgttcagtgctactacactgtcatcaccttcaggaaaaacaaacaaaccagttttggatagtgaagggttttggacagcctccatcttcaagtttacaactaccatggctttaggtcacatattgaacaattgaaagattgcttcgagctaaaattttcatatagtacttagacaccttaaagtacaaaaccaatttagtcagttcagtacaactcaggatggagcatctttgagggagagaagcataacttttgttgctacatatatgtgttagttaacatggatgccaatagggatggcaatttccccggtggggacggggatccagcggatacccacccctatggggccggggacgaggctgttttttgccctgcgggtgagtcgggtcggggccccagtcgttaccgggggtgggggcgggtgtgaaaattaacccgtgggtgaccctatggagctccgaaagtgtatatcccattttatggcccattcaaaataaagactaataggcccaatttggtgtcacacaccaatccggcaccgccgtacaacagcacctgactggagcgcgtcgtaggagaaacggtgcgaaccgcttcctacgagaccgcgataacggtaccagtcctaggacatagagctggtacccacggtgacaataatgaagcattgcaatccttaatttaaatagaggacttatttaccttaacttaggttgc

SEQ ID NO: 10388 - DNA, 1501 bp, Oryza sativa
  unsure (1)..(1501): unsure at all n locations
ttgcgtgcgggtggcttaagccgtccgcacgggataatatcatcccgtgcgtgctacttaaactgcccgcacgggaatatcgattatcccgtgcgggtggcataagccacccgaggcgataatatggatatataagcactgggcgggcgtacgaaatttgcacctacactgcccagtttttcaccgccgctgcctcctcaccgagcaccaaaagacgccgccgacctccaccagcgccgtcggctcatctcctcctcgcccttaacgccggcgacctcctccccaaccaccaccgttgccgcctcctctacacctctcctcctctacctctagccatcaagatttgggccgctgctgccgcctctcctcctcgccctcaccgccggtgtcgccgacctccaccgccggccacctcctctgcaagccattggcggtaatcatttttgagttttttttgtgaaatttgtgatatgtgcaatttgtgatatgtgcgcaatttgtgacatgtgcaatttgtgatatgtgaaatttaggatatgtgcaatatttttatatatatgtgcaatttttgatatgtgaaatttgggacttagggtgatatttatgaaatttgtgagatgaccaattatcaaatttgtgcgatgtcaattgttaggcaaaaatgtagatgcaattttttttatatgtcaattttgtgatttttgggatataggatatgtggtatatatgtaatttttttgataattattcatttatatatggatttagttcctagcttatcaattcatcacataatacgaggtgctccgggtgccatgttggttcggtcgggatagtgcattgacggaacgaaccaagacaccttgggacgccgaggatcttgtattaagtcatttttttataatttagcaacttttattgtatgaaattgagcaataatgatttatatgtaactttacaattcaaaaacacacacaaaaaaaaggttaaagtgtgtagatatttccaaacggctagcatgtgctanggtgactgcnccaatntattataccgggcagncgccctagcacatgctagccgactgggattatccattatctcgtgaggtcaatataataggaccgcacgggataactaattatcccgtacggtctacttaacacgaccgcacgggataatcaattatcacgtgcggtccgcccgtccgaacgcaaaaatatggattttcgtagatacctgggtgtagacgggcaggtcctctgcacggaaaaaatgtattttgaccgcacgaaaagtctattatgtactagtgtaagtggcttggtctctaaacaaacaatacagagtacagatcatcaatataactattgtgaattaaaataacataatcatctgtataggcttcacctataaataggcgtgtctcactctccaatcgtatgcacaaccacagccctcttcctttagttgatcctcgagtaaatctgattggaaaacaagc

SEQ ID NO: 10389 - DNA, 1501 bp, Oryza sativa
gcggggcgggccctgcgacggcctctgtcgcttccggattcacctaggcacgagaggggactgcccgttgcccgctggggacgggggtgaaacctgaggtggggtgtgcttggttagagggggttatgcgaagggtcctgtcacggcctctttccggtgtgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtactcttatgaaattggatagtttaggtggatggttgggcctgtcgcaacgtgggttagcgttggacagtggatagttgatactaattaattattacaactatttaaatctttcaacttctgtttataaatgctcgctttatgcaaatgaaccacttcagctcttctttgatgattccctgcatcatacccctattccggtatgacttgctgagtacagtgggtagtactcagtcttgctctacttttcccaaccccagagttcgagttcgggtcagatgaaagtttctccgaggagtaggcttcgtccgtgccgtcgaggatgcctgtggagtggtgttcccgctgcagttttagtcatggcttagctcctgttgtctttcttttcttccgctgcatttttgtaagacttttatgatgtttgtaagacgtggatctgaatgtcaacattgtcgtttgtgtaccccggctggtcctggacggggaatttaatgcacattctgcttgaaattctattcgggaatttctgggcgtgacaatagctttcctctggctaacgttcctaggctagggtgggcgtgatggagttgggtcggctggggtgttcggttgatcggcttccggattcactgtggcacgagggggggctgcccgttgcctgctgggggcgggggcgaaacctgaggtgtggtgcgattggttagagggggttatatgaagggtcttctcacaatcactcgacgtggtgacctgttcatcatgggcacatgatgacactgtgacatgccggtggattgtgtcttgtgggtacagttgtgcacctctggccagagtaaaactattcgaatagccatgcccgcggttatgggagatcgaccagattcaccgtgattagtctcacccctagtaaatcgactcaatgcacttattagttcaggtgggaatggttgggcctgttcaacatggtgtagcattgttcagtggagatttaatataaccttaattactctattgttttactgttttgctcaataaaatgctttacaactgcctttatgcaaatagccacaagccgtccttgtatccccttgcacgtctgcatcattagtgtggcttgctgagtacggtggttgtacttagtcttgctatggttcccccttttcagaagtgtagtgcttctgagctgaa

SEQ ID NO: 10390 - DNA, 1407 bp, Oryza sativa
tcgtccgtcaaaaaaaccgggtgaaaaaaaccggaacgaatccgattcatcaacgcggtaaaagaatatgtccgattccacaaaaataggaaacaaactcccatctgttttcgtttgagctgattaggactttgtttttgtttgggcgaataggacttggtttgaattataccaagtcctattcggttagcatcacaaggagaacaagtgcatatatacatacatagtataaaaaatcatagcacataacaaagaatcacatgcagccttatagcactttgcaaaaaaacaaaaaattagatcgaagggggtcgccgccagcacacatatatccaaataaaaacaaaaaattagatcgaagggggtcgccgccgctgccgccgtcgccgtcgccgtcgttgccgaaccgccgccgtcgccgtcgctgtggatccggtggaggggagagcaccgccgccgccgcctcccctcccgctagatccgccagcggcggcggcagaggcactctccggtggtgggggagagcgccgccgccaccgtcggtggtgggggaggactccaccgccgccgccgctcgcgggaggaggggcgccgtcgccgccgctcgcggggcgcctccccacccgctagatccgccgccggtggtgggggagggtgctgccccccccgctcgcggaagaagggcgccgtcccctcgccccggtcgcggggcgcctcccctcccgctagatccgccgccggtggtgggggaggatgcccccgacgccgccgtgggtggtgggggtgcccccgccgccgccatcggtggtgggggaggggcgccgtcgtcgccgccgccgctcgggggcgcggaggagagggcggcgaagtgagatgggagggggggaaatgggctagggttccgcggctgagagggagtgggttttgtttccccactattgacgctcggtcgtccgatcaaaaccctagagatcggacggccggtgtcgtccgggccgaaatcggcccaagagggatcgagagtgaggcctcttttccggcccaagcccaggttgcggcctgggggaggaaaagtgcgcccgcgcatgcgcaaaaggccgtgggccgaccggcataggtcggaaataagtctattgttggtccctcgagccgaaaaaaagagaataagtacatttttagtgctcattttttcagaagcattacaattatagttctattgaatatgtttatttcgaagcaaacctataagaaagtattttctttctttttccaattaaataattgttaaatgatgtttgtattaataaaattagcaattaagctctgaaaattccaataaaattccaaagagcgtaactaattatggagaatttaataaaattaaatttaaccatgtcattttattta

SEQ ID NO: 10391 - DNA, 1501 bp, Oryza sativa
tttattttagtttgttttctattatttaagattaactttcactagagttttccttctcaactattttataataccttgtttagcaaatgaactaaatttctatatattctttcttccccacacacattttctctctcatcaacttacaacttataaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatataaataggggtgggactttagtcccggttggtagcgccaaccggagctaaagatcaccaggatctttagccccggttggtaataccagccggggctaaagttacgatctttagtcccggttggtaactaaagatcccgggggggcctgacatgccctgacagcattcgaaccgggactaaagatgatctttaatcccggttggtaccaaccgggactaaagatcaaatatgcccgttacccttttgaaccgggactaaagatcatctttagtcccggtttttattgcatccgggactattgcggaaatcggccgaccgacgaaagatggtttctccaccagtgacagattcatctctagaattggactttttttgtgtgtccagatttatctgtagaattagacttttttttttacggagggagtactccggtaagcacaaggccgaatttttctcatttttaattttaatttttttaatatttatagaaatattataccatccaaaatatttacacaaatggcccctgtcgtccaagtagagggcgtcaaggtgtacgcattttgcacttaggtcccttgccgtcctctacaagggctgcaagggggtaaatgcaatttttgtcctgccaaaaaatgcattttttctttttttttttcaacttgtccgtccctcacgtcacttctgtaaatgtttatatttacgccggtacaatatttctataaatattaaaaaataaaaatttaaaatgaaaaaataccgcacagggcccatccacaaactcagatgggccggcccgtcaaccatccgcgtggcccacttaattgagagagagagagagagagagagagagagagatcgtcttcaatcgcgtggcaccttaacaccggcacgcgcctcctcctcccctcccctccactccgcgagccgccaccttctccgccgccgacgacgacgacgacgccgcatccccaaccctagccgccgctcggcggtgctgcgacgtaggagcgggtctcctctctgcatgatccgttagggctaccgagccgatcgaccggcgggcctaaaaccctaccgagagaggctgcgggttgggtgggggtgggggcgtgctcgactctccggcggcgcca

SEQ ID NO: 10392 - DNA, 1501 bp, Oryza sativa
gtactcatctgaatgtattaaaatcttcctaacaacacgcgacatcgatatgatctacacgtccatgtcgaagaaaatttttgcttctccctccaggctgataatacttatcgttttagataagggtgaggtcaaactttagaatctttgattatgaattatttttaaaatatttgtctttcaaatatggtgactacgtatatagattagtcttaaaagtactttaataaaatcatatatttgatatacatattataataaaaaataatggtcaaagttattttttatttttaaaatatttgtctttcaaatatggtgactacgtatatagattagtcttaaaagtactttaataaaatcatatgtttgatatatatattataataaaaaataatggtaaagttattttttttaagatcgtgttcttgtttaaaataataagtattaccaatccggacgagtattagctatcacgagcgtattattcagagtttcagacaacctctactgtacggtactatctgtcgtatggaaagacttacaaacgtagccaagagaatcagagtcagactaatgctgggttggtaggggttggtgagacgaagaagtctttgcttctatctaactagaattaatatgacttaatcctaattaattacttccatattttaatgtatgacaccgttgactttttatccaacgtttgaccgttcgtcttattcaaaaaatttatgtaattatcatttattttattgtgacttgattcattatcaaatattctttaagcataacataaacattttcatattttcaaaaaaaaattgaataaaacgaatggtcaaatattactaaaaagtcaacgacgttatacattaaaatacggagggagtatattactactacatgtcaacctcttcagggttaacaagtcaatcaaccccaggattaagctggggttgaccaacctaattggttactactccaagacaaaagttatctctgccaatgatataatattaatctccagttactctgctatgatatattgtctgatctttgatctttccatgaagtagctagctagctagctattttagcttgcgtctgcgaggcaactgggttgcgtgcctttgttgtgttggaaaagtatagcaaattagcaatgcagtgcaaatgcagcctaattttttctatctagtgttcctcgttttacccttttttccattgtgctgatctctaccgtccattttgtcatctggtctgcagcgattggcttggtcaaccattgcaaacggccatccggttcagcaaatgtacttctgtgccaactatatgcgtatggctgcatcatcagccaccttgcttctatctataaatatgaccccaaaactgtcctggaagaagcatcacttcatcacaaaacctaccaagctaattcagcatttcagcttggttctataggtaggagctggtaagatcaccatggagaagctctccatgg

SEQ ID NO: 10393 - DNA, 1501 bp, Oryza sativa
ccttctcgaagccagcacacatcctgtccagcctctgctacccgtacgtgcagctgaggcagaagcatttcgcgcatcagtcagggcaggcactgctcaggcatgttgccagccgctccagggacacacggtgatcgacttcgtctgcagatttgatcttttcttcaggagtagtcttcgcatgttgtgagtgagcctgcttgtatgttcctgtatctatgtccgaatctgctcctgagagcattattagtttgtagtttgaatttttgagctcagggtaattatttagcatttgtgctttgttgttaagttttagatcaaattgaggtgttatggtgatgtaaattcagatttccatggtttgttactaaatcaaaaggaagaatgaaagataagcacaagaggaaccccacagttccacggaacaggtagaagagacgtcttgcaccaggcaaacgccccttgtttatagtgatgagagtatggattatctgtttgtcccctttaccatggtagtagagtactcaatggattagcaactttttccatgtctgtcactgtcactagaagaagctttgctagtgcaagtgttatctgagttgagcagacttgcagcagcaactgctgcttgattttcatttcattttattgccttcattattggtcagcttagcgttaagcattcaagcatagcctctgctcatcagaggaaagagaaagatgatgtcaaaatttatgcatgtttgctggcctgcacattagtgcactgtatattgttctgtctgtccacccataaagtttgaatacaaacttcagtcttttttcatcacattaacctattatacacacataacttttcagccacatcatctttaattttaaccaaaatccaaacttttgtactgaactaaacacagccaaaaagaagaagaaagcgtcctcccctccacgcaagcaagcaaaaaataaaaaaaataaaaaatttttcatgtgatgaagttgataaatctcacatctaataaatactcctccagtttcattttaattgatgttttggacaatacacggtctaccagatatatctttgaccttatttttctattataatatatacaatatataaatacatgtttacttttattaaatatttttaaagttattgatggttaaatttataaaagtttaatctcaaccttattcaaaacgtcaatcagagcgagcagttagtttccacggtatattttcccggtttgggttaggccatccatcctccatccctgggcgcttgctgggcctcggcggatcccccgaagcagccgccgcaacaacgagagaaaggcaacaaatcaatcaattcccccatcttcctcgttctctccgcctcctccccactctccatttatactcctcttctcctctccatcgccgcattgctcgccaccccgacgacgacgacgacgacggcgacggcggaggagtagagacagagagatggccgccg

SEQ ID NO: 10394 - DNA, 693 bp, Oryza sativa
gtcgagctcccccgcctttccccgccccaagttgtcgcgtccttggggagctcctcctctccctccttgcctccctcctctgtctgccgtgcgtgctgccgcgccggtgcccgccgccggcgaccaccgggccgtgcgccgccgctgttaggtcgaccggccggcttgtcgccgccccgctcgcctaggccgcccggatccccttgccgcgccgcgccaccgctttcccgcgtgcgtcggccgtcgccgcagaaggccgcgccgccgtgagccgtcgctcggccgggccggcctgagctgtgccgtgctcagccgcgccaccccgtggccgcccgtcggttcccgtggaccggtggtggaccgcctcggtggtcccggtccacggtggaccggcgcccttgtgccgctgaccggtggggcccgcttgccggcgccgcccctcccctttgatgacgtcagcaaccgtctttgcctttgtaaaaataaataataattgcgcaataattcgtgaataattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcatgcca

SEQ ID NO: 10395 - DNA, 1290 bp, Oryza sativa
gtcgagctcccccgcctttccccgccccaagttgtcgcgtccttggggagctcctcctctccctccttgcctccctcctctgtctgccgtgcgtgctgccgcgccggtgcccgccgccggcgaccaccgggccgtgcgccgccgctgttaggtcgaccggccggcttgtcgccgccccgctcgcctaggccgcccggatccccttgccgcgccgcgccaccgctttcccgcgtgcgtcggccgtcgccgcagaaggccgcgccgccgtgagccgtcgctcggccgggccggcctgagctgtgccgtgctcagccgcgccaccccgtggccgcccgtcggttcccgtggaccggtggtggaccgcctcggtggtcccggtccacggtggaccggcgcccttgtgccgctgaccggtggggcccgcttgccggcgccgcccctcccctttgatgacgtcagcaaccgtctttgcctttgtaaaaataaataataattgcgcaataattcgtgaataattctagaaattcatttaaatggctcaaaacttctaaaattcatatctaattcattcgaactccgaattgagccattcaacttgcaaaattcatctaaaattgagctctacatgtttgtttactttttatgtactgttttcttggtttttattagagtttttcctcgttttgcatgccagcgtgtagtttccgtcgtttcggaagtccgcggtcgcgaggaaaagagttcggaagatcaaagtgaagaagcaaggcaagtcacacatttcccttgagcatattgatcccaatttacagatgttttactgtttgcaaataaatatgcatgttttgctaattacatgggatccgggtattacctatctgctcgcttgtgccatgtttacttgatatctgttctttgtcaaccatgggtaataaatcgcctagcttgtgttactttggtgacctagctagaactatatgcttagccatgcttaattaccactagctcagtcgatgggataattgcagtattagacattctagtatcttgttgagcttcgtgctcgagacatctggccatgcttcatggtcgtaattatccaactaaaatgcgactgcatggtgggctgtgggtgcatggttttgctggtcgcacccatgtcagttaaggaccggttcgcggaatgccctggaagaacttattgtacttaccacaagccagcgtgggcaacgactgggcttgtagtgtagctttcctctagccgacgcatccaggcaagggtgggcgtga

SEQ ID NO: 10396 - DNA, 1051 bp, Oryza sativa
cttgaccctctatatttatagcaagggtggtcttgcgtctacagaactctttgcatgttctattaggttttttttggaaattttacaatcaaggacaccccggatcaatgaaagaaacatggggaaactctacttgaattcggactttgtgctgaatgtctaaccgttcagacacctgagtctgatcggccatacaatggcggttagatcagtcttcgtgggaaagcttcgattttttttaaatttggtttgaacttgctatacgtgtaaattattgccaaatttgagtgtcaacaatattattgtgatagtagataatattaaggatttatgttaagtaaaatatagaaattataaataccaaagactctttagtttttactaccatgaatctctagctttagttttgataaaattaaatcatttttaaatttgatattaacaaatacaaagttgcacccatcttgaaatcctaatttattaatttatattattgtttaaacacggtatagacacatgtgcctatacacatatgcacactcaccactatgaatatccatacggataccgtacccatatgagtaccttcgaagactagcctagcatatcttgagattgatgaagtcaccatagatgcttcgttgtcgacggatacatcgtctaacactaatactgaaataatttataagctaattctaaaatagaatgaaaacaaatatacaagtgcatgacacatagatttacggttaaataccatttctaaaataaaaacttagacaaatgagttaggactagaggtacctagtctaggtctttgtttgctatacgctatgcaaggagacactaacatattgctgtggtcagtcaaaaactatatgatacatttttcaacctgatacagctatgcacagggactcctcgcgtgcatatggaaagagagaggagccatcaacaatattgcatctataacattctaattttgttatgcctctttgcaacccaaatttgacttagttcccaatttcccatccatgccgtgatacatcgcagc

SEQ ID NO: 10397 - DNA, 1501 bp, Oryza sativa
cacctccgcgtccggccgccgcctcgtcctcaaccgcctccgcctccgcctccgcgaccgaccgccgccgctcgtctgggcctcgcctcgcctccgcgaccgcctccgcctccgtgcgcagccgccgcctcgtccgcgaccgccgccgcgcgcgcctccgcgtccagccgccgcctcgtctgcaacctcctccgcctccgtgaacgaccgccgccgctcgtctgcgaggtagccgctgggagccagacggccctaacggtccgtgaaagttctccatcccatcccacctcaatcccttctaccaaacaaaaaactataaccatcccataccacaaaccaaacagacaactggaactatcccatcctaaaaaactgggataggtctaacccatcccactttgtccccaaaccaaacacacgccaaaatgcctgccaggctacactgtcatccatatatattatcgcacaggggaatacaatagagaggattaaattagcatcagccgtttggaaggttaattttcctaaccatctctgcatcccaatttgccgttactggatcaataagctcacatatatgctcctggtttatggatttaaggacgagggtttgaagggatcagttgcagctaaattagcttaagtgggccacaattttatcaccaggcccaactgtccgcaattggtccctctgttggattatgtgacctacctaaacatgaatattacagcgatttcatcttatatgctatttaaattactagaaaactgaaaattctaggaacatagaattatgatatatcctatataatcgagtacccacgcagcagaatttcagcacgggctatatattccgagaaaattcaacgaaatcaagtaatgatgcttattgatgttcattttataattatatagcacaccccacttcacacgcatatcaagctgaaaaaaataattgatggagactaggtacagtccgcctactgagcagcccccttccagatgaccaacatgtggacaacagactaatcaaataatgaccagctcaatcgactctaggagccgtgatttcaggaaactattttgatccctcgaggaaccatggctcttccgctcgatcgctccggctcgccatgactgcctatgtggacctgcctctgcctatcgcactcctgaatcagcgacgcaccacaatacggacgcattcatgacacgtacctgcactagaattccccttcccaaccttactaatcaatcggatgcatatatatgggcttggttgttttgcattgcaacaagaaaatgggtcacgacaggtcaggagcgccatcatgggatccactgccatcacagtgactattcacccaccaggaatacagtggcctagttgtgtctataaatatggccccaaaacctgtcctcaaagaagcatggcttcatcagaaaatccatgaagataattgagcttggttctaacagctaatagctgatcagaccacca

SEQ ID NO: 10398 - DNA, 1501 bp, Oryza sativa
tagagcacaccatcatctatcaaaattatataaaaagtgactttatatgttgatttgcaatttaatttcttttgtatggtcatttgatttggttttttcttcgatgagtagcccctttcttcaccaataaatattttccgttggttcaattaactaccctattgtaatgttacaattttaagggaaataaaagtcacctgatgttttctttaatgccaaaattttacggtgtgggtgcatgactctatctaccaggatttaaatcctagtgccatgaatattacacatatgtaggtgggctttcaacaggattttagtgagatcagggatgtgccgttgatttccatctcttagagtatgtgttagggatgtgccgttggtttccatctattaaagtatgtgttagatgacgcattcatgggggtgtaggtgtggttttgcgtctgtagtggtgtatgtgcgtctgtgtctgccatgtaatttaaaaaaaatatgttgggatttgtgactagtaaatgtagcagagtgtggaggtctatctatatatggtgcttaaatcttttttttgctgttttttttttagaaatggctccttggttttctatccatatgtatatttttttaaaaaaaaaagggtataatttctatgtattgatgcaacaaatctaatactagtactatatgttataaaacagatatcactagaaaatcagcgcgcctgttgacgcgcttactatatgaccatcatgtgtttatcttatatgaccattagtcaatggcacatacatatattttagtgaaataagttgaatttttttttgaatttgctacaggagcttcaaagaacctcttactgtgttttagctttcaatgtaatcagtatcttataatattgtagtgaagtatgttgtattttgaaaacaaaacacaatatttccttttttctaatgctactttttctcatatatttatttttctattagtgaccctgtaaaggagtaagatggaaaatacataaagatatatttagtgcataatcagatcactgagctagttgggtattgaaacaaccaatgaagaataagagagcagacttctatttcattctagttcagatttgagaaagttctagacttctatttcattctattagtaattgcttgatttatctcagtttttatagtgccatgtggaccaatcacaatcctgtaaaactgccggcttgagaataataatatttgataagaaaggatggagcaatggaaatttttttagtttccaagggaacagatacttgggaagtcgatgtatatggagatgtatgttgttcattttttttatttactttgttaggattttttttcccacgcatatgaggaacggcagatcttgattcattttaggaggggcaacaaactttctggatctgacattttttttccttaaaactccttttgaatataaaattttacacattggtccgttgcaccagcatcattga

SEQ ID NO: 10399 - DNA, 1501 bp, Oryza sativa
ctaggctatctcacactttttgctactgtctctccaatctcttctccacctccaattcctgacctccaccatggccatcgtcagctcaacccttgacctcaagctcatgatctagctctgtccacctagagctccaacgattactttctctagatgacaatagagagctgaagctcggtagcaggcctctctaatgcactcagatcctagcaactggcagggttggcaacggggtggatcagggctgggttggacaagattagccttagccttgactttctcccccaacctctggcctaaaggagaaaacagtgccaaataaagccccgcccctggtcttgctagggacctaacctcccatcaaggcctcattagttgctggcaggcaacaaagacacataaaggtggtgtggaggtgaggttggtgggcatgtggtgggtggtggtgggaggcatgtagtcaagggagccgagggaggcggcggagcagcagctgcacgtttcgtgcgatgaaaatgagggtggcgtcactcgggactgggagagggagttgttgtgcatggacatacacatcgatccttgagctagtaaggtatgtggggattagtttagatccattttatactccaagtatttgggccagcctgatattgtgggtttttctcttgtaacttgaggagatatcctcctccattgagattagtttcttggccctaggccctcatgatgtcggggcgccatgctgatggattcgcaggtgcagattttgctctcgtcccttagatgcgggtctctacacccattagggaaactgtcacccatagcagccagatttgagaaagacgaactcagcccttggttgtgcttatctgagagtccaccctctgctaagcttgatctatgcttgcatcacccaaaactagaagattgaacttgtgcaccctaccccaatgatagagctccatttcctacaaccgtgccatgctgcccaagctcgaggtccatcttggcctatgtcctcatggcccgtggattttacctctacatctgagtgccgatttgagtagtgggaacttaaggatatagtatatcgattcatgtctaactctacatttttttaaaaaaagaaagagttttgcttgccagtatgttttaacaatatgcacaataaaatagaataactcagattgttatgtaccaatttaggtgagcgtgcatttcagaagcttagcaagctctcgctttcgcacaacagtctaacaaatgaaggcgttgctgctctagttatcaaccgaactacactttcagagctgtaccttggcggaaaccagttacttacaacaagttggatatccaatttgacgtctcttagggtggttgatttatcccagaacttcttacacggatacaacggtatatctccgctctttttgttagtatccagggcaatttatccaatatttgtgttttagttttgcaggtatatgtaacctccatcaac

SEQ ID NO: 10400 - DNA, 1501 bp, Oryza sativa
tttattctgcatttgtgggtgtgtcttgttgagtacggtggttgtactcagtcttgctcaatttttcccaagtccagaagaggagctccttgaagatgaaggctttggtgtctagctcgtgcctgccgtcaagcgcctgtggtcgtcgccctagtcttccgctgtttttcgttgtctttgagtgtgctgggccttcgttgcccatgtaataattttatttacgcttccgcttgataaactctgaattgtatcaacttttggtgtaccttgcctcctgggacaaggaataatacacgcacgtcaggaacgcctgttgggtgatttccggtcgtgacatggtcagcgtgaaagagaaccaaatccaccaaatgcataccagtcgaagctgggattttcttggaatggactacaggcaaccaaatggcctgcttgctaaagctaaatatggggatggcactataattggtgtcattgacacaggtaattatttgggaaggcaattaattagtagtaccttatttgaaaaggcaattgataattatttcctgcatggttatatagccgttccaatttcattgttttgttgattatatataccacgcgaattgaaaaaatatagagtgtttgtttggttatccgcaccactctaaccaatgtaggagtcaatcgaccatttcggcggcctgggtaggtacaaatggggttatttcattggttagattggttggtcctagatatggtgagatatcgtttggatgagtgtatgagaagcttctgtacatataagaggttttgtttgattggcttataagtattgagttcagccatacaatatactgctagtatatactgcaagtatatatgatctaacggtgtagattgatttaattttttatttaattagattgcagtataaactttgaaagggtaattttatcttttcttcgttattctatcatcaaatcgtgctatcgtcatgtgccttgtcatcaaatggcgctcaggatgctcctcccctaatgcacgataagatccaggaacgggtactctcaattagattcaatttgaaccaaaaattactaaagtgttgttttaattttctatcaaattcctaatatatatgcccttttatatactgccagtatatactggttattgtaccgtaaaaattctctatttttaagggtggcaacaataattgtaacgtcccgccttcccccaggctgggctcgcttacatctgatagctttcataggtcaattagattcaatttgaaccaaaaattactaaagtgttgttttaattttctatcaaattcctaatatatatgcccttttatatactgccagtatatactggttattgtaccgtaaaaattctctatttttaatggttattgtaccgtaaaaattctctatttttaagggtggcaacaataattgtaacgtcccgccttccgggcaggcctatttttaagggtggcaacaataattgtaacgtc

SEQ ID NO: 10401 - DNA, 974 bp, Oryza sativa
taaaatgtcatcgcaaagtaggagtatactcctaattccagactaagatattaattattggcccatagatatgctacctagtactagccctccatatcaggtactacctccgtcctagaatataagcatctttaagattggacatgaataataatgaagtaggtagaattaaatggggaaggttgtgattagtttagaagtagaggtaggtggaaaaattgaatagtgaagaattgtgattggttgggaaagagaatgttaatgaagaaggtgatatattttgggatgaatcttgattgatagttgttatattttacgacagatggacaaattaagaaggcagcagcatgggcctccaccctctatgtgggaaaagaaaagacctaattcccgatgtttggaataactatggggactcctagatgttattgaccttggaggcattgtattagaggtcccccattggtgcggcattcttggtgccgttgtcccgctggatcggtttcaattgttatggcggtggcaagatttgggagaatgactaattactctctgatatttcttttgttggggttctcatcagcggtgatgtgagagaaatttaatcagcataactaatgatcggctgttatttcgaagattttgtttcctgatttgagaaagacaattactacataaaatttgcaagtcgctgagataaactaacggttatgtatattcttgccaactatggatgaatgtctttaggctggtagtttaagaagttttcttgttatgtacttcacagtcatctcacttgcaatctctgtaataattggttattacagtcatctcatcttgttatgtgcttctttgaaacaaaagccaaaataaattccattattaaaaaaaatatccataattaaatctccaagaaaaggaggcacatgagtattttaataatccaaacttgcagagacctctccttgtgtagg

SEQ ID NO: 10402 - DNA, 1501 bp, Oryza sativa
agctaatctttccccagaaagctagtaaaagcattgtttttcatagcctggagaacattgaaattgatcgaccttgtgctgtgacgacgtcaatttgaaagattatacgacgacgtcaaatctccgaccgaaaacaggaggagaggggtaaatggatgatcgacctgcccgtcaaaaagttaatagttttctgggtcctgtcatatatattgctgaatgacacacacacatataaacaaaacctacatcagcaattgaggttgaggtagattcattaattaattactactactactacctaatacttaaaaaattcacttgcctttgatcacgttgctgtattataatcaggtagattcaacggagagtgacaggatttcttcaagttttgcgaagacaaccaaaaagttcaattgaacactgtacgacagatgtgatacatatgatcgatcgacgaatgaggcgatacgatggaagaaaattgtagtattcaattaaactctgtcgacgattgacaagttgagctgttagtagctagtaaataacccgcggcagataacaccgaaaacgtgcatggtttttcctggatctcttctatcgatggatgtataaatagctcctaccttggcaagctctaactatcatatcgcagttcatttcacaaacggtatatgaaaccatagttcatttcaatccttccatatggctcaagctggtgtacatagaggaggctgttgccgactcctctttcttcttgttactgctcttttgttgcgaagatcctgtgttgttggacagcaaagccaatccaagaaagtatactggttttattataagtgaaatgtacttttctgtaattttgaccccatatatattttttaaaaaatgccgtaacatcttgaaaaaaaggtaatttcattgaatcaatgttttccactggagttttctttattgcccattaagaagttatcggaggcactattagaactaggatggtaaaaatgtcaatttcatattataagtcgttttggatttcttatgtcaaattttttgaccaaatatagtaacatttatagcattaaattagtttttattaaatctaacattggatggtttttttttgttttatgttgaaaatattgttatacttttttgtttataaatttggtcaaaactaaataagtttgacttcaaaaaagttaataatatgaaatggaggtagtagtctatgtgcctctcggtatctaactataaaaatgctcccatatataccattgagtcaatatatagctaagacgtgtgctggtggtaactactactctctccatttttaatgtatgacgatgctaatttgttgagatatgtttgatcattcgtcgtatttaaaaaatatttaattattatttattttattgtgatttggtttataaatgttctttaagcatgatttaaatatttttatatttgcacaaaaaatttgaataggacaaatgatcaaacg

SEQ ID NO: 10403 - DNA, 492 bp, Oryza sativa
gacacgcttgaccagactgcaataaatgctgttaggtgagcacagctgtgctcacttatcccatatatgtggcgcagacttccttaaggggtcggggtgcctcggccctcggggccgggcaagcgcaacccgacccccccccctcgggggaaatcaggaggagggcggacacctcaccctcgggcccgacgtccccgaaggtgccaggccacgtgggcgattgtgtctgcctcaagcctctggtcatgatactcccggtcccatatcaccgacaacgtgggttataaatacttgtatgcatggatgcatgcatcaatgtccatttactccaatgcacaaataatgaatagacttaatgaatgaacacaaatatgtagatcatttaggaataacctcaaaaaaaactttatgtagatcaatttagaatggagggagtatcagattaggtgttcctagatcagttcttatccctttaccctgtttgttcatagg

SEQ ID NO: 10404 - DNA, 1501 bp, Oryza sativa
accctactcctgtgtttttgtggatttgtgtatggacaagttacaaaggattaacttcctttcccctcagccttccaaaaaaggaaaaaaacccccctctaaatgggcaaggtcctccttttatatctcaaggggataccacatgcacctttctctttttaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccgggcaagcgcaacccgacccccccccctcgggggaaatcaggaggagggcggacacctcaccctcgggcccgacgtccccgaaggtgccaggccacatgggcgattgtgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggtgagcagatttgtctcgcccggagatacggtaacgccgcttcagtcggcgagcgtaattaacgcgcgcacgatacaatccatttcgattaccacaaccgcatatccacttcctgcgccgtaagcgggcgaatgggattagtggaagcgtgggcacgggaaacgagggagcgagatagcgagatacgagggagcgaggtagtgggcgcgagaaacgaggagccagggccagcgatggcaagggtataaaagcatcgagaaaaggatttgcttccttcctttcgccattgttcctcttgccttcgccgcctgagctctaactctttctttgctacgccctactttcgccacacgcgctcgttctcaatcatctcttcctccaccgcca

SEQ ID NO: 10405 - DNA, 1501 bp, Oryza sativa
ataggataggacaaatcacacggaagtacagttggattcaccaatgaagagccctgaatttccaagtataattaatttcgacgaatcaccgctcgtcacttctgacctcacatcgaccggatcgcccgaaaatcgtctccccgacggcaacgacagaccggcttcgcagaaaaggccatacgccgaattctggacagtcgtccagcacgacgcacacccagcagccggccgccccgcaattccagccgctccagaagaaaaaagagaaaaaaaaaacaagaaagggagagaagccgtaaagaaacagccgagcaaacggtgggggcgccgcgacgaaagcggcgacctcccgatgcgggcgtggggcccacgccccccgcgcgcgcgatggcgaaacggccgccgcgcgaatcactgcgccccgccccgacgcccccgcgcgggcgacgggtggtcccacgccccctgtctgccgcgaccacgccaggtcctcgcgcgcgggggccaaacacgcaccacggaatccagccaacggaaactcgcctccacctacgcgccggccgcccgcagatcgggccacaccgcccgcgcggccgcagcgacgatcccggggggcccggctgctgctgcgagtggccggcagcggcgcacacgtggcccgtgggcgtgggcgtcgtcgcccacacgctcacgttactcccgaggtcacgagcggaaaggaaaggcaggcacaggcgggggcggggcgcaaccaacccaccaaccaaccgaaccaacccggcagcacgcgggcgcgttgccggtagccatccacacgccgtacgacagctgcgggcgcacaccgacgcggagccgaaagatccacccgccccaccgcacgccgctcagggcggccgcccgcccccgcgccggtgtttttttctattcggctcgattcgatttacgcgttcgttatccacatgcgtcgtcgcctccttgtgccgctgccccagccttgacagcaacacgtactatagcggcaatagttttttctctcctttttcctccctccggtttccctgacaccattggtcagaaaacgaccgcgcgcgggcaaggcgagtgcccgcgttgaacgggtaaaaaaaaaatctttgcgtcggcaacggcgactgtagcgtcggtaggcctcatccctctacacgcgtaagaattgacaatgattccacctcactcgtgctgccaactacccggggttaaaatgacatcgccgctgatacgggtgatcgatccggtgcctgctaaagtcgacacgtgagtggtgtagactgtatgggtgggatgcccatgcacgacgagacgactgagtgttcattaatcgacaaagataacggcgattgttgcatggatcgcaagcaagagaccagaagagacgggttcgaagtgcaaacgctcagacgacatgccaccaataaatgaaccgccttgccggtaacgctcctgatttatcacgagctagagc

SEQ ID NO: 10406 - DNA, 1501 bp, Oryza sativa
atcttgcggagccgtttcttctttcgctcctcctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcggggccctgaagcgcgaccccctcccggggtagattgttcccccctgcggctcccgcccgcgccatcgtggcctcggggggcccgctcccccgacgccccgaccgcctgcatgatggtcaggatgttggcgcggtctggatcgcagcagagggggaggaccccttgggggatgagggatgcctctacggagctgagattcagcacccgttggaccaccatcttgaagtcttcagggacccagtcccatttgcacccctggtgggtcctcatgtagtcctcggacccggtgtactcccaggcgccccgggcgcgccgctggagcggcgcgatccggcgacgaaggtagtcgccgaagaccatggcccccgtgagcccctgggatcgcagacccgccaggcggtcaagaacggcgtcgtagccgtctcccagatctaccgccgcccgccagctggaggcctgcgccgggggctggctcggaagtcggaggcgcgcttcgtcggcgaggggggtgtagaaccagtcgctcttccagtcgtcccactttttgcggaggacgcagggaatgtagcggttcagcaccggcccccgcggctggaagtagcaaccaccgactaccgtcggcggcgacaccggctgtacagtgaagaaccaccggaacagccggagagatgggcgcaccccgataaacatctcgcacaggtgcgcgaagatggccaacgtcattatcgcgttgggggtgaggtgcgccatctggagatcataaaactccagaatatccatgaaaaaagtagagaatggcgggaccagccccgccattgcgaaagagaggaagaagacggaccgccctgggtagtgtggcgccgggcgtccttcgcccagcgcgaccacctcccggccggtggcagattccggcatgaatcggcgcggcagcccggcctgcctctcgctcacgatgcgggaaggcggcagcacgctaccgtcgagcggtgcggagccccgtgccatgacgccggcggaggaggagcttgagagcgagcgagtgcggcgagggtagggcacaggagacgaagagttggagcgccccgaccccctgaggttttggcgccacgtgtgtgggttaggtgagcacagcggggctcacctaaccgcatttatagcgggttggacgagcgcgccacgccgcatttaatgcggcgcagcgcatgcttatccggtccgtgaccggtcgcggcgtgtgaccggtcacagaccggtcagatcgcgggattaggtggcaacaggcggcctgtcacacgcctcgccccgtcccgtcggaa

SEQ ID NO: 10407 - DNA, 1295 bp, Oryza sativa
cccccccccccccccccccacacccgtcgcaccggatttggtgaaggcgatggagaaggcaccccgcggtggcgtgcgtgcggtttctctaatgcagaagagttggctaatgccggcaaatagacacatgaagaggccactaatgaggttgcgagaaagggtgcttagataggtggtagtgatgcctcgcggagaagtatggagaggcagttggaggggaggcacatattcgataggccatgcacaacctgaacatgctaaggacatcacgacgaacatcttggcataggcgaaagatggggcgtgaatgaagatagcgggagttataggtgacagcggtacccgagtggccaactatggctcgatggcagtaacctaagacgatggcggtgccagtggcatccaaggtatatgaatctggcctgatggctagatctaaagctctccaattgataaaaggtggctacgctaagaagggaagatagtggttccttatagcaaggctaataatacagccgacctgctggctataaggttctttatagccttctctcagcctatccatataatagttagctcttcataattaatacagggcccacttgtctctctcacagagtttcttggttcttatatccaagccggctgttagtttacagcccgcttctcctctctctcttctcttcttttctccaactcagcatttagctggcttatagcctactattatacttgctcttagcaatgtcgatgataacaaggatggctagatcaggcctaatggacggattcagtatacttctggaatacaaggcggctacaaggagagaaggcatcgacaagatatcgacgagctaattggaaattctggtgaccgagagggtgcgatgctgaatcttgggtctaaagagcaggtacaatagcagactattagccagctataaacataatttaatgagataaaagatgagagagaagagcagcaggctacagatctgtagccagctgcagcacggactccaagacgtaatgtgtgtatgacaggtgggaccatatattaatactccatccgtcccaaaatataacaacttttagcacttaggatttgtctcaaaatataacaacctctcaaccaacattcatttcacaaccaatcacaaccctttaccattcacttttcttacctacctccacttctcaaccaatcacaacccctttctatttaattataggaaaaagtacgaattaccccctcgaactaacgcagtcgtccgaattacccccctgaactacaa

SEQ ID NO: 10408 - DNA, 1501 bp, Oryza sativa
gaagttgttatattttggggtggagggagtagacttttttttacaacaacataaatataaagtagagaattgtaaaacatgtaaaaatacaaaaattaccatttgataaaaaaaagaagaattttaggaaaggtagatactcaaagaaactctccgtgagattcgatcacatgttaaatttttctaaaacttgtatggattaaggtatttgataggaattttatagaattcagtggtgtccaaaactttatttcaaatgataatataggattatgatcctacaaggagttttccaaaacacccttcatcactataacacaaatctgatgccgacaaagctttgtgttgcttgggagccttcgagccttttttggacaatcctacttgcaagaagctatggtcaccgggaaccctaattgctcgcttggacgagatcgctactacaaatctttagtcatgtgagcaagtcaaggaaagaaaactattcaatatctaaaaacaaatgcatcaagcaaaacgaggcaagcttgtgaaagctgtggaaatagcacctatttctaaattgggaaaaatattgaagatgggttgctatattcatttaagggtacatttcaggggacacgcgcgtatccaaactccaaacatactaggaaaagctaaactaaaaagagatcggaagtctagcctttagtgcacgaggaacgtacggtcccaccaaacacatacatatattaacatgtgcatattttgacatgagtctagacaaattgtagatcaactagcctggtaggcctagaaatcacgagttctttttccttgcatacttgcatacgcatatatattaagggtggccaaatcccattggggtatgtctctgcccctatgaggcttgggacggagtagattttgccccatgggttccacatgcgcgaggaggggggatgttccattgtgcataaccaaggccagggatccattcctaccatgaggcctcgaaaacgataaggccaatagaaacaactcataattcttaagaaaacccatttagtaggctcgaatacaaaccggggttgtctagtgtcatatgaacgtcttgtggaaagaatcactcaaattccaatggttgagatctcaccaagattcatgaaccaaaaccttatcccctctatccgttctaattcctctagctttcactagacatctagatgcgcccgtcatcgccaccatagccttgacgacaccacggttggccacctcctctttactatctagatggactgcatggttgagtagatatcttcttctataactccagtgtcaagcttcctccacgccaccaagcgtccaccatctttggcaacctacgttgccagatccaccaaccccccccccccccccaattcctcttttaaccactcgatttgtgtcaccccgctacctacaccaacccaccgttgacttcttgcttgtgactccagtggcatcaacgtcgcctacggta

SEQ ID NO: 10409 - DNA, 489 bp, Oryza sativa
ggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggtttacggaagttattgttttcatcagggacaa

SEQ ID NO: 10410 - DNA, 1501 bp, Oryza sativa
  unsure (1)..(1501): unsure at all n locations
atcaatctttttatctctccttgatagttgatacccacaccaaacactaaaacttgctatattcggggatgaagggtgcaataaatttcttttttgtgtttttgattgtcacatagtttgcaaaaggcatttcatgttagtaggggtggatttgctgccagcgatccctagtgaccgcccgagctcggcgacagacgcacaatgggatttgtttttttaatgaattgaaaaatattttcacaccaaatgtttgatatactaatattttactaggcttcttttatttttcatgagatggtacacattttttactagacttcttgtcaagctgttaatagtcaaatcggcagcgacggcttttgtatttaggttttcgatttgcctgatgacatcggtttgctattatgttgaatgaagatgatggttgatatttgttcatttgttctgcatatgctggnangtntggtcaaagcgtcgtggatacgttcgtcgctcgcatatattgtaacattttaagatgtggaggctctttattctattttttataacccttttatatcatacctcgcttagtattaggctcgttccaattgcagctgcaaatcaacagccgaacatgcccatttaatataatctaccttgttcaaggaaaaaaaatccctacaactacgataaaaaatcaaacatcataactcaatatcttataatctaaagctgaccagcgaggacaggtaatggacggtagatattccgacttcacaacaattatttaatatcgcaaacaaataaactaaatataaatataaaagttggaaatgaattaaaagaaatatggatgaagaaagtgttttttttaaacaaaacacgttgtttagcaccttgataagcacatccacgatgatctaactttagaacaaaacgtcccactcaaaaatttcaggccaattttgatgtaccagtaggaagactgtagtaggatagatacgaaactgtaggatattcacggactcaccgataaacaggacgacgcaaacgccttagaaaattttcgccccaaatttttgtttacccggtcgtgtctcacgaacagccgcgagcgcgcggggagccacatattgagaaatgagtaaccaaaaaaaaagctagcgagcgagcaagcgaaggagcgggccgagatcgcgagcgcgacgcgcgtgagagggacgggacgggaggcaagtgggcgggggcacagcacagcggtggtcagtggtaagtggtggtctagtctagtggctggctggcgctctgccgcccgcgcagccacaagcccccccagcgcacgccgtccccttccccgttcccaatctctccgcctcccctccccaaccaaaccaaacgcacggccacaccgccgntgcgccaccacccacacactcccacccaccatcacgccacgcctgcagagccagagactttgagccgccgtgccgacgccgacgcttacgccgagcgcccgcac

SEQ ID NO: 10411 - DNA, 1501 bp, Oryza sativa
aggaagaggaagaagtggtgcgcgtcctcctcctcctcctcctcctagaacctatcaccatcgtcatcgccgtccgccatcaccccgttccgcgccgccgacttcgcacgttgctgctccgcccaccattgccccacttcgcctgcctgctctgcctgacgccgccccgctggctttgcgcgtcatcgtcccactcctcctcctcgaacttgtcgctatcgccatcctcatccgccatcaccccgctccgcgccgctggcttcgcgcgttgtcgctccgccaccatcgccccactttgcctgcctactctgtccgctgccgccccgctgacttcgcatgtcatcgtcccactcctcctgcctgctccgctcgcggccacccaacttcgccccacctgtcttctctgcacatacaaaactatattaaggacaaatctcctaacctcacaccaatcccaaaatgcaaaaacaaaacccctaatttatagtgtattaatgcttattaatgcgataggagctataggttttaaaaacacctcgtaaaactgtctatttgacattagggcagccacaataagccaataaaaaggattataaggctgaaaagatttctttggttggctatatatatattatggcaatagaccataaataataaatataaaaagtaaccataagcttatggcccaaacacaagcaataaaataatacagtatacacacactgaaaaatagaaccaaacaagaggagagaagcagtcagtgcttgatacaaattatttttttacgttgcaccagctataaacattgtgaaatgttctagaccattttttcaagcaagtgaatcctagcttaagagcgtgttaatcttatacaaattaagaatgctcttaacttttttttttcaaaattttgactatcagctttctattagatccaaatggtactttctccgtttcacaatgtaagtcattctagcatttcctacattcatattgatgttaatgaatctagctagatatatatgtctagattcattaacattaatacgaatgtgggaaatgctaaaatgacttacattgtgaaacggatggagtactatctaacaaaattattatatcgttaaaataattataatgaaaaaaacactcatataattcttatgccttaaaaggagctattgatggttaaagtttaaaaattttgaatgaataaagtctaacagtgtcatgtttaaatacaaagagaatatttgtttggacttagactaagttataagtcaattgataagtccaagaaagacggatttaacgtggggcttaaaaatccaaatacatatttattatctaaaaaagaccaaacaaacttcttgtagatatttgtaggttgaaacatgggctattccttttcttttgtttaagaccttgttatcttctagttggctttctccaaaattccaggcaatgagaattaccttccattctcaaaaacaaaaacgtgggc

SEQ ID NO: 10412 - DNA, 1501 bp, Oryza sativa
gaagaactttaccctggaggagcaagccaaggtcatagttgcaccgagaagcaataatgagcttgattgtaccaagctgaaggcggaatttccagaacttttgtcaatcaaggattctctggtaaggtatgttttcaagccaaatcagaagacgtccaaggcttgacaaatggaacggtctgcacacaatgttgttgttatttattccatataaattgacatttctctccctggtgacaatcaataagcatgcatgatgactctttccctgtgtgtgcattgtttttgaagcagataggtttctcataggaagtcataccccgtcccgtcatattgattacatagaacaaggcaaggtgccatatagttcaacttttgtatgtcttctggatcgtatgaataccgtgggaaatgggtaagggtggagattcctctgtttgtatcttacaattggaatacagtcagttgcactgcgtgttgttcaataggaaatggctttggactttccttcatgtaacatgtaatgtaatacattgaattctcagctaatatattgatatttgatagtatcgacttaggtgatgttattttctcaaagatgaagattaagtttttttacgcaaaacgagctggtattaacatatgattgattgagttttaattactacaaacttgaaaattaaattaatatgatatcttagagcaactttcatatagaaagtttccgtatgaaacgcaccgtttagaagtttgaaaagcgtgtcacaaaaatcttaattttcgtccaactcttgttgaagaaaagagcaggactaagacatctgaatttccaattttgtttttgaaggagggtgaattgtcacaaggtatagcatattagctttgatttcttaatttctttccatcgttagattttgtgccggggaccgggagagggaaaaccatcatgaatagcataaatcaagccaataattcatcagagaagaaaatgtatacctcatcaactactccgtggaaatacatactccatctatttctaaatatttgacgcagttgactttttaaaatatgtaaccgtttgtcttattcaaaaaatttaagtaattattaattattttcctatcatttgattcatcgttaaatatacttctatatatacatacagttttacatattttaaaaaaatattgaataagacgaacggttaaatatatgctaaaaagtcaacggtgtcaaatatttaaaaatggagggagtatttgtttagaggaatcaaaatgattttgtagatcataccagctcaatgtcggcgactcggttgctgttgctcgctcctggcggaagcagaattttttttatttataattttttttattaaaagttttacaaaaataattttccattttgaaaattgacggaaatagtcgcctaccgccctctgggagggcgatttttaaaaatcgccctcccaagggcggcgaaaatgacgtggcagacggcc

SEQ ID NO: 10413 - DNA, 1163 bp, Oryza sativa
aattaccctgcaaaccttagaatgaacctgccaatgtccctggcagcatttgtgttcccattcgccgtttgcaaccaatcacatgtttcttttaatcaaaaccaatgatatgcttaacaaaaaccaacactcagctccttatacaaagaaaaccataccaagaaaagagacgacttcagtacaccacaaaatcacaggaaaaagcagttattgatcacccccccccccccccaacacacacaccaaaaaaaaaaactcagtcattaaaaccaacagtctctactagcaaaaagcaagatacatatgccaatatgcaacctccataatataatgatggacatcttttctttttctttttgctttgtttgaggaattgggtttgccatctataccctattattggaaactaacaactcactagcacatgatttttttaattattttttagacttttatttttaaattttatgaatagaccattccaaaaagtatttccaaatctgaaccttttggccacgccaccatggttggcgtggctaaacaacgcaatatttttggaatggtctattaataaaattaaaaaataaaaaaaatcccaccacattaggctaagatcagcatacctagccagtttgatcatttgcagttgcaaactttgcagattgttggatttcttttatcgtccctctacctgtgcagatgtagagatgctcagatgccctatctgtcttctttagcagcgcatcaacatgatcggctcctgggaatatcaatattgacttggccaaatcaatgactactggagctctgtggccttgcaatactcgcactccaaatacaccgaccttcaggctaatggccaggcatggtgcagtggcggtagattgagattttcttgacactgtggccagtactttcctgatttagcatacttgaggtttcaagcattgaaccttttctcatccgcaggacatcaatgcttctaatgttcaggcattggtgcataagagggcatggcttccaagcattctcatgtgaaattatgcagtaatgtttttaaaaaaagtatgttttatgttttctcctccagggtgaaaacacatcttgcaattgtttgctaatctattgatctcttctatctgaattccagctatagatggcca

SEQ ID NO: 10414 - DNA, 1501 bp, Oryza sativa
caagaaaaaaaaatatgtcgacctttttcaaaatgagatgctgtggatgtcatgtgttgaaaaaggcttgtcatatggcaatataactcaagagaacaattttttggtgtaatctgcaaaggttttaacatataagggatgaagattaaacttgaagttcagggtggaaactgtactgtagcaggagttgaaggaacaaaactgatatgttcagttagatgagttttatggttgtggacataattaagtaatatgtacatcagcaaaatatgtacaataagagaatgcacaaggagaaccaccttcatttcaaacaaaacaacaacaaaaatatcttccggggtgttatttgtctggttttgtaagtatggggtaaaagcaaccggtgagaaatagacatcgagcaaaatcaagggccaaaaagatgggctctataaaaaagaacacatatgcatgcattccaccctgtacaccacttagtatcaatcaaatttaataaaaacacaatttcagcgctggtacattcctatatacagaccctaagctaaactaaacgtctcccactcgaaccaaatgttcctggaagcctctcaaaacccatataccgcgaaactaatccaactaaaggaatttctttcaaggatggtctgattggcacaattacatagtacatacagtatatctctactagactacgagcacaaccatgcaatattgcagataacaccactattataccaccagataccaaattgttccggccgcacgcccgcaaagcgcaatagtgcaatgcacagccaacttacagcaatcacaccgaattggagtattgaattgaaggaatctaatactactaaccactcccgtctcacaggtcgcaagaaccctaacctaaccggaacgggaacagggaagggtacaagggtgtcgttaccatatccgacgacggcgccgacgagggacccagcggcggactcccacgcgaaccgcaggaggcagaccccgggcgccgcggtggccgccgcgagcgggctcgggttccgcgacaccgcgaggcggctcaggatggggttcgcgcccggcaccgccctcctccccgcccccgcccccgccctctcgtccgacgactcagcgtcggtggtgtccccgccgtccgacgagaacccgtcctcctccccttcctccttcctcctcctcgcgtcgccgccgccgctcgccatcgccgcttctcctctctctctctctctctctctctctctctctctctctcgcgtgtacgcgcgcgcgtgtggccgtagcacacgcgcggcggcgtcacgggagggtgtacgtgtcacgtgtcggtgtgctgcagtggcagggagtggtaaatagcctcctcggttgatctaataagtcaaataataaccaaaatttaaactttttgaacttgattttaaagttatttaaatatatttttaacgtatattttttattattagcttttgagccactacaaaca

SEQ ID NO: 10415 - DNA, 1501 bp, Oryza sativa
ctttctttctcttttggttcttgtagacagtttaagatgccatgattgcacacagatattgatatgtacttctaactgctcaattggttggtgttttggcactgaatgtttatttacctgacgcctgcaaaatctaatctccagtggcctgcctgaaaggggagcaagaagtccgcaggccatggtgggcgccgtcatgcctatcggtggtgttcgtgagggcggccaagcggaaccggcagtcccgagtcgtctccctgaagctggagccctagtacccatccaccgcctcaaatctttgcgcattcgccgttctaccccgccttccagctcctcttggtggaggcggcactgcaaccgcacaccgttggtgtgctagttcccagtgatatgaaaggtcttttgctgtgaagagcagaagtatgctgctctactatgttcaaccggtcctcttatccttttttttcttgatctgttttaatcatgatatatagggtttggaatagtaaccttggtgtagacaaacaagatacatatattgtgcagatggttccccttaaaagtttctgctgcttgcaagtcagtctgagcttgttctagtaggtatttttatcttgtgaaagattgatccccctagagatcttgatcaatctgcagaaaatgcagatgttttatttggtgttggtaaaaaaaaaaacactactacttccaacatttcttttatttgatgacattgtagaattagaatctgtctggtcaatcactcaaaaactttgcatcattgatacttttcaatttacatgaacaagggagaaccgcatcactaaaacttccattaggaatacttctgtaaaatttatcatttgtataaattttactgatgtctttgttatgaaaaagatatccctggtggttatatgtatctagacctggcccttgggcgtgtacattgtatctgtacaatgtagcaggagtacacgtgtatccagaaccttctgccgtatccaagcaagaggtgtgcagtgactgacaggtgggccgcattaaaagcaggcccacttgtcagccgtaatcctcctcttgctagccttctggattctggaaccttctcccacggggtggaccccacatgtcatcgtctcaaaacagttacgctggactttaccgcaggtgcacctagcatctccgcgacgagccaatccagaaccttctccccccaaaaaccctcggccactcgtccgccctctcactgacagtggggcccacgcggtggggccacaaggtcagtgacccgtagtaaccccccatcttcttgctccgcaaggcgcacgccatttatacgcctccgtcctccgtcgcgccgcccccacaaaaaccctaccgccgcccccaaaaccctcgcctcgccgtcgccgccgccgccgccgttgctgtctcccctcggcgaatccacggtagctctcccgctccccctcctcggtggtaggagtagcggaggaga

SEQ ID NO: 10416 - DNA, 1501 bp, Oryza sativa
ctgtcggttagaccatgtggccaatgccgatcagattgtagaccgcccatttgtgacctggtcggatttttaggttgttgatcaaaccgcccctacatggatagctatactggcctcactacagaagctctaacattattttttttaaaaaaaatggcttaatcttaccatgggctattttgaattgatgacaaaatatgtcctactattgatagcttgaatagtaatattggctattcgatttgaagccaaataattagtaatgcctaaaatcaatttgacttcacattggtagtaatcctctgccaatccaaacattcgtactacaactctatcctacttaaaagaaatgaaatgatagtacataccaatacttatcaagaatttgatactatcaaatatttagtatgttaacgaaccaaacccaccctataacttcatcccaatgccaacttgtcctcctgcatttttagcaaacttgaaagctaaaacactcgtaaatttaagagcgatggaccgttactggccatgtaaaaactgttactctattcgtcacaaaatataacaattttaaactacaaagttgtcttaagctataacaatttctcaagcaaatgagggaaaaaagtacatcgaaggtccctcaacttgtcatcgagttacaaaatcgtccccgaaacacaaaaccagatatccggcatctctcaactaatcaaaaccggtaacattaggcccttcgatggttttgaccccggttttgtccgacgtggcggttgagtcagcgtgggacccacgtgggccccatgtgtcagtataccacgtcatcatctctctctctcccccttctctccggctctcccttctcctcctctctctctctcactcttcttttctctgggcgagctggatggcagctgggaggaggccgccggggcgaggcatgaggcggcggttggcggctgcgacgtgggagaaggccgtcgagcagggagcagcagaggccgagcacattggcgcacacgcgcagctttagcgcgtcgcgtgggctcgacgacgacccggtgctgggtgtcggcgtcggcctcagcgggcagttggagccacaggcgctcgccaccacggccacggtgaggaggctcaccgccagaacaagcaccaccagaacaagcaccgccttcgccgccattgctatcgatcgagctttgctaggctgctagcttgtacttgtagctagctcgagcttgccgctgctactgctgcttgctgtgtgctgggcctgggagtgtgcatggcaaggtgtattgtgtatttatagtggccatggagaagaagatgagaggaagcgacggcgcgggagcaccagaccaggagggcctcccttcacgccgccccaccgccaccgccactgccaccgcaaccggcaggtggggaggaggccgacggggcgaagcggggaggctggcgattctgcaaagtcgcggatgatgccgccgtgatgagg

SEQ ID NO: 10417 - DNA, 1501 bp, Oryza sativa
gtcacattccaacctcttcatttcatcgtcttttccgactctattagtgcccgtgctaacgtgacgggaaactaggttgataacagtcaagtttgtttttgttgcttcccctttcatcttgttaattactagcttcttgttgatattaagttaggatctcaagtctctaaagctgaggtagctctttcgtcacctaaccaccctacctaccttatatatatccattgttgtctctatcctccctctaattaaattaaaatgggggagatttgctcttgcagtcaacagtcaacacacatgcacaccctaaatccaactacctctgtttaatatgtttatttttagctgcttccatttgtttcaaaataagtttatttttagagtaatcattacatcagagtctatgaaagtataggtaattatattaaaaatagataaagtaaaaagtagttttattaggatttggtaaagtagggatttttttttattggcatatgtgagataggtgaaaaataaatttattttttgagacggatgaagtaacctaatatggagtagtttactagagttggaaaggatacgttatttactagagttggaaaggatacgttattgtgaccagtcaacgcatgaaccttataaactactattacgtctgtttcgaaatataagaaacgtgttaggtgatgccaaaatctagctaattgggtcgccagtcaaaccgtttgcactttgtttatcactctgatggttcgatggccgggcacttcaacagaagtttgatgttgcatgcagtatacggactagaagcttttaattggttgaattttagactttacttaaagttcagagatataatatgcacttctaatttcctacgttacatacttacattagattttggctattgtcctatgtgaaaggacctgattttggcttttcgccaacgacgaaagggccaaaagttaattataaaacaattatttctcgcaaaatatataaataaccaatataaaaagtgtaaattagcatcaaactttcaatattgagaccccgtgtcgcccacacgtatagatggtcataacgcccgatggcccggccaaaggcatgactatttggcccggcccaagcacggcacaacccgatagttgggccgtgcctgggccgatgccttggcacggtgggctggcctggcacggcatggtcgaagaaaaatagtagagggatcaaagatagacttaatcaaccatataagaaaggccatagacaagagaaatacaaaatatgcttattttcagccatataaaacacatcccaaagagttgagagatgataaatagacttaatccatggtggagtccaatgggctgtcgtgccttcgaggcggcccggcacggttcgagttttattaggccgtgccagggtcgtgccgggccgggcggcctgtttggccatttatatccacgcatgggctaatataatatgcagcaatattttcagt

SEQ ID NO: 10418 - DNA, 1117 bp, Oryza sativa
cccactctctccctacctcgcgatcggtcacattccaacctcttcatttcatcgtcttttccgactctattagtgcccgtgctaacgtgacgggaaactaggttgataacagtcaagtttgtttttgttgcttcccctttcatcttgttaattactagcttcttgttgatattaagttaggatctcaagtctctaaagctgaggtagctctttcgtcacctaaccaccctacctaccttatatatatccattgttgtctctatcctccctctaattaaattaaaatgggggagatttgctcttgcagtcaacagtcaacacacatgcacaccctaaatccaactacctctgtttaatatgtttatttttagctgcttccatttgtttcaaaataagtttatttttagagtaatcattacatcagagtctatgaaagtataggtaattatattaaaaatagataaagtaaaaagtagttttattaggatttggtaaagtagggatttttttttattggcatatgtgagataggtgaaaaataaatttattttttgagacggatgaagtaacctaatatggagtagtttactagagttggaaaggatacgttatttactagagttggaaaggatacgttattgtgaccagtcaacgcatgaaccttataaactactattacgtctgtttcgaaatataagaaacgtgttaggtgatgccaaaatctagctaattgggtcgccagtcaaaccgtttgcactttgtttatcactctgatggttcgatggccgggcacttcaacagaagtttgatgttgcatgcagtatacggactagaagcttttaattggttgaattttagactttacttaaagttcagagatataatatgcacttctaatttcctacgttacatacttacattagattttggctattgtcctatgtgaaaggacctgattttggcttttcgccaacgacgaaagggccaaaagttaattataaaacaattatttctcgcaaaatatataaataaccaatataaaaagtgtaaattagcatcaaactttcaatattgagaccccgtgtcgcccacacgtatagatggtcataacgcccga

SEQ ID NO: 10419 - DNA, 1501 bp, Oryza sativa
gcgacgcatgccctcacgtcaaacgcgtgattagtccggccaaacccacaagagaaaggtggtgtgcgttcaagtcttcaaggcattgcacaaaccggtgcagcggcaggggataaaacacaggcgtgtttaccgcctcagcctgtgcctctcccagacacacggacgcttgtttgcaaggctcacaaaatcgatggaatttcacgaaaatcggttggctctcgtgaaactattaggttttggtttgtgataactgatcggtatagctggtttttatggtgttgattgaaaatcggtggtattttactcgttttcgattggacttgggtaaatcggtgagcaatggtttacgtcgaaattgaaaagttaaacctggcttgttaggctctgggtgtgttctaaagtcagttcccgggagtgaattattagctacatatatgattaaccgtgaaaaacttatttttttaaaaaacaactcatctataaaaagattttacagaaaacactctgattaatagtttaaaaacgtgctaacgaaaatggggaaaatagccaaactgaaagtactttatgtcatattgtcatgggctactagtgtgttactaccaatttctctagacgtcaaaaacaccagggtgaagagtctgttcagattatagctaaaataaaccttataaaattttagcaatattaaaattttggcaagttgttaatattactaaaattttggtatgatttctcatgtatttatcaaagtttgacaacaaactaaatgtagatattattttttataattttattaaaaaatggtacggttaaaaatagcaccaatccgaacagaccgaaatggtatgtcattgtcaatacgcgctctgcctccagcagtgcttcactgcttcatatcctaaaacacaaacaccctttcgttcctgcgggtcaatttgaggcgcataatctcacggccgcggctgtacgaagcacggcgactttagccttctcgaacacgtcgaaggagatgaccgtgcttgacccggcatgccgtcgccctcttttccatcgatcccttatcctgtttaaaccttctagaatctagaattatcttcttcgtcttaaatttcgccggaattttattattatgctaggccgagcccagtgaaagcacgaacattttgctactgcgtccaaaacatgcctaaactaacgtggaaaaaaaatgcctaaactgatcgagccgcgactaatcagatccaccgtccaatcacaatccaacgatccaaccgacgcgaaaccgacgcgttgcttccctgctaagagtaccctcggtcaaagtcacccacccacctggcaccaatctcgatgcaaatccaacggacgtgagatccacgcctacctccataagcctccaggaaagtcaccgcctccgacccgtctggccaaattcgcgcacctcctccacctgctcccccatctcccccagatctcgccgcgatggccaccgccg

SEQ ID NO: 10420 - DNA, 305 bp, Oryza sativa
tctctcccacctcactctctcactctctcccttggcgccccttgcccctacgcacgcccactccttttctctcccactcctctcctctctctcccggccggcccgcggtgacagcaagtggcggcgggtgatacagcggcggtgctcggcccctccctccctctccctcggctgcgagcgggaagaagggcggcgacaacagcagcgcgcccctcccctccctcaccttgcagatccggtggaggggaggcatgggggcaatggatccggcggcgtgcggcccctcccctccctccccttgtaga

SEQ ID NO: 10421 - DNA, 220 bp, Oryza sativa
  unsure (1)..(220): unsure at all n locations
aaattttccacccacatcagcttctaccagtgggagcaaggtgcctcctcccttgcgaggatcatggatccaagacttccctgcgccacaaaggggtttttttttcccccccccccggggggcccttttttttttttaaaaaaaattttccccccaaaaggggcccccccccaaacccttaccaaaacccccacccccccaancttggtgatggcctagt

SEQ ID NO: 10422 - DNA, 270 bp, Oryza sativa
aatatttagggatgagagtatattagatgagtcgttccatgcatgtcgtggaaaagaccaagactttgctctggccagtgccaaattgggcccgggagaaattagaggtccattgactcgtggtaaacgatagcgaactgcactgcactacactacactctgcctgcctccaggctctataaattccgaaaacccaacagcctgtagagaagcaacaaacccaggaggtgcatgcagtttcagtcagagttatagaggagagaagaagag

SEQ ID NO: 10423 - DNA, 1501 bp, Oryza sativa
tgtgcagatggataaaagatcacaagctgaaacgcgccgccgtaacaaatgctccaaggtcaaatgcagagctcatgctgtcactccttgggctcactgaattcttcccggtgctcgtaatcgggagcgagtgtgaccgagccaagccattccctgatccttacctcaaggctcttgagcttattggtgcatcacctgatcacacattcatttttgaggtacacattagttttgtacttttgttcacaaaatagttatcttcagttttatcatcaactacattcatgtactttttttttgttttgttttgagaactaactatattcatgttaaaatagtactaacatggtgttcatccttgtcaaggactccgcgtcagggattcgagccggtgtagctgcaaatgttcctgtagttggtctgacaactaggaatccagagaaagttctgcaagatgcaggagcaagcttgctgataaaagatttccaggacccaaagctactgtccatacttgaagagatagaacctacggttgccgccgtcgagcaagtctgatttttgcagatggagcaatggaattctggagtactagatggagcattttttgcagatggaacatgaatactggaataattatacatctgtctatcctaacaaaataaagctgatttctagatggggccggggtcagcacacgtcttaggacttttgagtttgtcaattgaccatcatctgtgcatgtgacttgctgtaaaaactcctgtaaaaaactcccagtatgcatattgccgaaaataactgtaatgtatgtttacatggtttgatagaactaaacagctgcaggaaaatggctatatagtttatcagttgaatttgctatcttttgttggaaacgcatctactgaattgtggtttgtaaacaagaaaaatacatgttttgcatggaaggaacaatacaataaatcccccgttatgatatcctctttggctattccatccatccgccaaaaaaaaaatctattatcatcaacaacatcttctgcttaaataactcagaaatgttataaacaagtacgtggagagagtaattaacacaaaacatccattgaaaagacgattttgctatccatctcccgtgtgattttttctatggcatttcaacggcacgtatgaatgattagagcggatttccgaatccggaaaggatcattaggcccgagctaattaatattaggcccagtagaataaaaagcccaagtaaacaaagcgaccaagacggcccacggacgaaggaagaccaccacatccgcacgaaaaatctccgacgccacgacgctctctcgcctctcccggaatggaaacgttcgcgcggtggcgtccaccgccgccgccggcggcagctgggcgcgtgtcccttcgaccggcgtacgggaggcggagccgggccgccacggtctccccgcgcgcgttcggcggcggcgctgacttcgacggcttcgtg

SEQ ID NO: 10424 - DNA, 1501 bp, Oryza sativa
ttatttacactaatttttcaaataaaatgaatggttaaacgtgcaaataaaaagtcaaaacgttagacgaagggagtactttttttctcagccgtggtgggtccctctcttcttttttttttacaatccgtcactctcaatcagtctccactcactccccacgcagttttcggccccacccgcgcgcatgagcctttccccttgctgacaccgagagatcttgcacttgaccattgatagagatggatgtcgagctagcttagctcagtatggctcgttaaaataatgagctagcttggcttggcttggctagttatatagatggctaaatgagctgctgacatggcacggctcggacacgactagagcacagcttaaggcatatcgggtcggcacggcctaaggtatgtcgggctggcagcttggcatactctttgtgtcgtgccaggctaggccacaggatgtacctgtggcttaggcacagtccaataaggcgtgggttgtgccgtaccggcccaaaagcacgactggcccatcgtgttcgtcttggaataagtttattttgcttttcttatctctttagaccgtgtcttatattgttggaataatttattttgagtccctcatttctttgggccatgtctacatggctggaataaatctattttgtctccctgattgttgggaaatgctaatgcgcaggtgatcgccccgcgctgtgccttccccctatactcctccctcctctcccccttccttctctccttcttctcttcctactacggtacaccacaattttttttaaaaaaacaaaagttagaaaaattatgtatagaaatactatatattaaaaaattgaattcaaattcaaatttgaatcgggtatgtaaacttttgacttataaactttagatctataatttataggtgtataaactttagatgtatagaaatactactacctccatcccaaaatgtttgacgccgttgacttttttaaaaatgtttgaccgttcgtcttattaaaaaaattaagtaattgttaattctttttctatcatttgatttattgtaaatatacttttatgtatacatatagtttccacatatcacaaaagtttttgaataaaacgaacggtcaaacatgtttaaaaaagtcaatggtgtcaaacatttatgggaagaaagagtatatatagaaaatatttgaattcaaatttaaatttgaatcggatataattcaaattcaaatttgaattgggtatgtaaacttttgacttataaacttttaggtgtatagaaatactatatatagaaaatatttgaattcaaattcaaatttgaataagatataattcaaattcaaatttgaaacggggtatataaactttaggtctataaactttagatgtataaactttagatgtatagaaatactatatataaaaaaatatttgaattaaaattcaaatttgaatcggatatataaacttttgactta

SEQ ID NO: 10425 - DNA, 1427 bp, Oryza sativa
ccaggcacggcccgacggtcgggctgtgccggcacgggcccgacccaagggggttcgtgccgtgcttgggccgggccaaaaaggcgtgccgtgggccgggccttcgggcctcgggccttatggccaactatacttcggagcgaaggtcctccttcgaccgttgaggagtatctcattctccgccttgacctcaacgacctgccgaaacacgcgcttgagaagctccatgaggtcactgcggcggtccctgctggtgggatcgaacgcctgagacacggacacgatcgctcggtacgggaactccatctccagcagccggcacacttcctcgcccagcgtcgacttgccgacgccgccgaaccccacgatggagaacaccttgacatgctgctccccgacgagctgctgcttgatcagcagctcgaccagggcgtccgcctagcccttgatgccgacgagttggtggctgtcatggcggtgcgcgtgcgcagccaccggagcagcagttaaagaatatgactgataagaagggaataagcggcggtgctacagggcgtcgcggttgacgccgtaccgggcgtggcgctcgctgatggagagggcgcttatctcggcggcgaggcagcggcgctcgcggtaggtctgaaggcggtgcttcaacctgccgcgcacgccgtcgcccgggcggcacctgatgcggagccaatagaggccgacgcagtcctcggcgtcgtaggcgagctcgcgcacctgcttcatccactcccggatgaagtggtccacggcggcgccgtcgtcggcctcagactacatccggaagagcgcgttcatggtggccagctcgtcccgcagctccgcgacctcgccgcggacgccgctgagctaccggtactcctcacccagcagctgcccaaccgtgctcacaagtatagttggccataaggcccggcccacggcacgcctttttggcccgacccaagcacggcacggcccgacttgggtcgggcccatgccggcccagcccgaccgtcgggccatgcctgggcctccccgccagcacgctgggctggcccggcacggtcgggccggcccggcacggtcgggccggcccggcacgatgggctggcaggccagacccggtacacaaagtatagggactaaaaatagacatataaatgtcaatgtctaaagaatagggaccttaaatagacttattttagctatttatataccacagcacaaagaagagggaggtaaaatagactttttttagctatacaatgtcacagcccaataggagggaaaaaatttagacttattctgaggaaaagcacgatggcccatcgtgcctttgggccggcccggcacggcccgaggcttgttgggccatgcctgggctgtgagtgcggcacgtgggctggcacggc

SEQ ID NO: 10426 - DNA, 1501 bp, Oryza sativa
gaagctggaccatctcctcgagctcatccaagcgcatcaattttgtgatctctgagaagatccatccattccaaatcagcatagtgcacctgctccttctcacagtttactaatctaacatgagcagcacaagttcctgaagaggaaagactagtctaaaagacgatatcgaaacgaaaaccaattcggaatatagtagtagagaggaggagagattgcgtggggatagcagaattataataataccgaattgatgatctgactgcgaatgcattgtaaacgccgcatgcttctgcttttttggtatgtttcctccatataaagacctctacccatgcaggtgtcactacatcagtgcatccaggacttccttctaaggtaaagtcttttctttctctgaagtgtttatcttcagactagttactacttactctctcttgttctaactactctagttttttttctctatgtccctagcttcgctttccttctttctctcttgtctagctatctttctttgcatgtctttgcattgagaagaaagaactctgtgtcagtttattggagcctgttgttttagacttgcacagcttcagtgatcaatggtcaggcatcgcgaatgaaaatgccaaaaacacaaactgtagctttttggagcttccacgtattgttttttcatgtgtggagtggttcatctcgcctgaaacgaaacgaggttctgaaatcattcagcatggacagtcaatagggcgatgcctttaaaaccaataattgctattgttctctagctgttgttctctagtgtattgtccatagtaagaaagacgaatcgctatacagttgcggagttatactgtaggtaggcttttgatgtcacaattagtggacgacaagaacttgggggagatcatcactatgatttttttcttcttcttcttcttcttcttcttcaaagatcagatcactataaataggcattgtcattctaaaaaacatacttgaggcaaggcaatgccatgacaacatcttctcatcgcaccacttgattctttcatagtagtatttctcaacgcagattgatttgatttgatctgatctgaacagtgtgtaaatggagcatctcaagaaaggagtggagtttggggtggcctccctgcagagatgccattctctgtcgtgtcaaatggtgatgctttttttttttgcaaatctttcgcgctaaaaatttcttttcttgttcacttttatgcaaaatggaccatacatgtcggctaatgctagtactatgaatttggcataaccatctgcatatatatatacatcccatgacaaaaaggaaaaatcagagaaaacctcagctgttgctgtgatcaacttggtgactgaacttatatataacttcaacaacatatataattcagcttgtatcatgacttagctaccatggtggttttgctgaatgtgcaaacaggcagagagcacgcagatcgacgagcggaag

SEQ ID NO: 10427 - DNA, 1501 bp, Oryza sativa
gttacagtaaatttctatcgtgccaccaaatttgtctcctccatataatacatagctacaaatttaacttaaatcaattttttcatacaaccatccattcatgtctcaactaaaaattatcattaccacatatatgcactccaaaaaatcatagcaccaacgagcacattgtgtacatgtaacactacaatcatcaaatccccaatttcaacggtcagaatcacaaaatcgggaaaaaaaagagttctagagttaccctccgatctaaaacgcaaaaaaagagggagaatggaggatataccttgctctttgattttcccaataaatcttgtaaaaaaaatggctccaaaccgaatggatttaaggagaagaggtgatagagagtgcacgagatgcactcgagctcgggcggaagaggagggggcgaatagccggggagtggatgtacggggtggggctcgtgtgcttcccccctccacgggtagagcgtgctagggctgttggtgcacggggagggtttggcaatattgttggcgcctagtacctcctgccacgtcagtgccgggccgccgtgtggtgccatggtgacggcgcaagagaccgtccagttggacctcgacgccagcaattctagcgccaaaaaggatcattccttaaataagttttttctaagaatctatttataaaataagtttgtgaaaatgaccaaattgtaaaaaatcaaggagagtacatgacaacctcgtatacacatactggatcttgtgtttgtagacgactataaatttgtatccctctcgtcttctgtcttctccacccaagtacaaatttgaagtggcaatttttaattttcactcacaacacttgttatacttgctctaacacataagtatctgatatacacccaaaaggtatatgcgagctacaagagtggattattgggtgaaatcagtcaagccctccaggatggactaatggaattagaaacaatataattaattttggtgccaccacgagtcatgctgcagatggtaaggttagttgttcctgattctctttaattaatataactagtattatggctaattacgtacacgtgcatgtcgtggaatcaaatcaacgacaacttttgctggctagtgccaaaccggtcacaggaagaaaggaggacatggcattgacccatggtaaacgatatggcaatcgaactgcacgcactactcactgctacttgctccgtacaaaaaaaaatcaaaaactggatatgacatatctatcatagtacaacgaatctgaaaagaggactgtccagattcattatattagaatgtgtctctagtattaggttggttttttatgggacggagggagtacgtaacatgcctgctgctagctagctagctgtgggtctataaatcgtgaaaactcaacagctatgtagagaagcaacaaattaaccaaagagggtgcaatttcagtcagagtagggagaagaaaagag

SEQ ID NO: 10428 - DNA, 872 bp, Oryza sativa
ccctggctggtcctggacagggatttaatgcacattcagcttagaaattctggtttgagaatttctgggcgtgacaagttggtatcagagccgaccttgaccgtaggacaagccaactggaaacctaagagccctctgaacccctttttcatatgcatatgcccttttgcacttggattttgtttcgggaaaattttggggtttgttcttttgatttgtgggaaaaatcttggtcgcttatttaaattggatttctcgactagggacagtctagggagttagtaaaagtttattcagaatttattcggcagtcggtcgggaattgtcgggtgatatgcattaggtcgcgtctatgttcggaggggtaagtttatgcgtatcagtatgactatgcatctatttcatgcattaagtcattgtttagtcagttgcattagcgtcttttgtctcggttcgtgaaaaatgttctatgcataaaaatcatcatgctccgcgagttacttgagtcatttgttgctttatttaatttggttttgagcatgtgttggttcctatccctctgtcctctttagatgtcagtcctatccctcgtttgcaagcgccgccccgagcttcagagtcgccgcccttagctttatcgtcttcttagtctgtttgcttgctagttttcgtgtttaggtttgttgcttgagggttagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 10429 - DNA, 1501 bp, Oryza sativa
aggtaatggatatgtcgattaatcgaatcgtttagaaattatgttatctgcatacacttacttttgataatcatatatctttcagtttcaaaatgactgattattttattattataactaacaaattaaaaaacaatgtagatccttatcgagatgacatgagtggctgctttgtttatatggcataaaagtattgtgtggaatattgatctttcaaccaaaatacacacggtagccaagtttttttttttactgaacgcactagccaagttgtgcacctatatgcttatttttcacgttttttactagatcgcacccacctatcaagttcatgtactgtagacgtataaattactttaaaaaaaaaagaaaaccagcaccggaagttgtgtatgattagtgtgcaacatattgctgtaggctgacatggtccgttttaccgtcggcacttaactgtattactgatcttgctcttaggttgcggcgagatcaaaagttatacttccattttgtaaagaaaggataattgccaaaaaaaaagaaaaggaagataatatcggatggtcacctgggccgacgtatgttcatcggagagtccgtcagccttgtcaaaggcccggccccacgcagttccgaacttcactgatgggttgaacttgaaccctcaagcccactagtttcggccgtgacttttcctctcaaaaaagagaaattaaaaaaaaaaagttgtgccgtgactgcagtccaccggcgtccccgcgcctcgcgggcggccggccgcagcgcagggcggttcggccgcgcgccgcgggcagccacccgccgcagcgcgaccgctcgcggacggatcccctcccctcccctaatctcgccatgcctttccccaccaccaccggccccccggggccttcccggccccgccctcaccctagccagcgccacgccgccagtagcggtagcattagccgtagaggaaggctaggacgcataggaagaacaggaggaggaggaggaggaggaggaggagaggtggggggtaggaggacggaggaggagtaggcaggctgcccgcgatgctgcggcgcgcggcgagcaacgcctactcgtggtggtgggcgagccacatccgcaccacccagtccaaatggctcgacaacaacgtccaaggtatcgccattgctctccgaagtccgaacaacgcacgagcacagcagaattcgtagctacatttttctattgccgttccaatctattgtggatacgacggatgaggtgatagcggtgtcctgttggtatttactactacttagcataatcttctttaacatgaaatgattctgaaggaattattgtagatttctagtaagagcgtttgtttttgggttctcatcaatgtttcaaaaggtttgtatggttatctctgcagagatggagataagggtgaaggccatgatcaaactcatagatatagaggctgatacatttgcaaggaaggcagacc

SEQ ID NO: 10430 - DNA, 1501 bp, Oryza sativa
agaagtttacataagatgcattcttgtagtacgtaagaagaaacttacaactcttcatacatgcatatattccaccatgcatcacatcaagccaggcatatacttcctccgtttcacaatgtaagaatttctagcattacctacatttatatagatgttatgtgaaacggagggagtagctaataaggcattccttaccaccatatctgaatcactaccgccgttgccgttgtataggctgtatgttcatctgtttgtttggttttccctttcacttgtttaattcattcttagcacaaagaaccaacaaaaaaaaataagaagctctcttatcattgtcctgttggatatatcatctcagaatttgacgcagatgagatcacagctagtctatttgcatatagcccaagaagcagacagaacaatctttttcctgctcctcgaattagctgtgctccagaatccgattcttttttttgtttgtttttggtatgcagattccgattcggactatgctatgttacgttccgttaataaatatatgtgcactatgcaatctcgagttaagcatcatttgtttgtgtgtttgctgcatgtaggacgacaccatgaacatgaagaagaggaagaggacggtaggaccagctgcagcagcagctacttttcctgagctgccggaggagattgtgatggagattctggctcgtctgcccgtcaaatccctgctacgcttcaagtccgtctgcagagggtggcgtgcaatcatctccgagccctccttcatcccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggcggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctag

SEQ ID NO: 10431 - DNA, 1172 bp, Oryza sativa
tcctcccctcccccttctctcccccttcctcctccccttcccggccggcctccccttcccattcggcgggccggccagcggcggggccgcgcgctgcggcggccggcggcgcccggcggggtcgtgcccagcggcgggcggcgggcggcagggccgcgcctggcggccggtggggccgtgccagtcgttcgtggcgaccggcggcggcagtagcattcttttttttttaatttgtgatgattcactgagatgtatttgactgagaagttacaaatttgtgattcattgtttggatctgtgatgtatttgagtaatttcttaggatattgtgatgtatttgatttatgatgtatttatttgtgtgtataagtaactttgatttgtgatgtagatttgagatgttacttcgatttgtggattgggggtttgatttgggatatgtatcccacttgatttgggagaaaataaaaaagaaaaaaaaagaaaaaagaaaaaggggatcatttcactgccgcaaccctctctttagccccggttggtaacaccaaccggtactaaagatcccctctttttagttctggttggtgttactaaccaggactaaatatctatttttagtcccgggtatttgaaccgggacgtcccggattggtagttccagtttaaaaaccgggactatagggggttgcgaaccgtgactaaaaagcatttctccaccggtgctagttttagcttatacttaattaatcatgtgcgaatgagtttctctgtttgccgtgtgctgaaggagaaggttcccaaccaacgtaaactaaaggcaatccatttaatagtgttagtgatctcaacatactgtgggactcgtttaattatctgtaattattgtaaatctcaacgacaaagtcagtagccccggatgggttcctggctatttcttctcagacacgaaattgatgctcccggcaatcacccattgaattgaaagatgggaaagggacagaactgatgctcttgccactactacgccacaggcacactagctggagggtgaccaaccattctttcatcgcacctctacgaaattcatcctgccacaccataatcgatccatcgactgattctgattcaagaaagtagactgattatagcctgggattgagggagatgggagg

SEQ ID NO: 10432 - DNA, 1501 bp, Oryza sativa
tcaactaggtacgtagataggaagagtgcgcagccattatgctataagcaaagcaacagtagtactccctccattcttttctgtttgacgttggaactaaccaacgtcaaacatttggggaaggaggtagtagtaaacaacaacattgtaatatatggcatcaacctacttcgactatttcagtccttggttttcctaaattcgtgaacaagtaaattagcaaaaaaaaaacatccctaaacatcttccaccggctacaactagatatccaaccgttgcactaaacctaagtttctcaaggcaacacgcccaagcagaaaacactgaagtaatcaactagattatggataccacccactgcatcctaacccaaagcagaggcgaatcacaccgcgcaagtgcaggaaataatcacaactccaaaaggatgcggcggcagaggcctcacaactcacaagctagggactgacgccgaatcaggagcagaggaagcataccgcagtgggcttggcgtcggatccggcagccgcctccccgccctgggccgccatatcccggcgccctacggctccagagctcgagctgaaaccctagcggcctcacaacaggtgagagccaccccccgagtccgcggctagcacgggcaagcggagccggatcgagcgggagggagcacgcgcgcaatcccgggaaagaaaagctggagaaatcggaggcgcgggttgacacggcgaagatttcgttggagaagagggggactatggcgagccggatgtgcgagtgcggcggtttgagtttttttttctttttcttttttttttccacctccgtcgggccggggacgagagaggaggggtcggcgggtgcggcggagggggacgagtagagaagagagacgtgtgtgtgggcttataaccttgtggcttggtttgtaaacgggcctgactagcccaaaaactggttatgcaggcccaacgttaggccattcacgatgcggtgaggtggcgtgtggtaatctctgtccatgtcggtccaatgcgtgcatggaggagagaaggagatggggcccacgttttcaccaggttcgcatggctagttttggctccgagaacctcagcaaattttgtgagagaaacacagtgagtgagtgaaaaagctcgccggagaggaagagtaggggcgccgaatccgagccagatccgtgccgagttcgccatcccatccggcggcgacgagaggagctcgcccgcagaggtggtgaagcgacggcgccctcgccggccgacgtcgagctcccccgccgccgagctcccccgccgccgattcctccgccgcccgcttccgcgtgccgacctcgccgttgtttcatgggaggtgggaggagggagaggagggtggtgcgccggcgagcgccaagccccgccgcctctcccgtcggtagcggaggagctcggcccggcttggggctatggggtggggaaaaaggagtgaagaaaggagg

SEQ ID NO: 10433 - DNA, 1501 bp, Oryza sativa
atacaggaggaagttttcagtgcattcaagtagtagtatatacagataggcagacagttgcaaactcacaacacaaatgcacggtttgggaaagttttaagacacggaccattcttgcgataagtgcttggctgctcggacttgtagcggtggaaaaagcacgcgatctgcatcaatcgtcaccaggaaaaatccatcattagcacaactgcacaagtcacaacacagagcatgcatttcaacaaacacttgtagggcaatgagtgattagcatcacctcactcagcagagggtggagtcagtctagcgcagaaggatgacgttgcacagtgctgacggcgagtccgtggtactggcaacctcacatagaaggaacagcatgtcagcgaaccaaagggcaaaggctgcagcactccatcgtcgatggcccggcttagctcgaaggctgttaccacatctgcatccatccagtacgtctgtaggaacctcagtgacacaccaccaagcagtttgcactatacaaaaaactaaatagaaaaaaaagaactccaacaagctcagtaatatgacatgaaagcaactaatcagcttatctcaggaaaaaaggggaaaacactcacgcccttcttgaagctcgacttggtgtcttgatggcagcggcaagaaagcaacataggtggtcagattccttagcatcgacctgggacgaacagaccttggggcccttgtagaagagcagatatggcgctcatcgaactgccccaccgtcggtcatcatctccgccccgagctccgcccgctggaacctgaactccgcccccaggtaacacaggttcgacagcggcggcccctgtgagaggaggggaagcgggctccgacgcttctcccccatactgccgtcgacagccccttcccactctttactgctgctgtcacctctcactcctccagatcgacggacagccggcctttagccaatgaggtcgcggcaacgacaccagctccacccgaggccgccccttccatgtggtcgggggacggaggctgcggcaccgcccggtgcacgggggaagtcagatccctgtcccccgaccacatcaaggctggattcttacgccggcggcaggaggcggaggcggggatggcggctgtgcgaggcggaggcggcggcggtggcggcgcgaggaagaggctgggcggcggcgaggggcggagacggaggtgggagcgcgacgcagggacggtggcgaggggccgcggtgtgaggcggaggcggggacggcggcgcgaggggtggccgaggatttttcacattttggtccttttgaaaaacttatttcgcaagtagatccccagaaaaacttatcccaaaaatggtcctttttggggcgccagagtgcctggcgccgtcgttcaacaggacggcgccagcctctttggcgccgtcccaccgccgacgtggcggggcgatgctgaggtggctagggggagtgcgccagag

SEQ ID NO: 10434 - DNA, 1501 bp, Oryza sativa
gcactagttcggagagaggagaggagaggaaaaattctacatgtcacatattacgtccatttgagttcaatttttctatggttggttcttgtgtgtccctaagcgtgaaaaaaatatcaaacaaataaaacaaaaataaaaaatttcgaggggggggcgccagccactctggcgcactccccctagccacctcagcatcgccccgccacgtcggcggtgggacggcgccaaagaggctggcgccgtcctgttgaacgacggcgccaggcactctggcgccccaaaaaggaccatttttgggataagtttttctggggatctacttgcgaaataagtttttcaaaaggaccaaaatgtgaaaaatcctcggccacccctcgcgccgccgtccccgcctccgcctcacaccgcggcccctcgccaccgtccctgcgtcgcgctcccacctccgtctccgcccctcgccgccgcccagcctcttcctcgcgccgccaccgccgccgcctccgcctcgcacagccgccatccccgcctccgcctcctgccgccggcgtaagaatccagccttgatgtggtcgggggacagggatctgacttcccccgtgcaccgggcggtgccgcagcctccgtcccccgaccacatggaaggggcggcctcgggtggagctggtgtcgttgccgcgacctcattggctaaaggccggctgtccgtcgatctggaggagtgagaggtgacagcagcagtaaagagtgggaaggggctgtcgacggcagtatgggggagaagcgtcggagcccgcttcccctcctctcacaggggccgccgctgtcgaacctgtgttacctgggggcggagttcaggttccagcgggcggagctcggggcggagatgatgaccgacggtggggcagttcgatgagcgccatatctgctcttctacaagggccccaaggtctgttcgtcccaggtcgatgctaaggaatctgaccacctatgttgctttcttgccgctgccatcaagacaccaagtcgagcttcaagaagggcgtgagtgttttccccttttttcctgagataagctgattagttgctttcatgtcatattactgagcttgttggagttcttttttttctatttagttttttgtatagtgcaaactgcttggtggtgtgtcactgaggttcctacagacgtactggatggatgcagatgtggtaacagccttcgagctaagccgggccatcgacgatggagtgctgcagcctttgccctttggttcgctgacatgctgttccttctatgtgaggttgccagtaccacggactcgccgtcagcactgtgcaacgtcatccttctgcgctagactgactccaccctctgctgagtgaggtgatgctaatcactcattgccctacaagtgtttgttgaaatgcatgctctgtgttgtgacttgtgcagttgtgctaatgatggatttttcctggtgacgattgatgcaga

SEQ ID NO: 10435 - DNA, 1501 bp, Oryza sativa
tctttcacgggataaaaaaaccggcacctttaagcacatatagtgccggttttagataaaaaccgttatcgtatcatttttttaaaaaaaatttgacacaaccggaccttaaaaaaaattgcgtgggagccaaatatctatagctcctctctataccttatccttatcctcagctcctccctctcccacttaacttctccctctccccatccccacttctcctgctctccttcttcgccggcatctctcctcagtgcccgatggccatcacccggcacccgatggccagtgccccgcctctctccagcctactgtgccggattcatcggcaacggcgagggtggtggcaccgatgccagatcgaacgggcctgagctcgagggcctctggatctagcccccgcgtggagccctccaccagatatgctctcgatgacctcaatagtggcggcgatggcgggcggtggccttcactcgacgtcgtcaagtgcactacccacgggtttgttgatttgtggatgtttttgttgttgattttgtgtatgttcacaattctatgatatcaatcgatcttgatggtgatctaatttggatttggagatttgaatttggattcgaggcaatggaagcatcttatatttgacttgtatggaacagagcgactaattcaccatttcaaatttccctaaccaaatatgttgaagaacaggagagtcaaacatggcatgcatgtgtgggccttcagcgataatggtggctttcttctcgacgaagctccaagtatagatggccgtaaagcttgaggcccgacagcccgccccaagcacaacacggcatgactggtgtcgagcccatgccgacccagtccgacagttgggtcatgcctagatcgatgcctcagcacggtgggccagcttggcaaagcacggttcaatgagcacggaagaaaaatggttgagggactcaaaaaagacacccaaagataaaagggatacaaaatagacttagtccagctgtataatacacggcccaaagagattgatgattgaaaatagacttatccataaagaagtacaatagactgtggtgccttcgggccggctcggcaatggcccgagtctaattcagcatgcctggaccatcggtgcagcccgtgggtgggcccagcccggcctggcatgtaggtcagaccgtaccggcctgactgatatcggccaaggcctggtcgtgcctggacccatttgggcatatatatagctcgaacctcgaagtagcttgcatgcggcggctgcacaggtgaaaggaaaacctaggtcttaagctgggcccaaccattttattatccttaaatttgtgtggttaattaattgggtaattgattatttgatcttctctatagtgtgcaaattcaagggaacatatcttaatttccatctgccatatatatgcgcaccgttattgtagtttgagtttcacgtacggtgaccttgcctgcgttgcca

SEQ ID NO: 10436 - DNA, 1501 bp, Oryza sativa
ttatgggtcgtagcattagcatgggtatattactggtataaattaagtgtgtcctccgctatataagccatcacatatgatttgatttttatttatttcattcttacatacactacgagaaagtaaaatttattttatggttactgaaaattttcatttcattgattgacgtagactatgttgcgggtgaccacattatttgataatttttttcacatttaccgaaacattgcataataatacaacattaacaatagaggagcaatggttcacatgaatgctaacacatgttactacctctatcacaaaatataaaattctagaaccggatatgaaatatttagtattacgactctggaccgacctactgtctagattagtagtattagaatttgtctcatccaattctaagttgttatattttggaatagatagagtaccatatagaaaatttttatggtcattgaaaaaatatctctaattagctaaaattttataccacgtggtacggaaggtaccaagttttacctcccaatatatcttttcaaggatgataaaattaggccttgtttagttccccaaaaacctttccaaaaacatcacatcgaatctttgacacatgtatggagtattaaatatagataaaaaaaaactaattgcacagtttgcatgtaaatcgcgagacgaatcttttgagcctaattaattagtccatgattagccataagtgctacagtaatctacatgtgctaatgacggtttaattagattcaaaatattcgtctcgcggtttccaggcgagttatataattagttttttcatttgtgtccgaaaacccctttcgacatctggtcaaacgtccgatgtgacactaaaaaggtcttactctaccaaatgaaaaaaaaatgtagctttagttggctctagaaatcctatatatttctaacggtattgctaaatctctgtcgccatattttgggttcgatttcaatcggatagcctgatccgcatgatgcgcatgcgagcgtcgtggtcgactcacgtccgtagatcatagccggcatggtcagagattttcctctcttttcctgttcactaaaaaagtgccaccattagtttcccattaaattagcactagcatcgattctctactaatagctacttacatcaatttaggtatgtaattttagaacttatacagtaaatacactaaaattatatatgtaatttagagacttacatatgtaattttgggacttacattataaatacattaaaattatacgtttagaaacttacaatataaaaatatatgctgactattttttcataaaaagtatggcgccataaatttaggtagttttctaatcaacgctgaaatttcattttgtttatctattctattattatgctattcatcttcttgcattgtcactctgagctgcttgttgggtcaaggacgtggccggcgaagagcaccgcgcccgacgtctcctccac

SEQ ID NO: 10437 - DNA, 1501 bp, Oryza sativa
  unsure (1)..(1501): unsure at all n locations
tgaaacttgaacctaaatttatctaaaatcaagatctaactattggtaccactttatcaatttaatttgtactgtttgaatttttggtgattttatttgaattctaattgaattcaaatcaaatctttcgcacgtaaatttagattccgaaggagttgctgagttaatcaaagatccgggtcagcaaatctgtgagcaaggcaagtcatcactaatctttgagcatgttggacctattgcgaacttattttgatttaaataaagtttgcatgctatttatatgtgaatatcctactttgttatatgccatacctttgatattgattatccatatgtcggtgacatgggatcaggagtatcatgactagaggtttgaggcagacacaatcgcacacgtggcctggtacccccgagggacgtcgggcccgagggtgatgcgttcgccctcctcttagtccccccgagggggtggggccgcacccccctcggccccgagggccgaggcgcnccgacccctcgtgggtttttgctccgcgtatgggttaggtgagnacagtggggctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcctgtcaggacgagggcttctaggcgctcgtccccagctggagctagcgtgttacctcccagagatggcacgttagtcctggtcagatatatgccaggcttcatcctaaccattacaggcaagatgttgtgtgaagaagggcgagcatgtagattgctaagctgacacgtggtggacaagaatgaccgtcgtgactggtctgataccggtcatgttgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtgtccccttaagatataaaaggaggaacttgcccactgagaggggggactggacttttccagattagaaacccagaacaagggagaggctggctgatactttgtagctccttcatacacagatctcccaaaacacaggagtagggtattacgcttctcagtggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtagggggctctgcgagggattttctgagctctcgcactctttcgtgtgcgccaagcttttcttgttcagcccaa

SEQ ID NO: 10438 - DNA, 1501 bp, Oryza sativa
cggcgaggagcgcacccccgccgagctccgccttgtcggcgcgcccatcgtctccgtcccgcgcaccgactggctctggcgcgcgttcctcccgcccggcgccgaccgcacccaagaggccgcgcaagccgcctcccccgccggcgccgccggcattgactccccggcgttccctccggccacggtggtgatcggcggctacgacccgctccaggactggcagcgccgctactgcgagacgctccgcgggaaggggaaggcggtgcgcgtgctggactaccccgacgccatccacgccttctacatcttcccggagttcgccgaggcgcgcgacctcatgctccggatcaaggacatcgtcgccggcggcggcggcgagcactgactggtcggcgtcgcagtgcacgacacgagcacgagcagtactgtggttggttggtggtggtgagtgagtgattggggtggggttgcgtgatgggggtggtgagtgatgacgtggactgattaggcgagatgccacgtattgtagctatcactaggcactagtgagcttatccagtagtaagatgacacgtgggacttgtgttggtcgcatatgttatactgcatggtgtaggatgaggtcgtcaataatttgttaggagtaaaaagtagaggccaccaataaaatgggatttatggttttagataactgaaagtggcttttctaatttactttgttttaggctgtgtttagttcatactaaaattgaaagtttggttgaaattggaatgatgtgacggaaatgttagaactttgcgtgtataggaaagttttgatgtgatgaaaaagttggaagtttaaagaaaaactttggaactaaacatggcgttagcacatcaatacaatctctaatgtacaaggaatattatggaatgatctaatatcaaataaatagaagatgtaaggcttcgaacccagaccgactagcacaccaatttgtgaagctagccggagaccctcggacgtttctcaacaactatgggcatgtttagatcaatttgttgtggcaaaattttttggcaaaagttttggtggcaaaagatttggcattaaagttttgctagttggtgtttagatgaatggtaaagttttaccattaattgctgctgcctctctcatgcatggggcccgacgcttttttgtccaaatttgctgcgatggactcccaaatgacaaatgccaacttgcctactttttgctactggtgtttagatccattttatcaaaaagtggtccacaacagcaaaactttcatttagagagtagtatttgtaatgctaagttaatatactgataccatttttatatattaaatcttattgtttttacatgtttgaggcagtgattgaagctagtttgagttttgattgtaagcattctgaagcaacatattagtttacttaaacgccgtgggaatggctgaagattagcgtgccacctcagccgtcttttacaaaa

SEQ ID NO: 10439 - DNA, 627 bp, Oryza sativa
cataccaacagcatggaacccatcaaggcccactaccatctagcccagctgatagactatgaggcccagtcttacattccacgttttgtcacttttggatcgttgggtcgctcgtcgtgttccgtaaaccccaccccgtctccgcagatccgctctagctgcacgcctgcaccttgctggcttggcgagtggcgacgaaccaaatggactcgcatcgttgtcgccggggccggtcacccgccgtctgtgcaagccgtcgtcgttcgtgccgtccattacctcggtcgatcacgtccaaaacactctacaaccaagggaaaaaaaagaaaagaaaattggggaaaaactttggacgactccgcctcgttgaccggcgggccatggccatcagttaacgaggccgcacaaatcggacccgatccaacggccgaaaccccaccgaaacaccgtcgttttcctcccctcttttcccctcctcccccgcgccccaaaaagagagagagagaaggatagtggcttggtgcaagtgcgatccccccccccccccccccacatctcccgcagagtccacggccgatccatcccctcgtgcaagccgccggcggcggagaggagaagaagaagcga

SEQ ID NO: 10440 - DNA, 457 bp, Oryza sativa
tttctgcttttgggatgtattccggaccgctcggtccgatgatttaagactacgcctgcgggcttatgttgtaataatttgcactagactctcgtgtatgtgcgtttggtatctcggctatgaactcgtgtgtaccagactacttgatccaaggaaatggtactgtttacacgattgattcctgttataaaaacgggggtctacagagctggtatcagagccatacgactgtaggaaaagaccaaaaggcgccccacccccttttctaagttggccaagggagaaattcccatttagtaatactttcaaaaataaaaatgctatgttcacaaaactctatacgattttcatcttactcttaactattttcttcacaaaacaagttttactctcagctgactttgggtttttcttaaacttagatggcagatcaggattcacccgctacctgggatga

SEQ ID NO: 10441 - DNA, 1501 bp, Oryza sativa
ttttacagaaaattctaaaaaaaatggacacatatatgtgtcaaatcttatcttcaaatccattataacaaaaaaaattctaacaaatttttactcttaaacctgttagattttttttcacttttctggtacggttaaaatataatgaatttaaatataagactttccaaataagtttaatactattaggagcagatgtccacttttttatataatttttcgtgatatttactagtgtgcacggaaatattgtgtgcataggatatgttctcatacatatacattgtctttctcaaactatgaaagcagcgtctctgaaaccagtggctgattctttgttgatcaaatttcactcctatcatcgtcggcgaactaacgggaaaaatcaaatatcccctcatttttttacatgttacttaaaagacataaaaaaattagtaggttagatcaatatgtcatatgtctcttcacaaatatgcaaattcaaattcaacttatacaagtaaaaacaaaaataataaatttaattatggatagaacgcgtaattaatggtcaaatttgtttttttttttgaattgtataagtcgaattttaactcgcatctttacgaaaagatatatcatatattgatctatcttgataatttttttaaatttttaataactttttagacgacacgcacaaaacgagaggatgtcccctagagggacaaaaatccacttccgaactaatgtcaaactaaagcggaagaaaacattgggagttagctgaattgtagaacagacattctcctggaacttaccaccataattaccattgaacccgatccgacaaggaggctgtcacaaggacattgcactaatagagaacctccatattaattcgacgacttcaaaaaaaattacgatattttgaatgttcatcatcgctattccggacatccaaaacaaggttttctcctcttgatggttcacccataggacagatgagagaagggacgtcaccacgccggtatatcatgtctaggaaggtgtatgatactcacaggtatcaccgatgttagtactcagatcaaacagaagcacaggtgcgacgacaaaggccgaccgactcaacgtatcctaactgattggacggtctatttatttggccgtcaaatgggttgtaattatgcatacctgctgcatcaggtttcatccaatcactaaacatttcagtatttgcgtgatctagactggtcacatatgcacgcaattgcatcaaaaaagaaaaatctagatgcatgcatgtgctacaaaagtaaattaccagtgccatgcttgttaataattagtaccacaggttgaattgctaacccctccgtcaagtacgttgcttataggcagaaacacatccattaatccatcgaaattaaactataaatagccatgcatgcgaggttagattaccacactggtggagaaaccctttgtagtcccggttccgtaacccccctttagt

SEQ ID NO: 10442 - DNA, 921 bp, Oryza sativa
cgctcattcaggttgcatagattgtacttttgcttcattaaatgtatccactcacattattttattagtatatattctatatattcctgcctaaacctgcttcatggatttctttttcctacttggccttattttgttggtttaaaagcagagcagcgcacttgtcatggtctccttttttactgggggtttgatctcttttgtcagcacaggctctgattttacctcctagacattcaaaataggaactctcttcaattccagttccagatactgttcctcaagaacacaggtactaattgatgaagtatcctctaaaagatacgttgaatatagtgctttttcatgttgccgttcctattttattcattccttgctatgttgtgttctctaggtccaaattccacttaaggttgtgactctctgtgcaagtagagatgtgatttgtcaaatttggaacggcactagtaattgtcttatctcatcatgtttttctgagtgtccaaatttttaaccttttcttttccttcagaaggtaacagactttgcttgtatccaggttaatgtcaaacttcgattccctgttgtattgaattaattcatggaacctacaaatcttccacctgaagattttttgcctgcctggaattctggaaagcattagctgctcagtctctgaaagtttaagatgtggtaaggtttcagttctgttgtggataactagtgagttgtgaaggaatacatttttttcatgaaatgtagaattggataatcttccctcatggttttgcttgttttttcttggtactgatgatttagtgtgtcttgttagattgttactattgccttctagcataatggatatagcaagtatgtttagctggatagtaatgttgtgctctattaaaaacaaaggaacaa

SEQ ID NO: 10443 - DNA, 1501 bp, Oryza sativa
gatggaaattaatatgattactgaatgttactaattattcgaaaatgaagggaatatattattccacacttagccacaaagtgcctagaaacaattgggacagtaaatattttaaggcatgttcggtccaatacacgaattaattaataactaatataattcaataaatagcttgaagaaatgttatgtgagcagtgtttatatacaaaattatataagaaattgtatttataaaagcctgatatggataattcataccttatcttaaaaagaacacggtctcattagcgttagaatctcataaatacacgctatggtgctaactaccagtttgccagctgccaccaaggaaccaacccaccacctcatctatattaccgtagtactctctccatcccaaaataaaataatctaatactggatgtcatatatcttagtctagattcatactattaagacgtatcttatccaatactaagttggttttatgagacggagggagtatcttctaatgaaattgtgcaacacctccacccaataaatatgaggaaaaagtctacttttttacatttctagtttgattctcgttctttgaccacaaaaatcagggacagaattaaaactagatcagattacctctctaggcagacagttttgatgtttattttgttctatcttacatgttgacctgatctttattatacgtaacgtttaactgatattatagtgagaggataaaatgacacattatctctactattataaaaattaaatttgtttccgctaaaattttggtacttcatccgtatttgagttgttttttatttggttataaatcatctgtatctaattcgatgtgggtctaaataactaatatgcccctcctagcccgacccaagcggtccaaaccatcctgccacgccatccaatgcgtctccactcggcgtggcgcgtgcctctcccccgatcggtgttttttttcttttcccatttttcattttcattttctccttttcttttcttccgatcatcatgatcttctcacgatccttcccatctcttccgttttctcctccttttctcttttcttctctttaaaatttctctcctcataaatgttttccttttgaaattatcattatttaaggtgtgtatacggtaaatttgttactttacaaatgctttctatctacagtaaaaaaaattcaataattgaatattcaaaatttcaattttggtcgatgaagtatagcaaatacacatgtgttaacttatatagtagccacccaatcgatttgtgaggctatggaaaggtgtacataaaggattcttcgtatgataatgcaagcgaatgtaacatggttcaatgctatatatgattttgatttagttttaccattattttgtcttgtttcagtcatttaaattggcagagtttaatcaatcgcgaaaattattttcagctgttgcaacgcaaaggcatttttgctagtaggagtaa

SEQ ID NO: 10444 - DNA, 629 bp, Oryza sativa
gggtgtgcactttgggcggcccaccgagcgtgagtagggacgacacgctgtccgcggtcgcagacagggtgggaccacggcgccacgctttgcatattcctccgcctcggtggtggtggtgggtagtagtatgggattattcgcgtgcgctttccttttttttttttacttgggcgggcgggcggggctgctacagggaatcgcttccacttctccttttctcgatcggcgtgcgggcagagacagacagcggacgggtgaagaggaccccacgtggagggcgatccagctgctgtgggttggactccggtcggtcgggggtagtctcctcgacctcgatcggtgcgtggaccggggtcgacgagacgacgacccagcgacacacatcccatccacgcacgcatcccgccggtggacgtcgccgccgcagcttccgccgagccgggccgtctcggggcgggcgccaccggcgtcggcgtacggggctgtttggttcttaacattgccataactcactttaggcaatgttaggcaagtgtggcttgccatacttttttggcctacaaattataagccacacttgtgacaaagttagacaaagaattgagtctataatatgtggggtaaga

SEQ ID NO: 10445 - DNA, 1501 bp, Oryza sativa
acctaacaaatgaaaccaagtttgcttttaaaattttatatggttgtctaaccgatcttccctttgtgcaagattttttaaagacgaattgtgcttaagaaaacattcatcaaacacaattcattgaaaagtaccttaatctttgattcccaactctcccgttaccggcgcggagctacagtgatcagggagggttcacaagcacccatgtccaaaaatcattttaccttataggtaccattcaccccccccccctcaactcaaccaagtgtacccccaacaggccaccatacagagcaagaaggtaaaagatgcgttcatgcttgcagcttataagtattctcgggtagtcagctgacgagttgcttcctttccaaattgttttttaggatcatcctgatttactgtaagcaaaccgaacaatgttgcttgatagggagtcgattggatgattattggttgttttttttctctaaatttagggttgagttccaatttgttatcatttgcctcttttgtgttttagacaatgagtgtggattgaggtagttctctaatttgggtatgttttttgttgtgattttagtcttacttttttttactacagttcactaatttttatattaacattggggttctctattttggtaaacacattatcgctacattttcttttacctatttttgtgtattgaatgtttactatgatgttacttaatgtaaacacgtataaggttacacttgtggtatagtagtgcacctcctatattttgctctagctccaccactgcccgttacgacaggcgttaagctgttggttaggtacaaggcaccacagcgatgcaatactgatcaagaattcaagatgagcctagtgtgctgtgtgcagagtatttgtttgcagctatattgaggtgtcaatcaatcttctaaaaagcttagccgcaaaagttatttgagtggttgtttatccaccttctagcacttttacgatctaattagcagtcaatgggtaactgaatttggaccttggtgaatcattctcgaccatcccaaactaaaaatggaatgaaatgttacaatgttggatcttatctagtactatttcactaggattaacggataagccgagaacatatcttcccacaaagttacgcaaggttagaaactgtgaactgatctggaaaagtttccagcccactgaagtttatcaaatcttagtaaatataaaaaaaaatggcaaatcaagcttggaatctgcttccttctcgaagcaaaagcattggctctgctccaacgagcccggattacgtggccggccgattgatgcagttgccactaacgcgaggaatttttcgcttcatcactaaacaattactagataataatacactactcaacatattctaattaccgctatatatatacgcgatcatggcgcgttcaaggtcgagcagcttcgatatcgacggaagccaaagccggccaccggccatggcga

SEQ ID NO: 10446 - DNA, 1501 bp, Oryza sativa
aaaaccttattgccgccttctcccggtgcaggacgtcgaaggcagaggttccggagacctgctctcccgatcgttggtgcacgcaggcgagcgggatggagtagtctacgagcgacggcgcagtacagagtaggaggcaaaccctagattgatttcgcgtgtgttgcgtgaagacggcgggtcggtttatatagagaagggccgcttgatcagggcatccgcacgatctctactgcgcgtaaccgaaccggataagtcgcgcgtaacttatccgaactccacgccgtttgcacgcaccggatttttcggaacgtttccaaaacaaaaacgaatccgaatttgcagcaaaacaaaactgcaaaaggaggctacatctgcgcaagggtgaggagtcaattttttggaccattcgacgtgtacgtcgtgcacgcgcgccgtcggcccggccaggcgagcgagcgcacgcgtgtgtttccccttttctctacaccacacatgcttcaagtggttaggagggcatcctcccttttaaggaagtccccctctcttagaataagcaaggtggtactaaactccacatgcatgccatcccatgaggtgggcttttgtgattttccaaagaattaatcttcgagtgggctaaggcccattcattaattccaacatcaacaacaagcactcatgtgtggcctactccagaagtacaagcagtaccacaggattcggtgatggccatgttggctgtttcaactaccccaccatcgtgtgatccttcaactatactagcatctccgaagaaggtaatgctcatggtgttattaatgtattggttgtgcaacatattcacaagagaatttctttagtgttagatccaactttaattgttagtgtaagaccaatgttcagagaaaatttgttcaaatctcaggtgggtattcaaaacatttttttttaaatgaaaagcggcaaaagacttgccgaatatattagaagaaagaaagagaacccacatagttcagtttacatattacagactgggccactaggggtgagacgactaaaaactgatggacagtacttgataggattacaatttctcagaaacgtgggagaggcaactgaaaaacaaactcacagccccttaatgggattggttagctagatcaagctgggcaagccacttgattctcagtttgggagatttgaaggaaaatcctacggttatgctctagccatacaatccaccaggttacctggaggtctcccaatatcttcctcttggctattggagaaatgttgcaaagcatctcccaccaatccatcaaggtgggcgctgaaggatgctgagaaaccatatcatggccctgccactgacaaacttggttccaaatggctcgtgtcttcaaagtcacctctacaaagactgcatatccaatcacagggccaatgtctcttcaacaatttttttcacagggtaatcaaaacagaggatccccacata

SEQ ID NO: 10447 - DNA, 1501 bp, Oryza sativa
  unsure (1)..(1501): unsure at all n locations
ccggtggttggcggcgggcagtcagtgaaggtggacggagtagcggcgagtccagcaccccgaggctgtggcctggaacaacggcgcagggatgagagttgtccatagcggcttgatggatagaatttggtgtctggtgacggagacgggcttgaaggcactgatgacgacgagccccgagcccacacgatcctgagtgaagagcggaaggttggcaccggcggagggcgggcccaccctccacctgaggacgcagaggatggtgccggtggcaggccggtgatggctcgggcaagggaggccatcggcagagaaggagccggaggagggctcggtgcaccggcgggggtagaggcaaagccccgtcagcgaaggagaagcggtgccggcaacgggcttccatgagacataggttggaggctggtggagaggaggcgtcggtggtggaaaatctggtggtgggcgacgggtgaggaggagccgatggcagggagatccgccacacccgtctctggcctacgcccccgccacgctcgtcgccggccacggggtcaccactcccaacggctcacaatagagagagagacaggaggggggaaggnaagaggggaaagagaggggtgagagagtatggtaggtgggtcccaccatgtcacgccccgaaccagttccggcgggaactagcccgtgacgctccaaattaacctgttaatcgataccagtcccaggaaacagtgctggtatcacagggagacagaatatcatagcaacagaggtctctttattatagagtaggagtacagtcatgttgggctgcggacagatcctgagctcacaactgcattacaaaagcgaaacggaagccaggacttggaccaatcatcacaggcgcgacttgggaactaggccgaaaccctaaaactcatcgtagccggcttgctcctggaagaactcctcatcagcaggatctgcttcatcttcttcagcaactgggggggggatatttatatagagcaagggtgagtacgggagtactcagcaagccaggggaaaataagtgtttaatgcaggcttcaaggaatggctgttgtttttgcaattgattttatttgaactcttttctaaaagcaactaagtgagtgcttctcaaacgacacggatgaggcagtgcgtctcgtccggtcggagtatgtgcaatgtatcagtctttagatttgaacaagattggcacccggccaaaggccttttaaacggccacccgggccaacaccttttcaaacggccacccgggccaacaactttttaaacggccacccgggcctagctgatcccgtcagctgcggattcttttcaaacatcgaacccgatttcacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 10448 - DNA, 1501 bp, Oryza sativa
caccgtcgccacccccgcacctagcccgcctccgctcgccctgcccgacaccccgacgactcgacgcagccacaccgtcgctgccttgatctggccggggtcatgagcactgaccccgcgacctcgagggagttggaaggccccgccccgtccttgtagccgtgcgttttccggcgtctgcttgggcgacaacgaagcggaggagggagtaaggcgggggtgaggaggaggcggtggtggtcgccgcccgtgtcgcccctgcccctaagtgacacggggctcctctcgtctcacatgcaaattaaaccacatccactcctcttttaggtggagttaaatctgtttggttaaactcaagctccagagttggagctagagatggagctgtgctaaactgatccctaatctgtgaagctaaatttaagagttggagttttacctaacgtatcctcgtagatacgtacgggacactggatccgtgtcagacacagacacgcacctagcttgccctatcagcgcatcatagccgaaaacgtgtatacaccaactatccgtccgattccatatccaattctcatccgcttggtgaatccagttcagcccacgacgacgaggagttccaataaatagacacagggcagcgcgaagtgtatcggcgaggcagcgcgaagcactaggccactggctagctgctgtcgacgcgtaaaggtatggcatcaaacatccgactacttcatactaagtaatatcgttacttgggccgagtttagtttcgaattttttctttaaacttttctattacatcaaaatttttctatacacaaacttttaacttttccatcgtatcgttccaatttcaatcaaactttcaattttaacgtgaactaaacacacccttactctatccctttccaaaataaaccatacaagacatccctactatgctgtcatatctcatattaaaattatagatttatttattttaaaacgaagagaatatgcagttagttagccaataaattaaatatttattagagatttcttttactacattattttatcattggtattaagctacagagtacttattaatttatttcttaaaatatttaatttattttttctaatcaaatagataatccattttttttctaatcaaatagataatccacggtagtaatcaggcgaataatctttttctaaggggcccgtagtttggtttggtcttttatgtgtttaattggatgttatttttactcagtaaattcattctatgtttattgcgtttgtacctacgtgttgtttttaataaaatctggccagtgtgtctttgctgtcctgacggaaaaagaaaaaataaaaacaataagaatccttaaattgtttattttccttttaaaatacaattcaaccttttttttgttagtaagagcatgttgtctaaccctcttatttattcaatgatattagcacacttggctcatggtagctcgttcttttt

SEQ ID NO: 10449 - DNA, 1501 bp, Oryza sativa; identical to SEQ ID NO: 7906

SEQ ID NO: 10450 - DNA, 1501 bp, Oryza sativa
tgagtgatgctaagaaggtaatggcacttctttcaacagagaagtcaagtagtttaaagcaggaacctcagctgccagagatcaaatctgtttgtaacaaaatttgcaacgctacttctggtcacttccctttgacaagtgtaggaggtagccagaagagtacaagtaattttaatttgagtgatgtggatcatcctttgttggagaagtttgaggcgtttcaagtcaatatgcctcaaaaggtgagttgataatttggtaaattcgtttggtcatcttcccttttgttcaattgtttaactacggacagcgtttttctgcagaaaaatggaagcttaatttctcaaattcttagaagtcccctttcctggatagagcaaagagctcctcctgtgcaaatgttagagttgagacacatttgcaagcaagtcgaagaacagcatgttaggtaagcaaatatggttgagttgtgtgacctcgtaccatccttgtgctgcttgccaacgtgtataaaatgtggaaacgatcacctgagctcatcatgttctagcagcttaacacagtacttttcttgtcggttaatttcgtgtgttctttaaacttcatctccatttttctgccatcacagggagaagagagctttgtccgtgaaggatctccattcaaaccgggaacatggtgatggtgaaaaaaatattgggaagatcgtcgacgtgcaaggaagccaatctaaccctgacagagctagcgaatggagtggatgctcagatgacgagcaagagacgggaggaagtaatgtggtgcagtcgaccaaagaagcaccagccgctgccagctccggccccagctccaaaaacaagccgcagaaaaagaagaaatctaagaagtccaagcgtagcggcaggaagtagtctctgttttgttttgctcttctgcctgaccaggcgtcggatggccttttttgcttacaccgttgtaagtccagcagcaaggccagctttgcttaactggatgtactccctccatactgaaatcgtttttgacagcgacacggtctccaaaacacaactttaacttcctgtttctataaaaatatttattgaaaagtgatatatgtatacttttataaaattatttttcatgacaaatctatttatataatttttatattttcaatctcaagttgagagatatttataatttatatttctaagttttgacttaaccttatcctaaacgatctcctttacgagtacggagggagtacttgataagaattgtttgcttatacagtgactgtccgtgcattagtggaaaaaaagggaatgctttctcacccccagtctttgtgtttgatttcaaaattaatttttaggggcttttgcccccccttttttttgcacagttctccattcaatgttgctaagaagagttaaaaaaatcaaactaaaattcatccttaattcaagttatgaaattcaaaactgctccgtttcctatt

SEQ ID NO: 10451 - DNA, 1501 bp, Oryza sativa
tggtggcggatcgaggcgcggaggcgccagatggaggcggaggcggcagatcgagcggcggcgggggcggatcgaggcggggcggcacggattgacgccgcggccacggatcgacgcagcggcggccgggatcgacgcatcttcttcccttctctccagtctaccccctctccatcttcttcccggcgtgggagcagcaacggtttgggggcaacgtctctcccccaacgcggctcctcgcctgttcctcgccgaaaagctaccgaaaccactcgacgctctgcagagggtcgcagcgctaggtgagggtgcggtcccgatcgacgtggcgtgaatattcccctcgggagcagtgagaccactctccagcgtggagcgttgaaaatagcctaaggaaaggaaaatgggcagataaagattagtgaaatacggagcaggcgaaatcggggcttttaactatttgccactcttacggatgttgcttaacgatttgccactaggcccacatgtcatagacacatgagggcccacatgtcattgacagggtgtggcaaatcgttaattgccatgtcacaagagtcgcaaatagttaaatttcccggcgaaatcggccagccgccagtcacaggagcgagaagtcaagaagcaaagctggcgcgaatattcgcgcgacatcaacgccaacatcttccccgtctctctcgctacccatcggctccaccgctaccctctccgccctgccacctggcacccgaatattccttccgcccgaactgttgcgtttacatggccccacatcgctccgcgtcattagatttagcactttatcttcttccacaaagattcgaattttcttttcggtttggatcatcgcaagcgatcttttcactttgagctactgtaccttttttttgtcggcatagttggactaacgatgatgctcgtgccaattgcaacgcagcgctcgtgctacgcatcagtaagctgtagtaaaagtatctagtctagtcgtctaaacaaagcacgtagaaatcaacacggtttgtgcgccgtgctcgtgccaattgggggagcatttttatccatctcgtgtacgtgccggcgccgccgtgttggtggcgagcgcgcggcggccacgcacgtacgtggccccgcgcggttggcgcgggcgtttagccgagagatgctctctggttggtttgttgggttcttttccttttttttgtttcttgcgccgttgcattgcaccccagctcaagcctccctagattccgcgcgcgcacacatggatgctttctccttcctccgcgccaccgtctccgcttccctcgcgtcctcttgtcctcacgcagagagtagacttgcactgctcttttatctctttctctggccaccaagctggttgttgtatattactagtagtaatccgtcgccgatagctgcttcgtgttgctcgatctttgaccagccagtggggttggaggagggagggagctagcta

SEQ ID NO: 10452 - DNA, 1501 bp, Oryza sativa
ggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccaccctaataaatcgacccaatgcaccgtagcccaggtgggttggttgggcctgttcaacgtggtgtagcgttgatcagtggagattcaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgttgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacactcgctgctctcgggcagcggcggcgtcaaggaccccctgggcggcgtcgagctttttctttagctccgcctcccagcgtccgtgttgaaggcggagggagtcctgcgcctcaatcatcgcggtggtggcgatgagggcggcctctcgctcctcctccacctctcgggcgatctccgccaacgccgccttgcgggcttcaagctccgagatgtggcggcggtgagccttacggcccacctccaccatggcgtccaccgagcgccgcccctcctcaacacgcgcccatgcggcctcgagctccgctcgttccgctcgcaaggcctccacctgggcgctgaatccatctagcaccgcggtgtttgcggcggccaaggcttgcagaaggggctcggcactcagcggggcggcagaagatgaggagaagagccgccttggagaaaatgcgacgcggctcggcccgccagaagacgcactgagctcggggatgtcccccggacccgtttggtcctgggcgtcgcccgagggagcgggcccaggcgatccgcccgcggcctcgtcgcgagccgccccggaggctgtcgcctgagcgtcgcccgagggagtaggcccaagc

SEQ ID NO: 10453 - DNA, 1501 bp, Oryza sativa
gcttctgatgtttacgcgcacatggaaatttattaaccaccagtgtgctatggctagctagctccgcccgtttgtgtatgtgttgtgcacagtgttcatgcagatgaggcgcagctacccacgcgaggtaggcaggggcgtatggggaagactccaaacgacaccaacagcagtagctcggtggacgaggcagggagccgctcagatgtgtatcagctacagtcactgcagctggggccccacgccctcccccagatcaacgtactgcctggactttattttttttttcctcctgctccatccctaccgagaaaaatatgggccccggctaaagcgaccggctatcgagtgactgcattgtggagcccggtagggtttttgctgattatcttttgcgcttttttaatagaaacacgacgtgataaccttaaacacggtattgtgtgtgttttcttttggccggtggtagtaatttcttttgtacagtagtagtatcagctagtaattaattaatgttgctgtagagggagagagaaatgagaggcacagtgagagtgatgagatgatgcttacaggtaactgacggcccccagatagctacgttagccacagctctctctctcctccgagtttgctcgccgtgtaaacagtgtgcgtacccaaaccacctacgcgcgcgctgaccgggttgctccgcctcctcttcctctctctccggcgcctgaaatgatgcagacaaaaatgtgccaaaataaatatgtatacgcctagaagcgagagcgggatgcaaggagaaacggccttttatttttgacaccaagataaacggactttgactttctggtgaacagaacagggtaagaaacggcatgcaagacgagaaaacaaaacatagaaaaagtgtaactcaacacacacacacacaaaaaaaaagcaaagcaaagataagacgaagcatcaagcaagctggttgcgtgcgtcgccgtcaccaccattaccttctcctccacgtcgccggtgagcgaacgagcgcaatttgcagcccgccggtcggcttcaccttcgccgccctttcggtttcgagctctgcctctgaatcgactcagaagcctttggagatagcacagagagaaaggcctcccttgtctggtcgaggagtggatgcggctgcgtcaatggcgccaaacacagcggcggcaaagatatcagaagctacgcagcgacgctgtcgccgcacagaaacaatctgggactgagtgggagattcctctcgcagtcgcaggagagaagagccacgaagcgagagagagagatcgaggtggggagggagagaacactgcgggcgtcgcgctgggccgtcggatccttcccccatatacgacgagagggcgccgagtgcacaggcagtgcaagccgtctcgtttccggcccatatatagtccctcccccacgggacacgcggcggtccccgcgagatcgcggccgtccgatcctgcgcggc

SEQ ID NO: 10454 - DNA, 1501 bp, Oryza sativa
caagcgccgggagagccggtgcgttcgaggacgcggaaggggacttcggccgcgccctctccttcctcttccccggcccgaggccggagagattactcccgcgccgccggcctctcgtcacagcgcccctcctcttctcggtgatgtctctctccgttcttcctcctcgctccatctcctccccctagctttcggtagtagcttaagtagactccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagctcccgaagccgcatagatgctctcaccgccgggaatcgacctctcgtgacctcgtcgccgtttccctcttcttccgccgccggttgccgccgccgcaatccgccgccgtcgagcaacctccggcgaatccgagccgatggctcgccttcccttgtcacgtgcaaccgcccggtgtgcacgcttttgcccgtatcaccgtggttcgctctgccgctcgccgccgccgcccgccgtccattcgcggccgggtcgtcgtctacctcccgccagcccacgtggccgccacgtaggcgccacgtcggcgccagctcagcctagaccggatcgagccaaccccggtcagtccctccccgtgcgcgcgttccaccgcgagccgtgaggctgcgcgtgggcccgccgcacctgcgtccaccgcggaccgcgcgcatgcaccgcgtctcgtccccgcccgcgcgcgtgcgtcgcatgctccctccgcacggtgagccgagccgctgacaagcgggtcccacccgggaccgcgcgtggtgagcccggtccaccggactctctctccttcctccgcgcgcgcgcttcttgggccactctgggccgccttcttgggccagccggcccatttagctcggccggaccgctccatttctcttgggccgcgccctagccgcccgagaaaagtctataatccctccctcttttcttttctttatcttttccaaaaaaggatttaattaaatccttttcctttagatcaaaaattcaataatcttagaaattcaatatcttcccaaccgtaaatccgtttgactccattcaacttccaaaattcctcaaatctcgagatctatctaatggcacgcttagaggtcgttaatagggctttattttcgccgtttgttgagttgtcccgtttcgcgtgtagtttcagagcccgaagacccgcagtgcgaggattttgaggatcaagctccagatctcgagcaaggcaagccacctttgaacatcttgagcctatatttgaaatttaattatgttgcttgcaaaatattatgcattgataggatcgcacttaatctgtttgtcccgtctgcaaggcagattggcggacctacctaatttgtcgcatttgatccttcctttgttaattgct

SEQ ID NO: 10455 - DNA, 1501 bp, Oryza sativa
attaattctcatcagttaaggtgctacgtcgcttcgtgtttcgtggagcatcaagttttaaatattgcatatagttggaccaatataaattactcatggttggttgcatgcagtgcattcaatgatgctcatttacttttggcgcaaaaaaagatttacttgttagatgatggtcattttgagaagatcttaaataccttatgtaatgatcaaattgggataagagggagtactactttttattgaatgcttttcaaagaatacataagagcacccgcaatgataaagtaaggtgttctctataaaaacatgtacatctcagcaatagactcgattaatagtaaaataccttaatagtatgtctacattggtatctatagctctctcatgcattgcctcgtttttctctatagactatctctacgttagtagatagctttgctctctctcttcatttaataccttccaagtaggaaaatatgctgacatagatctcttgtagagagcctatagataaccattgtgggtgccctaatgttgcgttattgttactccatcagtctcataaataacaaatctagaatataatgtgacatattctagtggtcggaatataaacggaggactgtccatagtattatgaatataatagccacccgtccagatttgtagtactgggaaataggtcatagagagcatgttatgtctaagatatcgtatgaccttttcttttccttctttcttttaggtacttgcattttgataggtgtaaagacttgatgtacttaactttgtttcttaactaaacaattcattatcttaataaaaaaaaaacgccatcggcagtgaggctgatttgctgtggtttgccataacaccgcccacacatccagattccatcaggtagagcatatggcaggtgacgcacagcgagtctcgaagccgcgaggaagcttcgtcggcccggagccggaggcgtccagccagcctggcggccacggcgccgccacaccggccaccttggcatccgtcctcaagatccaatctactgtatcttttggagctttgagcccagcccagcacaaaatattcgaagagctcgctgctgggcccacgcggcactcttttgtgccgctgagcaccgggacccaccttgatctggccggatgggaccacccatacaaaattctctcccgtactttgaactcgattttgggacaggataggtggccgtgcatacggtccccgtcctttgggcatctgtaccgtacggctctcacgctgctcctgatgttcattaaggcactgatctactgcaatttctgcagaagattagtacagtactattacctgtttcagcttaagataatgatttttgtaaacatgtttgttcagtggtccattgaacggctggtgagcttgacaggcaggcagcacatttcgatttctatgaagaaagagtaaactcaaccataatgctaagcaggcaaagcatgtagta

SEQ ID NO: 10456 - DNA, 1501 bp, Oryza sativa
ccggagcccggtgcggctgcgcccaaaagcgctcgcacgccacagttccccttgcccgcttgcccccctcgcgcgcgcacctgtgcctccccaagtggccgccgcccgcgcgcacagactagtagcgaaccagctagtactagtctctagccgcgagcgtgacgtgggttgcacgctcgtgtcacgcacgcgtttgatacgcccgtgctgcttgcgatttgcgggcggctgatgggtgggcgggggcggtgcgggcgtacaatggcgtgcgcgtcaacgataattctgcgtggattttcgagggattctcggcggtttggcggccggggagggacgtgcccaggttggcactcggcacttggcagaattggcagcaggcaagctttcccggtacagtactggtgtgtcgccccgcaggcaggcagcttcgtggcccaacctttttgacgacgttactattggacccgtctgcctttttagcctgttctctgtggcttgacgtgacatggagacatatgatgcctgctttcaacctggattaagttagaccgtgtttagatgggactaaaacttttaagtttctatcacattagatgttttgacattaattatcgggactggctatatcttatgtgacagattttttagcctcctatcatgcatatttcttatcctttagataaacatctaacggatgacattaatatacacaaacaaaatacaaaaaacaaacaaacggaccacatgaacaatctgaagctcacgtgggctcaagtagatttcagacttacatcgtaaataccctaaaactacatatgtaattatagtgtaagtacgatgtaattagtacgcgtgggatcatacaatatcggatattctgtgaggaacctcacgttaaataacggtaaaaagagtaacagaagggtcttatggtgtgaacacgttaatgatcagacattggagtccaattccatgcagccataggacatacaaaaccgaatcttagcgtcaaatcgaacggatagaaaagtgacagatttttgggaaaaaaactgtcgacaaagatatagcaattccgttaattataaatattaaacataaactattaataaaatctatttataatcttgaactaattcgcgcgacgaatctattgagcttaattaatccatgattagcttatatgatgctatagtaaacattctctaattatggattaattaggcttaaaaattttgactcgcaaattagctttcatttatgtaattagttttgtaagtagtctatatttaatactctaaattagtatctaaatacagagactaaagttaagtccctggatccaaacaccaccttaaacattggagtatggatttgctgcctcctcttcatttactctcatcatctaaattatctaaggctgtgtttagttcagcgcaaagtttggattttggttgaaattggagatgatgtgattgaaaagttgtgtgtgtatgacagg

SEQ ID NO: 10457 - DNA, 1501 bp, Oryza sativa
ctagaagtagtacacctccaacgcaaatcaagaataatgatataagtaactccagtacatatcaaacggcgctagtttgcacttacagtcaatcatgacatcagataaatatgtaatgcagatgaaaaaaagaaataaaaataatcaatgccgtctttgcaaaataatgcaaaggtagtaattacttaatgttgatcaacttaccataatttctctaaagttgctcaatgtttatttttaactagatagtaacttgattattgccttaacgaatactgcttgcttcttgggtggagcgttaaaaacgtaaatgcatatcgattgaccaaaacatccttttttaagagcaagtttaataatatcacccgctgttagctgaaatttctttccatgacatctgtaaccaacatacatactaatatatacaatagggtcagctctgtatttatcctccttttactgtagcaaatgatatttaattgcgctgcgccaagcatctcctctcccgcgcaaaacggacgcacttttttcttggagtacacgtatcggcgggcgactatttagtcgccggctcgtactctctctcatctgcgctcccggccaagtcatcaacagaatttacgtggcttgcttatcgctagcttttctacccctattgaacctgctctaagtagcttctgacagttatatcttctctaagaatcttcaatacttccaaatagtaagtttttttcacctagtttctaggaattcggaagctatagaactatgtctgagaaaaaaaaagaagctatataattcagaaaatggaaaaaccccctagcttttctggatttcaccaactgctttcagaatctccatctcctctaaacatggcctaaatttatctataaatagctatatactcattgcgtatactactaacatgttaacgtgacactttgctagaaaacttccgcaagtttttttcccctaaaatttcagatttgtaaccatcgaatcgtctcgagatttgtgcatgaagaaaaaaaattgctagaaagaaattttcacacttgtcacgcataggattctagcactaactaactaaatcatagttgaatgcaaatttatataagttacatcataattatagtatagttacattgcaattatgaatgtaattacgctttaattatattatagttacatctgaaagttttggactcagaaaaacttgcggcagttttttttagatactacccttatcggagacattgtacgtggtgggtcgactggtcgtgtgcccattgcataatgcaatgctactcacttgagcgcaccatgcaccaaaatagaagcaacaccctcgaaaatagctctatatatacactgcccgtgccaccctcatcatagcttcactcagccacggtctcctcctcctccttccatctgatccacctgtacgtacgcagctcagccgccggccggcgagaaggagaagaagctagccagccagcca

SEQ ID NO: 10458 - DNA, 583 bp, Oryza sativa
ttttcatatgcgcatgaatatgctcccgtttatgccagctaatgtttaaggagtggtcagaagtaagaacattctcagaaattgcctcccagatagaagcagatatttataaatatgaaattgtctattgcttcacaaagtgaacaaaggggcaaaaataaaaagaatgacatatgttttcttgttagaagggttgaaccaagaaccagtcctcagggagccttcgtctgcacgtaccgctgctcgcgataacgcatgttatatacagaagctgtgccattcattgacctagcaggttacagagatagtagagtttttagttgtatcaacgtatcacatcagatgatttcagatgatggaacggactgacggcgctgaagctgtcaaacataggttcagtaccaataatgaaaaggttgatgtcgaatcctgaagcaaaatgtccattgcgtcacggttttgtgattgatgaagtaaacaggctggtcaggggagaactgaatgatctacagatggcatgagagcatattaaaaaattcacggacatcttcttgttagccatgaatttcccagcacaaaattg

SEQ ID NO: 10459 - DNA, 1501 bp, Oryza sativa
taagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctcagtggcatcaaccacttcacacgcgcgcgccgcccgccgggaaggaagccaacgccgacgccgaca

SEQ ID NO: 10460 - DNA, 1501 bp, Oryza sativa
aaacagttgatttggacggagtcgcgacacaactcgatccggcttctgaatgaatacgttactaagccccgcaatcgcagcaccacgtctcctctggttatcaaccgtgccgaaacccggttgacctcgccgagaaggctaatcccaacatacgaatcgaagaacacaagcgagaataagatagattgcgattaagcactcgaattaggggttccacaaaccgatctagcggctaaactgttcttgacagattaatctaagcaaaacccgacttaaaacgatgacgtctactgaataaatataattatgggcgtctagggttgccctagggcgcacacccccttgggctaagcccacgacgcaattacaaggtacaaaacacaaatcagattcggactggataatatatgtggcttgttttgcatattccgggcagctcggtaggaattttgatgtaggaccaaaaccatatgaaagtagactccataagctttccaacaagtactcatgggccccaaaattctttctagatcagcggctaggtccgtttgaagttgatgctgtcagaaggcccgaatccgaatccaaaacgtgtaggtttatctcttgtcttctatggaccaaaagtgacgtggtgagatgaaaaaagacttggaaaaggtcttggtttgatccccaatcaaattcttcaatcatccatgcattccttacgctcggtctcttttctttcgcccaagtaagtacctctgcaagtaaaaacatacaaaacttattgtgtagtaacgtttgttcaaatatataacaagtaaatctaatatagaacatatacatctttggtttattaatacataagttagtcattgttatatccgagctagttgtgttctcatcatttgttttgttattagtctacgtttagtattttaaatgtgtatccttatacgctaatttttttttaccaaaacaactaaacacggccgaagtcaaatttgtctctccaacggcatgtgtgcccgcgtgatgcatgtgagtatgtgaccactgaccagcaacactgagtcactggcaatcctatggaggtacctcttcgtcctatcaatcctaaatactacctcgtctcaaaatagcttaatctataaatatgacttgttctaacccaacgaatttaaacatcattttatttatattcgtcgtattagaatatattatggtatatcctagcttaacttattttgggacggagagagcacaaatttgttagataggtctcttttttcttaatgagcaaacaaatgatcgtgcatactccagcgttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagc

SEQ ID NO: 10461 - DNA, 336 bp, Oryza sativa
tgaaagttttcaaaatttgacttcaaagtttaaatcttaagtagaaagtttttaaaactaatttaaagttttcaatctgttgtcgaaacgacaactacatacgtcgaaagacgtggttacttaatagtggttggaaagaaacgaagtgtattagtttttttttggaatttctctccttccggtccccttattacatggccctagggggctatttatagccccattacagattcttactactagggtttaggttacactgagaaatttatatggttgcccttatgaaagggacatttacagggttacataatgtcaagggggcttatggacccttga

SEQ ID NO: 10462 - DNA, 662 bp, Oryza sativa
caagtattagagtagtaattgtttattgtgtatcccacagatttgtcagaggtagacggcaggtggtgacagccctgaatcccgtcccagtaatcctccgcattcggataaatcatagagctatagccggaaccacgttggcagaccagcaggggtcggtgtccggagcatcatacaggaaattatgttttactcagcttagataattaaaaacatagaaagtcctctctagcctgcctagcctaccttcagttgttgttcttggatagtcttagccttagatagattatacacgttccctgagttcgatatccgtttggggttacccgaatgtcacgcctagaaattcatgaaccagaatttctaagctgaatgtgcattaaactaaactaggggtgagactaatcacagtgaatctggttgatcgcccataaccgcgagcacgactattcgaatagttttactctggccagaggtgtacaactgtacccacaagatatgattccacacatgtcgccatgccccgaagtatcaccatgatactgcaaagggggaaatcgtgacaagaccctccgcataaccctcccctaaccattcacaccacgctaaggtttcacccccacccctcaaaaggcagtgggcggtcccctcttgcgccgcgg

SEQ ID NO: 10463 - DNA, 1501 bp, Oryza sativa
tgtcgcgtatatatctgaactttcgtattggtagtttattttcaatatcatggaaaacatgtgtattttttcccctgccaggtgagatttatactagtataatatctaagaagtttcttaacattcacggtaccacattttttttagtgataatatgtccttagtacccttgggtatccaaaatattagaaagtatcttaaatttgtttgagaaaatatggtactttgtagtttctgaagaggatctcaatgatcattaaaaaaataaatatttaatattcaaccagcaagtaaatacaaatatttccatccgtaaggagtaaatcaagcctgtgtatcttattacctgactgaattggtctggttagctagtataacatgcatagcctggttcatccttattgttgttttcctcgtgtttatctctgtgtttttaacatgtcatgctgatcagctttcaactatgaggaaggtagagctatctgcatgtacagacacaaggtgactgtagtgcttggcaagtgaggatgaagatgtcatcttccctcccctgtctacaaattaagctctcagtactgacacattccagcagttaaaccatgcacatgcatatgatgcagaacatgctctctagtatatatttcctctgatgcattcctgcagctagcagtacttgcacggattccattctctacagtacatattcccttctcatttctccatgctactctttgttttcattttctcttcccaacaaaaaacatgtataccagaagacattcatatatatatatatagctcttgtattcatcatctgatagaatatacagtttcaatcgggttctgcgctcagtttgttcccttctttgcgcagccttgagtacagacacaagccccatccctagctagccttaacttttccattgcatatgagaacaggctaagtttccctgtgatctgcagagaatttaacaaacaagacagtgattgcatccaggaaagtgcagtacagcacgcacaagcaacatacgggcgatcagaaatatactagctagatgtcaactgtgactacatttagaggcccggtttagttcctacgcaaaaacttttcatcctgtcatatcgaatgtttagacacatgcatgaaatattaaatatacacaaaaagataaaactaattagacacattgcgtgtaaattacgagacaaatcatttaagcctaattgctccataatttgacaacgaggtgctacagtaaacatttgctaatgacgaattaattaggcttaataaattcatctcgcaatttacaggtggaatctgtaatttgttttgttattagtctacgtttaatattttaaatatgtgttcatatatccgatgtgacacactgaaacttttcacccttagatctaaacacggtcatagatgaatttaagaacatccttgtgtgcaccagctgtggcctcctgcaccaggaggccacggcattggcaaccc

SEQ ID NO: 10464 - DNA, 1501 bp, Oryza sativa; identical to SEQ ID NO: 1788

SEQ ID NO: 10465 - DNA, 1501 bp, Oryza sativa
gccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccc

SEQ ID NO: 10466 - DNA, 1501 bp, Oryza sativa
tgggagttgaccgcgggtgacccatggggccctgaaggtattagttataagttaaaagacccatttgacccattaagtgaaggactatataagcgaaaccttaatttttcccaaatccatacctagccgccctctctcctgtctgagtcccacgtctctccaacctagcaccccccagccaacctacctctttgtgcgctatccccagctgtcaccaccccgagccggcgctgctagacggtggtgcatctttgctgccatgcccagctggcgtctcgttttcgccgccgccctcaagcgatgccgcctcactgcagcgcgtcgcccccaaccgccaccgcttcctcacagtccaccgcccctagctggtctcgcctcctcacagcgcgctagccctacccgatgtagcctcttcgttgccacccctggacggtgctgcctcatcaccaccgtcctcagccgtagacaccttgtcgccgcccccaaccgtcaccacgttgcggtgcgccgcctcttgctgccacaataggtgccctgcagttgctatccattcgggtagtggaggaccccgctcacccgttgggtcctctgtgggggtgagggcaagtgaggttttccacccggtggccaatgcggggccgtggacagggaaaaagggaaaaagcaaggagcggtggctggccgggggcattcttgtccaacccaaccccgccccgctgccacccctatgtggtggatttggtgctggcctcttcttggctctgtgtaggtggtgttgttgtgtggtggtggtgccacccctatatgaccgattcggtgctagccttttttttcttggctttgtgtaagtgttgttgttgtgtggcggtggtttttttttctggctattgactttcggggttttagcgttgtagtttttttctgttatattaaataaattatcgcgttgtctggtgctgatggttcagaaggaatcattaaaattgtagtggtcgtgtgacagtataaaataaataagctataccactgcattggcgtaattttattgttgggttggggggttgaggacactgtatttgcgtcaaagctgagctacttcctccgtttcataatgtaggtcattttagtattttctacattcattaacatcaatataaaatgtgagaaatgttagaatgatttgtgaaacggagggagtagatgttaccgacgcaaaggtttgccggaagagacggttgccagcgctacaagaaattaatcggagatgaaacagacaaaaatgtcagcgtgtgttttgtcggtgtgttccgatctgggcaacgggcctacacggtcccatgtttgacgggaggaggatgatagaaaaaggcactgcatgcaaacctgattttgtttgactcttttcttggcttttgctctctttgtttacgtatacgttgcttcacaaatcaagtaggcagactggtcatatttcagttctcatcacaggatcgtttggtaa

SEQ ID NO: 10467 - DNA, 1501 bp, Oryza sativa
gggtccggcgccggggaggtcgtgctcgggctggggatccgggagaggaggcggattgggaacctgctgttcctcgcgttctgcggcgtgtgcctgctcctcggcgtcgccaagatctgggcgggcggctggttcgccctccccggcgacgacaaggacgctgatttgcaggtatggaagctataaattcctttccagttttagactttctagctgctattttggcaagctttcttcttcggagtcaacaacacgtgtagtttgaggaaagttgcatgatcctctgaaatgttctgtccgtacatttcttaacgaacaaactatatatcctgctgttacttaattcgaaggtctttgaagactatgaaatcatgctagcttgctaatgttcaactgtaatttccgcacgaacttctgatccttggtgttccaatttgtaagcatgcagtttggccatcctatttgttccataccgtaactctgcaatttcatgttctggagtctggacaaagcaacaagagttgaaaacagaaatgtttgaaatcttgacaggtttttagacagttgaatgtgatacttggggaaaaaaaattgtggtggaagagatgttagaatggagttactgcattttagatttgcatggaccttattgaatagggatattttacaggagatttagcattttaatttttaggacagtgtcttacttgcttggtatgtctataccaactaatttactacgaaaacgcttctttggtgcttttggccattggcagttggatgcagttaagttttggatcttacgaaatatattttgtttgtacgttcaatagtttattgtagtagtcaggcagtcaacttgagtttattgtataaaaaatttagataactcgagaggttccatactccatttgttaccaaggttaattataagggacatcatgtgggatggagatgggattcagagcgctgcaaccttgagctagcttaccagccaaccgtttgtcattgtttgatcttcccaagtaggatgtgttgatctctttatctcaagtcagtaatttcacttctagtttttaccatggtgccctctctatctctactaataactcaatgtctgaatcatagcattgcatcgacataatttagttaatccttttagtaacattttttctattacaagcttattttgctgttctaacatttcacgaagtttgtatctacttaccttgttgacccaaattgttgatcttacagtgtaatttggttttgtgctgtccatgtttctaggatctctcaatctcattctccagtgatggagggtatcaatttgatagccactttggacatgttggagggaaagagagtgacaggatgttgatgacagtgggatcagaagacagtgttcctgaggctagtaatacatctctgcctcgacctttttggttcacacattaattagtggaacataacatttattttggctggtgcttcatgtagg

SEQ ID NO: 10468 - DNA, 1501 bp, Oryza sativa
aaccattttttaatagtttagggggggagtaaaatgagaacaaaatatttcaggggtttagttatccaacgaaatactccgggagaataaaatggacattctagatataaaaattttgtaaatcatatttaaattaataatgttgggttctaccattttcatacctgattcctgacaagaggcctccatcgccgtctcatctttatgactatactcattgcctcgtctatgtgactctggcatttgttcaactgttaaatcttcgttgttaacttgcttgatgttcgtgccattctccattgtgccggtgccatgagccggtgactatggtttatgtgtgttgcaccatcatccaactagggctatccagattagcctcttactagatgccaccccatctatattttaaaattacatctatcactgggttacagtgagttttgaggtatgcaccgtccagtactaaagacacggccatgcttacagccatattgtttcgcttatgtttatgcttattcctacggcttattagcaactaacaaataatttatcggtaaaatttttatatacatgttcttagagattcgaaagcaaatgctataaaataaactacgatgaaaaaacccataaaatgaactctaaaattaaatttttagcttatcagcatatatagaagcgaaacaatgaggttgttttcgtgaacgcgtaaaaggattgcacgtcaatatattagaagaaaagagttttagttacacaatgcaatcagccagaccgacttatgctagcggaaggaagaaaaatcaaaataaaaaagctgaagcttagaaaactacggcggctaaacacaaactctaaacaacggaaagggaaacaatgaggttgttgatgtcttcatacagattaattagtgcactgctgttcatgatagctagtacttgcacagttttactgctaggtagcaatgtttcaacatactctatctcgtaaatcaaacgcaaagacgttcaaaaaaaaaaggaaacagaaatttactatactacaattctcctactacatatatccacgtccactagaaaacatgagcccacttaagattttttggctaggtaactcagaccttttttaattttgctaattaatttgttctgaagaacggtgacacttttgcctctgttctgaagaacggccacaacgaaatcatatataccgtcacctacaaacaaaagtgatccgcatgctttcaaaaactcttgagaaaaagaccaaacggctatgcagccgatccaatgaaccgttagtctgcatgaattcagggtccatactgtccacatatgcacacagacaaaggcatatacaccgtccatcctaaaataagtttatttatagatttttgtgttcgacatctaaccgttcatcttattaaatctttttcatgattaatatttttgttgttattagataataaaacataaataatactttacgctgatttttttatatt

SEQ ID NO: 10469 - DNA, 1501 bp, Oryza sativa
tgctgagctcaactgaacgctggctgcctgcatggccagttcgtgactacagttactacgcatactacccggggtagcagcggcgcgctatcagctctacccggagtaggcagtagcagcagtggtggtagtagtagaaagcgcggcagtggaagggatagaggagtgcccacattaataactcgtttcaaatcggacggcgtggctactctagtacacccatttcaacgggacgttccactccactccaccgtaactgcgcgcgtggggcgaccccatcacgtgccacggtacgggggcgtcgctgaccgtctctggcccaccgcaaccctgctcccccaatccaaaccccgcgctgcacgtctcgctggcactgggcatttcgatccatcgcggtcgcggccgcggtatcacgactgacgcgcggggccggcccggcacgcgagaccgatgtagacgtgtcaccggggaagcttgtccgctcgcggttgccgctgcgcgggggggaggggagggcgtcgagccgtacgtcgtcgtcgcatacctcggtcgcgtccctgtcaaagccggccatcgctgccggctgctcaatttattcccttgctgtttcatttcgtacgtactccgcgctcgggatgcggccatagccatatcgccatatatctcgtgcaggcaccgtcacgctcgctcggcaactgtacgtgccgtctcaggacgcggcagtcaatgcggagttggtacaaacttgcgatgaaaggagtggtactgtggtaccaccactgccctgtctttgcacacatcagtcttcccggagtttagctcaaggaacgtgggtgggggtgctgtttgtgtttgtgtgtagtttttgccaatccaaacaaattggcaaagggggctggaagagtccatggtatttcccctatttgatttgcaatttgaactgtgcaaaaaataacgcgtgatttcatccctgtaccacgggacgaaggatcggctttgcatggtctggggaatcatggccccataccggagaagtaccgggcccacgcagccatgatccatccctcgagacggcccggcgacagcgtatccaacgtaggctcgggcccacgtcgcagtggaacaaagcccacagacacaaaaccccaccccccgctcgctgttgaactctctcttccctctctctctttctctctccaaaccccacgcacgccgcgtcgccgcctcctcctctccatctccgctgctattattgcccgcgcagacgcaggccaccatccttcctctcgctcacgctcgctgctatatgggggtcctcctcatcgcatcgcatcgcatcacctcgcacgggcgcgcgcgccgtgccgtgccgctagctcgatccgcctcgtacgccagctcgctcgctcgctcccccaccccgctgctgcacggctgcgcccgcgctgtcccctgtccccccgctcgccgcggcgatttatacccaccacgccccctgctg

SEQ ID NO: 10470 - DNA, 1501 bp, Oryza sativa
aaaccaacctagtactgaatgtgacacattctagtactggatgtgacacattcgtttttttggatggagggagtattgtcgtgttcgccactgtaagtaagtaagagtgacccaccagtaaaatcaatttttgaaacagagaatgagaggaaggaagtacgcatctgtcgaaaaaaatgatccaacaactttggaactgaaaatcctctctgatatataaaaaaggcaaataaaattggtgttggaaagtcatgttcatgcatactacctccatcgaaaaaacaaacttaaaattaaatgcgacatatcatagtacaacaaatcatatccaatccagattcagatttttgtaggacggagggagcaaggttgtgttattccctttcttttctaactcatcttcatcttttcttacgtgtatgcttttcacgctgttaaacaatttgttttttacaaaaaaaaagttttctatagaaaagttgttttagaaaatcataataatttatttttaaaacttttagactaatatttaattaatcacgtattaataggtaacgctattttccgtgcagggaggctcccgaactcggccagaaacttgtttgcttttcaagtttccatctcctcttaaaaaattaagggctgtttggatcagggactaaaattttagtctatatcacattagatgtttggacactaattagaagtattaaactgcaatactactgctagcgttctgcatctgtataggtgaacatccaaatctgcagcggaggaaaggaaaggtacccatgggccatgacgccacgggtgacgccgatcgatcgatcgagacgcacgctccgccggcgctcgctgattggcctccagcgtccagcggaagcttcagacaaacacggcgcagaccatgcaccaatgcagtgctctctgctctgatattttcgttctgaagctgagctgagtgagtagccgatgccagagcgagacgggaacccatcgcgtcgtgattggctgagcagatgagatgcagatgcggttggaagaagaagaatggctggcagtccccgatacgacagcagtatgcatggagtcatggagatccgtctcgggcacttcacttcgatctgcaagtgtccaagattgcagctccatcccaaaataaatttatttatggtttcttcgatatttgactgtccactttatttaaaaaaatataaaaaaatcagcgtaaagtattatttatgttttattatctaataacaacaaaaatattaatcatgaaaaagatttaataagatgaacggttagatgtcgaacacaaaaatctataaataaacttattttaggatggacggtgtatatgcctttgtctgtgtgcatatgtggacagtatggaccctgaattcatgcagactaacggttcattggatcggctgcatagccgtttggtctttttctcaagagtttttgaaagcatgcggatcacttttgtttgtaggtg

SEQ ID NO: 10471 - DNA, 1501 bp, Oryza sativa
gagggttgtaattggttgggaagagaatgttgatggagaagttatattttggaacaaatactgagggttaaaattgttatattttaggatggagggagtatcttcaaggaatcctgggatccacccctgagaaaacctactgctcaattgttgtgatcatgcatacatgcagtgcaatctcactgaacacaagcgagatgttgacaggctaggagactattctaaactttcaaggggataacccctccttatttacatgtcactcacttaaaatagttataaaatctctttaacaagatagattattatgtgataaaatctaaccgagatatagagattccaaaatgtcttataatgtgaataggggagagtaacttgtttcttttttttaaaaaaaaatccatctcaattacattcattaattattaattttagaattgaataaataaaatttgaaaatgatattttaatatggatacacttcatatttaaaactctaagttttctttttaaaaaataaatagtctaatttacaatgacatattatatttaacatgagtttaagtatattcttgtagatataactatccatgatcatattcgttactgttggtatttactttgtatctatattcattataatttctgtatctgagattttttttccatttccaacaaaaaaaattaaacaaacatggtggaggtaatttccgtctattttcgggccgtttcctcactaccaattactacatgatcatgtgttatacgccggatccatttcttttcacaaataaatgccaaattaattcattttctaataaatacaacacactctatcacgatgagcgtttctgaaagattggatgggagtatcttaagattatcgaagacactataggtgtttaatttcgctttaaacacaacatgcacgcaccttacttgagagaccttactgatatatcttagtactaatgaaattacatctctctatcgacgggtacttgttgataactttttgtgacaagtcgacaagtacgatcgcaacacctaaacgtcttaaggtgatatggagtcgccaaccacctcgatctagctaaaaagccaaatcaagataggttttgtagaaaacggctaaaccggctagcggagccgatttagagattaaagtcagcatctagaccgatttagatcgatatgaggataactacccgtctcgtagacaaacggaaggttttcaggacaaacctacaaagaggtgtcgtactctcgcagcggcggcggacgatttacggcacaaatcgacaaagatggactaaaactagggtaaaataaaaaatatggctaaaaataaagataaaatataaggtgattcaagtatattgtgtgtttgggggattacaattgaaccggccttgtcccttaaatgggggttggtcttgccctctacaggttctcctccacgtctaacttgggatagaaaccaaaggaaacccgaaacatg

SEQ ID NO: 10472 - DNA, 1501 bp, Oryza sativa
gtgctaaaaatcacaaaaaaaaaaagaagtggagagaacatccaatcgaaatcatagatgataccgtgaaatttttttttttgtcacacacgcatgatgaagttgcatgattcagggcaatagtcccatccagcgaagctgcgaaggtggccccgtagacatgacgagcgagacaatcggtgcctaactgaatgaagacacgtggacaggggcagattcacaatgggggcacgtggacaggggcagattcacaatgggggcgggggtcttgagaccccactaccgtctccgggacagtggagaccccctaagcccccactaaattttttttccatagatccataggatgtggggactggaggttcgatttatgctgatgtagtttattcagcctccactactattttttttctagatccgcccctgcatgtgaacaatatgtgaagaggcaggtggacgcgtaaagcgtgtgcatcttcatgcgaccgtgtagggtatgagaccgactcgatcacggaggcgatagacaaaaaaaatgatagaaatataccgaagaaaaatagtacgtatcagaaactgagcgatgtaaaaaagaattcaataaaaaagaattcaatagaaacattttcaatctattaacttaataaagtaacagaaaaagaagcctccacgttcactcttacggtctagaaaatctcacgttaatcgaaagaaaataagaaaaaataaaaatagaagggtattaggattaggttttgtgtaaacggacaaaaaaagaagggtattagattgggtgtagtgtaaacggataaaaaaattgaaacggacaaaaaaaaatggaaacggacgagaaagatagaaaaaaagtgaaaacggacaagaaaaatagaaattccaatgttaatcaagacaaagagaaaaaattaaataaccatcgcgtcatagtagatccagattataacagtttagatttaatataatagttatataactaatagaaatcttttttttacagaagcttaaagtaaggtataggaatcggagtaaaaaagtttgagatggaaacgaccaaacaaaccacatacacaaagtttatttctaattcaaccaatgcagagcaagtgtaattggattaagaactaatccattaacttatttaagtaataggaaaattagactccacattctctctcatgggctacaaattcatattaatcaaagtccatatagaaaaacaatttaaaatagttgaatttgtaattaaaaataatgaatattggaagagaagactagagttcatactggtatataatttataactaattgaaatacgtaatcagagaaaaagaaataatagagtccatatagaaatacaattttaaatagctgaaattcaaaattaaatatggaattaaaaactagaatattaaattgctagaagattcatgcagttttttaagtacatactcgatattctatgctatatatcttgtcttctaga

SEQ ID NO: 10473 - DNA, 780 bp, Oryza sativa
gcctcgtctctccgccgcgctcgcctttgcctcgccgtcgcgctcgcctcttcaccgctctcgcctctccgccgcgctcgccgctgcctagccgccgtgctggcctctccgcatccgccatcgcctggagaagtgagagagagaagtgagagagagagagagagagtagagagaggagagagtagtgtaagacaagtgggtcccacatttttttataaagagaatgttgactggactgccacgtgtacgccacgtagaccaaaactaccgcggattgggtcgagggggtaattcgtccggtatttatagttgggggtgaagaatgtccggttttatggttcgggggggtaattcggatgaccgcgatagttcgggggggtaattcgtactttttccattctggtttgatatgttggtgaatggtaattttttgggttgatatattgttgaatgctcatattttggtttgatatgttggggaatgggaaatttttaaggagatatattgccgaatgctcatatattgggttgatatgttggggaatgggaaatttttggggtgatatattgctgaatggtcattttctgggttgatatgttgctgaattctgaatttttttattagatatattgctgaatggttattttctgagttgatatattgttgcatgcatattttattaatatatatatatatatatatatatatatatatatatatatatatatatatatatatatatatatacatatatatatatattactgaatggacatttt

SEQ ID NO: 10474 - DNA, 1501 bp, Oryza sativa
cagtttaacccggacaaaattaatctcttacatgataataaaaagaaatcgaacaaacaatgaggaatccgagcaggcaaggtaagagagagaagtcgcgaagagatccgacctggcggatggagtcgaggcaggcggcgatcagatccaccgaccccatagtccactatcccctgagatcccaggaatcttttcgccgccacgcccccaccctccccgtgcgccggcgacgcggtagcgaggatgggaggggagacaccagccgtaaagaactcggtggggttgggggtgttcggcgctgccgctcgccggagatgccgccggtggtgtcggatgaatcgcggcggcggaggagacgagacgagacgacggcgagagagagaagagaagacgaaaggattagtaggcccgtttggagtatccggcccgacccatctgatttgggcccagtaagcaaacgctcatgggtgtcgaccaattgaaaaggaactttctactgcatatccgtttcatattaaaagacacttttaatttttttccagtaaaactcttttttgagtttgatcgaagcttattaaaaatatatagtaatatccacaacgctaaataaatttgtttcattaaattttacattgaatatattttgataatatgttttgttttgtgttactatatgtttttaggcaaacttagtgaaactttaaaatgtatgactaaaaaaatatacaaaacgttatgaaaggaaactagtacgtacctccgtcgcataatataaggtaatgtttggtttggggacaaggtgggatgggttagctccatctctatttttgaatgggatgattatgtttttttgtttggttacagggatggaacgaaccctgttttttaatttggtttgaggaatataatgggatggaatgatcctatacattgtttggatggagggatgaaggtgggatgcctgatagggctacctattgatattagttggtgaagttacccccaactagtcatgaacaccatacagtgcaaaataatacttagtcatgaacaccacactatttaaaaatgaccattgtgaattccaatttcgtttgttcacaaacaatatagctccataagttattaaaaaaatttaataaaacttcatgtatgcccaaaataattgctgcagcagcagcagaagcttcacagtgcacatataatacaagccacacataataatagcaaattttagtcttacatatattagcaacttaaggtcttcacatttaattcttgcacatgatagcaattttaagtcttactcgtactagtaagttctctgcctcaaacatattggcagtttaaagtcttacataataggtaaataagccaaccaacaacacataacaccaaaagaactatccaactcatccaagaagcctatgttgatccagggaacttttcactaatgaacatagcaaaccaatgcatcttgttttcaaatggaagtccatcg

SEQ ID NO: 10475 - DNA, 718 bp, Oryza sativa
gaaaagaaaacagttgtagcccatcaaacaattttaagtcatcttattttctcgaaatatccagtaggattaagcaataagcatcgttagtgagaattgtatttattgattttatttcctttatttgaaaacaagtcaaacgacctatctaggtttagcagacgtttttcactgttcatactctatcactaatcagagtatcagagaatgaattcctttctttgaatacaagtcaaacgacccatctagttttagcagaggtttttcgctgttcatactctattactaattagccaatgagagaaatggaggtatgaatccaagcttgtcacatcaatggtgcggccgccggcgccgccgctgccgttttccccgtgcaaatctcctctccggtcaagcgattacacataaaaaaccactcgaatcgttgtcatttttcttcgtcttccgatcaaaatcaaacacgcattcaatccgagagtcgcaactcgcggactccatgataaaagcagtgtgtgcttcttgttttctggtcgtcatctgaagacagcgatcgacatgcgtgtatgaaatctggacttcagtcagccagaaaagaaaaaagaaaaactaaatgcaacattagcatttaaaactaaatcaggttatagaatgtattattacaactctataaaatttatattacaactaaattggagtatttcggtgagaaaggcta

SEQ ID NO: 10476 - DNA, 1501 bp, Oryza sativa
aacaaaattgctcacctagtgtgtcaatggcaaaaataaaatttttggtattttgcttcaaactattgcaaagtaatcagtttggcttcctcacctattttgcttcaatcctatttacccagcaaaatgctgccctatagcgtttctgcagcgactgataatatatccttaccgcacaaaattactatattacagagtttcttacaggcttaataaacaaatagtattattttctcttcatattatggcaaacgaaaacaaatcctatatctatatatatctatcaagttcatccccactacgtgtagttaatgctaattctctcttctgtcgtgaagccacatcaactcaattcttttaagactttggatgattcatcaaaagtgtaaattgcatctctttccaccaaaagatacaccatacaacccaattatttatgacatttggataattaataaaggtaaaaaatatataaacacatgaaaagaaatcatatagttggtttgaaagaaaattttagaactcatatctactatattattacataattcttccgcagcaacgcgcggggtacacatctagttttactacacaccaacccacacgtataggaaaaacacattgtaaacttatttttggtgcaaactagtactccctccatactcgtaaaggaagtcgttttggacagcgacacggtctccaaaacataattttgacttcttatttctataaaaatatttattgaaaagtgatatatgtatacttttatgaaagtatttttcaagataaatctattcatatattttttatattttcaaactcaacaacttgagagttatttatgatttgtattcccaaggcttgacttaaacattgtcctaaacgactttctttacgagtacagagggggtatagagtaaagtctctgcttataacctagtacgtatttactccctccattccaaaatataaagcataaccacccttatcccaaagaccaagaaataattaatatctcatcgttattatgaatcaccccaattaatacaatacatgcaaccaatagaattgaagatcttgtgagtataggatttaaaataataatgatttaggggagagaatgtgctaattaattgcatgcatgcatgcacgccttatattatgaaaccacttttaaaaatagttgtgccctatattttggaatagagggagtattatttacccagcgaaatacaaatttactcaaaataatgcgcaataaaaggattatttacggcccaatagatcacatgggcctaaagcccagcaaggaggatcggagcccagccccacaattgggtgtgtgtagacatctccccgatcttcgtctcccgcccttttcgtccgcgacgccacatcggagtggccggaccggaagaaggtgcccgcgtcactccccgctccgccgatccggccgagctctccctctccaggttcccttcgcgagcttgggggaacagga

SEQ ID NO: 10477 - DNA, 1501 bp, Oryza sativa
agtatgttgtgttgctgttctgaatttatctcaggcagtcaggctgtgttcaaaatccgctccaaggctgcaatgctgaacagatgcggatccatcaaggttgttgattcaagcctatgtgcagtgaaatctatttgcatatcatactagattaccaaatactcaacgatgcggatgcagtttaggtggcaatgcacaccttcgacatgccatttctcaattcctggagctatcagattatcatactgaaatgagaatgcaggtcaccatgatccaacctaactccattgctgccaagctataatttcttcgatggatttgatggtttcatcacgcgtctcctcatttgcaggaggccaagaaagccaaagaggaggaacgccatggagaagaagctgtccatcctcgtctgcctcctcctgctcgccgtctccggccatggcctgcgcatcctccacgacgtcgacggcgacttcggccagggcttcgccttcggctccaaggccgccgccgccgacgagacggagccgctggacccgttgctggacgactacaagaacgagatcagccacctggagttcgagccggtcgacgccgggtcgacgccgtacgccgcgggggatgcggacgcggcggtgccggctcctgggccggcggccgaggcggggagcgccgccggcagcgacagcatgaagtggtggctgccgccgtcgacgatcccgtcgttcccgctgttccccgggatgcccggcctcggcatgcctctccccggcatcccattcaagcccatcggctggggctcgccggcggcgcccggccagtacgcgccggatccccccgccggcgccggcgccgacggcgacgcggacccgagcgccgccagccaagtcatcaactgagccaatatcgatgacgtggcacaccacgtagttctagttctacacgaaatgaatccttgagtttttaaaacggagttactataaatatgacgctatatgctatacagtcgattttttttcagccatttatacagtagttacacctcatttacgaatttacatactaattacatatataattttcaaatttacatatataattttagtacttacatatgtaattttgagacttacattgtaaatacactaaaattacatatgtaatttagggacttacaatataaatacatgccgactattttttgatgaaaaatatggtgccataaatataactacacccttttaaaatttccatatgtcctgtaaaacgaggcacaaatctatcgtttttatgaattcgcgttgaatttgactcaaaagcttttctcacttttgttgatagttttcatgggccgggcctaataagatggtaaagccttttttctgggcccattaaataaagccctaatcggagtagaacccgggttgggcggaagatctgagccgtccatcgctcacgcctggttagggtttctcccttccgctgttcccttagctctata

SEQ ID NO: 10478 - DNA, 1501 bp, Oryza sativa
  unsure (1)..(1501): unsure at all n locations
agaaatggatcatatatattggagtagatatgataattactataatataaaaatggtattttccgttagaacagggtagattttggaaacggttgacataatcacataatatcaatatcgtttccgtttctatttccatttttttatcatttttattcaattttatcggtataatcatttctacatggctcggtccataaaaaacagaaatgaacttcaggcagtcaggtatttccattaccgttttcacagtattagtttatgccaatttatgtgtttaaagcagtcaaaccggtagattatcttcctttcttttagaaggggaccaaggccaactagcagtgcgatccagttgttgggctataatatcagtttcctttcgttaatgggccgggaaatggaaaacggccttcggcggcagcccaacttttctcacagacaaaaagagtgtcttctggaagtacttctaacagttaaaaatatttttttagaagtaaaaacaatttgtaacacaagcagacgttaatatacacggagacatactcacccctataaacatatatacataccgatatgtctctatgtacacctctaaaatttctcattttcacatgaacttttctaggcaagcctctattttcatcaaattctcaaactatactaccgggactaaattcagggtctgtttggcacaacttcaactccagctccacccctcctggagcgggagctcagccaaacagtttcagctccaccaaaactgagagtggagttgggtggagctctctcacaaaatgtactagagttgtggagctggttaaggcagctccaactccacttcagactcaactcccggagcaatatttaggagttggagctgtaccaaacaggctttcatagtcaaattcgactacgcgaatagaaaaaaaaacaatccaactacacaagaacgccgcaagctttttagttaaatttgttttttttagtcgtttcagttccttagaccgtcaaggctgcagcgctgcattttgctgcaccggattatgtgacctgcgtcaggaactgaaaagtggagtactttttttttccatgtcatattctctgcgtagctgccgcccacgagattacatcaaagttccaaaatgttcaaacatgaaagtacaattgtgaactttaaaaatgaaatgtagtaaagtaacatatatataatctctgaaagtatgaaagtaaaaacaaatacataaaccgtacgtacacgtacacgtaaaacacaatggcacgacctcaacacatgcgttgagaccgtgcgtacccaaaatataatgtacacttcaattaagccaagcacactagtagtttcaattnctaaccctantttggaccccaatttcaagaagaattcaaactaagtatgaaataaataacacactcacacaaacattgagaaatttcacatgaaaaatcttantttacctactgnnnccnnnnnncnnncnccgcc

SEQ ID NO: 10479 - DNA, 1501 bp, Oryza sativa
gttccatgctaatagtgcagactgcagagcaagagaactgattgatatttcttttgttgtgataaatatagggctaactgcttgctgaattatacgagcttgggcattttaaaggaaaaacgagtggatctatatacaattcttattttctactacctctattccataatgtaaggtatggtcaaactcggcacagtatacaaaactattttttgacttataatttcttatatactataaaatttgtagcaacaaaattataaccatatcaaagtatattgaaatatcaatccaataatattattttcaacaaataaaattcaatttatattatactaatcgttagtgagatattttgaaagttaaatcttgaaatatgtgtgtgctttacattatggaatggagggagtacttctataaaaaaaatgcaattatgatttctatataaaactagaaatagagtcagatttcatatacaactcttgaaatagaaaatagaattggatgtcatatacaacttttaatttcttttctgttacctgtagtttgtatacaccatacttttaaaagtggaattagatatacatctcttaacttctcgttttatagataccaccaaccaatttacaccgctatattttaaacccattatgacaatggtcatttttttttctaaaattaatgtgagaatttctaagcaaacttggtgactcttatttgagttaccttaataataaatccaacgatcaacgttaattttagttatttatattttatttttttccttggatagagaacacattatttatttgattgagaaaatatggaagaactataaactcgtagatgtcaaaggacacagtaggaacaacaatatagatgtcacgatcagcgttcattttaattcctttttctttggataacgattaacgaacacgttatttatttgatagagaaaatatggatgaacatagtatatacaaaaagaaaaaaaaatgatttgatagagaaaatatggatgaacacagtatttgatagaaaaaaaattggcttcgcccggactcgaaccggagaccttcagtgtgttagactgacgtgataaccaactacaccacaaaaccaagctgctggtaagtccaaattactttaaataaattatccctatgggccagtacaacacatgctttagatgtaataaaatagattagctcgacataactactctatttcttatttagttttatcattgcaaatgtacactattacttgaaggtttaattaattaaatccatgcaattgtaaattttatggtttttaaaatctaccactatattcatgtaattggaaccatatcaccatgacaagcctaaaatcgaatccatatcacactattagcttgagacctgtgttaaatattttttctaccatactttttatggaacagaatgcccttctgtctccctgttttaacgaattttttagagacaatactattttaata

SEQ ID NO: 10480 - DNA, 1501 bp, Oryza sativa
gtcgtgtgggtaaagtgtaccccctctgcagaggtcattgaactgttcgaacagccgtgcccacggtcaagggcggatgtgaggtgattcctagcgtagttttgtttgactactgcttgtgaaattgctgttgtgaaaaggggttcgatgtttgaaaaatctgtagctgatgggatcagctaggcccgggtggccgtttgaaaagttgttggcccgggtggccgtttgaaaagttgttggcccgggaggccgtttgaaaagctgttggccgaatgccaaccctgtttcaagatctaaagactgatacattgcacatactccgaccggacgagacgcactgtcccatccgtgtcgtttgagaagcactcacctagtcgttttagaaaaagagttcaaataaaaccaaattgcaaaaacaacagccttcccctggcttgctgagtactcccgtactcacccttgttctatataaatatcccccccccagttgctgaagaagatgaagcggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatcagtccgcagcccaacatgactgtacttctactctataataaagagacctctgttgctgtgatactctgtctccctgtgataccagcattgtttcctgggactggtatcgattaacaggttaatttggagcgtcacgggctagttccggtcgggactagttcggggcgtgacaatcccttacacaagggtaggatggttgatggagtttaggaatttggttaccgacagttcatgtcagtactaggtgttttcagtttcctaggtcatgttatgcaggaccgcggcaccagtcgtctctctagatgaggtacaaaatgcttaatttgtggcactaaccagacaccagcgcgatatagattgatgctggactagtcgatggcatgatacagtccacactgacgatcagactcagttcttgaatccaagctagactctggaacaaacgttttagattataagttttttcataactagacgagttgatcaggattggggatttgctggattagactcggccattttggcattattggaagaaactacggttgagcaggatgatctcgtcgttgcaaaacttgtagccagatgagtaaacatttgtggttgattgcatagataaagctagcattaacgaatgcttttaggagtagagttcgtctcaaatacgaagagaaggatgtacaattcctggaaaaagaaaagatttgcagttattttggcagcgtattcatatgcagctattcaagtatttgagaaattaaatagcataaaaatgaccaattagccaggcccaaaattggccatgtatattcatcttataatgcaaaggccggacgctgcccattat

SEQ ID NO: 10481 - DNA, 1501 bp, Oryza sativa
atatataatgggcagcgtccggcctttgcattataagatgaatatacatggccaattttgggcctggctaattggtcatttttatgctatttaatttctcaaatacttgaatagctgcatatgaatacgctgccaaaataactgcaaatcttttctttttccaggaattgtacatccttctcttcgtatttgagacgaactctactcctaaaagcattcgttaatgctagctttatctatgcaatcaaccacaaatgtttactcatctggctacaagttttgcaacgacgagatcatcctgctcaaccgtagtttcttccaataatgccaaaatggccgagtctaatccagcaaatccccaatcctgatcaactcgtctagttatgaaaaaacttataatctaaaacgtttgttccagagtctagcttggattcaagaactgagtctgatcgtcagtgtggactgtatcatgccatcgactagtccagcatcaatctatatcgcgctggtgtctggttagtgccacaaattaagcattttgtacctcatctagagagacgactggtgccgcggtcctgcataacatgacctaggaaactgaaaacacctagtactgacatgaactgtcggtaaccaaattcctaaactccatcaaccatcctacccttgtgtaagggattgtcacgccccgaactagtcccgaccggaactagcccgtgacgctccaaattaacctgttaatcgataccagtcccaggaaacaatgctggtatcacagggagacagagtatcacagcaacagaggtctctttattatagagtagaagtacagtcatgttgggctgcggactgatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccgcttcatcttcttcagcaactgggggggggatatttatatagaacaagggtgagtacgggagtactcagcaagccaggggaaggctgttgtttttgcaatttggttttatttgaactctttttctaaaacgactaggtgagtgcttctcaaacgacacggatgggacagtgcgtctcgtccggtcggagtatgtgcaatgtatcagtctttagatcttgaaacagggttggcattcggccaacagcttttcaaacggcctcccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccaca

SEQ ID NO: 10482 - DNA, 1501 bp, Oryza sativa
accgacctttcctcctcgcctataagcccgcgcccttccctttcactctccgcgccgtgcccgcccgccgtcacgtctgcctcgccgcgactccatccgccccgccgttcccgctcatgggtgagctccccgcccaaatcctctcatctatatcctctagcgactcctaaacagcactggggcatggtagtttgtgcgttcgtcctccaaatcgcgcccttgccggtgccttgctcccgccgccgccgtgcgcagtcgcgcgccgccgccggtcggtcccgtgccgaatcccctcgccgccacccaccttgagctccaatgaaccaccccaaaccgccaattccgccgccggcctcctcttttgctcccgcgccatgccacccatcccgccgccgcacggccgccgtcgccggcctccgtcgcgcctctctcccatatccgagccggtggatggaacctccgtgaccccctctcgcttccggtgcccgccgctcgctccggattgccaccgttcgccggattccgccgcgcgccgtgagccgtccgatctccggcccggctcctctcctctctctctcccgtgccaacgtggccgccaccctggcccgccggcccagcttgaccgggtcaagcagcgaccggtcagcgtcgcccgcgcgcgcaggcctggctcggctcggccacgcccacccggccgtgggccgcccaacccgagccggcccatctcctctctctctctctctctcgctagctgatgggcctcacctctctcctcgctccttggaacaaagtctatgttgcgtctctcttccaaaccagctgccgtggaacaaagtctaactttgctccctcgtcctccccctaccacatccgccacccattggaccgcagcccatctatcctctctcactctcacttcttgttggccccacttgtcaatgagtcaaagatattcttgagaatatcttttccaatactccacaaatatttctcttttctataaattcaataaatcatttttccctctttcagaaatcaattccttattccaaaattccatgaatcattttccttggtcagtgactgtcaataatattcttgagaatattatttccataaattccgacaaaacatttccttgtccagaaaatccatttagacctccaaaattcatatcccttgatccgtagctccgatcgactccgttccacttccaataattccgtaaaattgagatctgtttaatggcactattatttagtctaaataggatctttcttttggtcttttgtttaggttttcgattgtttgcgtatagttgcggttatcggattttcgtcgatcatgggatttctcgaagattcgtaaagcttcgtgaagaccttgagaaagacaagtcaccctttgaccaattgctcctataattggaaaatcattattattttgtttgcaactggcattattagaatcacacacttaacttgcttggcctcggtttgcg

SEQ ID NO: 10483 - DNA, 1501 bp, Oryza sativa
ctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaaggatcaaatcctcacataaacataggcctttttaggcgttcacaaatcaaactccaaccaccttgatcggtaagtgagcaagcttctcgtccttgccttactaagaacccggtttgtccgaccccgccccggcgttcccaactattggcatgcgaggcttccctgaatcgactagttacttagccagggtgtcccattccaccttgtggttgcactttgattatgttcgatgagtttcccacaggaatcggtccttatatgcgaatacaggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgccagttgcaaacaaaataataatgattttccaattataggagcaattggtcaaagggtgacttgtctttctcaaggtcttcacgaagctttacgaatcttcgagaaatcccatgatcgacgaaaatccgataaccgcaactatacgcaaacaatcgaaaacctaaacaaaagaccaaaagaaagatcctatttagactaaataatagtgccattaaacagatctcaattttacggaattattggaagtggaacggagtcgatcggagctacggatcaagggatatgaattttggaggtctaaatggattttctggacaaggaaatgttttgtcggaatttatggaaataatattctcaagaatattattgacagtcactgaccaaggaaaatgattcatggaattttggaataaggaattgatttctgaaagagggaaaaatgatttattgaatttatagaaaagagaaatatttgtggagtattggaaaagatattctcaagaatatctttgactcattgacaagtggggccaacaagaagtgagagtgagagaggatagatgggctgcggtccaatgggtggcggatgtggtagggggaggacgagggagcaaagttagactttgttccacggcagctggtttggaagagagacgcaacatagactttg

SEQ ID NO: 10484 - DNA, 1501 bp, Oryza sativa
ccgccgctcgccgttcctccacccatcttcctgcgctcctctccatccgccgcttgccgctcctctgctccagatctgaccggcacagaagaaggtgggatacgacggtggccgacgattgaagatgggatacgatgggaagaggagggatgcggcagcaaggtggatccgccgtcctcgtcgccgcgacctccgctgagctcgtcaccgtcaagctttttgccgcctcaccactagttggatctggcagtgctcacaccatcagcggggacgtgtgggcaaggcggtggccggatattgaaggtgggagacggtgggaagaggagggggatgcagcagcaagttggattcgtcgggcgccactccctctagcagagctcgtcttcgccatgtcgattgctgggggaaaatgacgaggagcaaggggcggagtggtgaccccatcgcttgcccttgcacacgcgggtgcggggcgctgcatgcgcggatgcagcgcgttgcatcgtgcgggcctggccgagtagcgaagctcaacttgagcgtttctgctcagcctggctgtgggggattttttgcatccgctcgaccaggctgggagcgagctgcaggcaaccaaacagcgacctactgcatccacgcgtgcgagccaggtttcatgcatgcaaccaaacacaccctcgcctgtaggctgtacttcataccaaaataaaaacaatccagtagtgagtacaatctaatactccgtcctaagacattttagacggatgggacatcaaaatctccagattttagacggatgggacacttcctaatataataaatctgaatttgctctctgtccagattcattgtactagaaagtgtctcatccgtccaaaatctctcatattttagaacgaagggtgtagtataagatgtgaaaatctttcctaaattgaaacattaaatctttgctttgttttggggttgaaagcttattccttcctttctttttagccctagctcagtccgctacctccctccactcaacttacatctctttggcctagtccataagtgaagccacgggacgtctccaacctctgcaacacagtcttgtcctgtgccctacgatgccggagctgatcttccccaccaaaccagattgattctttctcgttcttccaaaattagttgataagtctgtatgttgctgtttccacagcagagcaaaaaagattcatcatgcaaatagtaacttgaaatttcctaatgctggagtactttagttgaatcattgttcctcatgtgtttcttattcaaggaatgacatcactggtggaggaaccatctttgctcggtccggcaaaatccacgatagtctcggatccaaaaagaaccgggagtaaagattgtttttagtcccggttataaaaattttgatctttagtcccggttggtaacaccaatcgggactaaagatcaagaggttgatagtaccaatcgggactaaaattaaaca

SEQ ID NO: 10485 - DNA, 1501 bp, Oryza sativa
gataggtagataaaggagagaagaaagatgattggatgagaacttaatttgaagacatcatccattgtatatatagtttctatgcataatgtatatataacatagcaaatatggaaactaattgatagtttctgggttggggatggcctaataccactaaccaagagacaattgccttcttgtgcctttctctatgctgtaaggaggtgtcacacatttctcatactagcaaaatgctcatactttgctatggatagaagaatcataatatgtcatagcaaaatattttttaatcaaatattttagtatcatttatttgcttatttgattatctattatttatttgtctgaactaaatgttagactattctacaatattagaaaaatattgaggcaatttgtaaaaactacaaaaacaacagtgagtggcatattcattggcaccagccactagagacttttaaacaagtattatacgattaaaaataaagtactactagcatagaacataacaccagtaaaccaaataactcgtggttaatcacattttagatattgcgcatcgtggttagttgcaccgtagacattatactacttaaaaaagaagaagaaaaaaccatgtagtgcccgattaatattctaaacgtaacaacaaattcacccaattttactcgacgccaatctatttgatgtttatgtcatatttttgaattacaaaaatgtctagcgtagacataagaggagcaatgtttaccttaccgtcgcaagaagggtgtaaaaccgagaaaaaccaaatactttttatcaaaaaagtttggctaaacttgtttgaattcgttcggtacactaggaaatgttattactatcgccacgtctctcccggctccctctattttggccttaagttggcacgcctcggtgcagcgcagcgtgtgggtgcaccaccgcacacggatccacctcctgtctcgtcgcacgcgcacgcgcacgccctataaaactgccacgccccaaaaacccctcctcctctcttccccaggagacctctcctctgtctctcccctcctttttccactttccaagacaacgcaccaacaaaagcgtcgcccctcttcctcctcctcctccacctccattgctgcgccctctccctctccctctcgcctccctaggccactcactccccaaaacaccaccaacctcctttcctctctctctcttcttgagttcttgaatcaatgcgttcttgagttcttgaatcaataccagtatcacttgtgctaatagtactagaggaggaggtgttgtttcttgcgatcttgggttgattgatatgggtgttctttgcttcggcgcttccaacatcctcctctgcgcggaggacagcagcagcgtgcttggcctgggcggctttggcggcggcggcggcgaggtggcggcggagctggggtgcggcggcggtggcggctttgatttctttggcttcggtggtggtgctgtg

SEQ ID NO: 10486 - DNA, 1501 bp, Oryza sativa
ttgtacgtaaccacatttggctccaaccccctcctcaccatcatgtccatcaccccgtgcgccttctttgccttccccactttacaaaggctatcgatcaacccagtgtacatcaccacatccggctctattcccttctcggacatttccacgaacaccttgcctacatcctcccaccgcccagacttgcaatacccttggagcaaagagctgtacaccaccacgttaggctcgatgccactttcgcacatctcgcccatcagctccacggccttgtccacttccgcggcgtcgcacagcccacggatgagggtgccgtaggtgaccacgtcggcgcggacgccggcggaccgcatggaccgcagcagcccgacggcctggtccgcgaggcggtcggcgcagagcgcgcgcatgaggacggtgtaggagacggcgttggggcggcacgccgggtggggctccagggacatggcgcggagcagcgcgcccgcgcggtcgtggtggccgcggcggcagagcgcggtgagcacggtgttgtaggagacggcgtcgcggacggacgggagcgcgtcgaggagcgaggtcgcctccccgagcgggagcaggcggaggtggcggttcaggcacgccgccgcctccgccctcccgcggcggtggagcaccgccaggtagggcgccgcttgcctcgccggccgcggcgccgcaggcgatccggacgcggaggccgtggcgagggcgcggacgagccggagccggagcctcgcgcgcctcgccatggcggctcgcgccgcggcgcaggcggcggaagagtcaccgagagagagagagagagagaccgatgcgtgcgtgagacgacgcgccgcgtgtgcgcgcgggccgaatcggcgaaaacgcgaggaatcctctcgtctcgacgcctcgcgggccgagccgtgcgcgcgtgattgggccgttttacgcgggccgcggttgataactatctcgcggcgtcacgtgaagacgctgtgaacatatataattacagtttaatcgtagtaacatatgtaactacaatgtaacttgcacataattttaaaccgttagatttgtttcaagatttgtgcaaatggaggaggaaaaaagtcactacgcgcacacatatgagaggattcgtttccacgacctccgttttaccgaaatagaattttacgaagagatttttgaaacttaaacataagtgagttacaatgtaattacatcacaattatactataattacatctgtcaaatttttaggtgaaaatttatcgacaaatggccccgtttggcacagctccagctcccaactccaacttacctggagctggagttgtgtcaaacagtccagatactccgtttttgggagcggagttgggagagctgctccacaaaattgtactacgggggtggagctgggtttttgctgctccacagctccactccaccccaaaagacccactaacctttaattctttagtgtatt

SEQ ID NO: 10487 - DNA, 1130 bp, Oryza sativa
gttccgtgtggtcccggtagatttatgctgttcttgagcgttgaatcggtagggggatggatacacgggggcgctagggttcaagatgcttgtgtttgaggtatagagatctcgagtcagggtcggttgtttttgcgtctccttagacgagatcttgtgcgatccagttatggggaattctggtttgtgagattgtgagaacgcactgcaagaggtgattctgacttttatctcctttttgctagatgtgtatgtgttggtgtatgcttactactagtatcttggttttagtatttagtcatgagttgacatgatctccactccccaaatcccagatccagttagtcagttacgcgctggtgtaccttttgagttttgaggttgaattatactgattgaattagcttgtatagctgaatttggcaccaaaaagggtagtatcatagattttttttcgctgttaagtagtatcacaaagatttgaaaagctgaaactctctgttttttttaacacatagaatgagcaagagatttcttgtagtttacttgcactattccatcagatgctgtgtgaagtcatgagatgtttttacggacagtattgttccgtcaattttagtggcagacctgctcatgctgtcttgcataatattttgatttttctcactatcagtagtccaatggtatgctggcgaagcttgattggcactgtcttgactcttgagtaacccgccgttaggttgttcgttgaagtattttaactgatttaactgtggtctgtgttaatcaatcactgaacaaccatagcacatcaaagaaattgttgcaattaaacctgttttggtgtttcttcctgctcttattggaggaagaattagtgactgggatgtgtttgtgaacttataaacaagggattagtgcatctggtatcaataactttatctgcagaattactttaatgctttgtactgttaaatgttcttctttgaaactacttatatataatttcttggtatgccttcccaagtcacaaataacaaccgagtcctttttctgctgacatttttttttaatttttttaattatgtcttcagacgtgactgacatatgctttctacctttgttgcaga

SEQ ID NO: 10488 - DNA, 1501 bp, Oryza sativa
agatacccccgctgaggctgatgatccatctccttctccaccaacaacgccacgaactcatcggagtcgatggggaacacagcaccaccaccgaagccaaagaaatcaaagccgccaccgccgccgcaccccagctccgccgccacctcgccgccgccgccgccaaagccgcccaggccaagcacgctgctgctgtcctccgcgcagaggaggatgttggaagcgccgaagcaaagaacacccatatcaatcaacccaagatcgcaagaaacaacacctcctcctctagtactattagcacaagtgatactggtattgattcaagaactcaagaacgcattgattcaagaactcaagaagagagagagaggaaaggaggttggtggtgttttggggagtgagtggcctagggaggcgagagggagagggagagggcgcagcaatggaggtggaggaggaggaggaagaggggcgacgcttttgttggtgcgttgtcttggaaagtggaaaaaggaggggagagacagaggagaggtctcctggggaagagaggaggaggggtttttggggcgtggcagttttatagggcgtgcgcgtgcgcgtgcgacgagacaggaggtggatccgtgtgcggtggtgcacccacacgctgcgctgcaccgaggcgtgccaacttaaggccaaaatagagggagccgggagagacgtggcgatagtaataacatttcctagtgtaccgaacgaattcaaacaagtttagccaaacttttttgataaaaagtatttggtttttctcggttttacacccttcttgcgacggtaaggtaaacattgctcctcttatgtctacgctagacatttttgtaattcaaaaatatgacataaacatcaaatagattggcgtcgagtaaaattgggtgaatttgttgttacgtttagaatattaatcgggcactacatggttttttcttcttcttttttaagtagtataatgtctacggtgcaactaaccacgatgcgcaatatctaaaatgtgattaaccacgagttatttggtttactggtgttatgttctatgctagtagtactttatttttaatcgtataatacttgtttaaaagtctctagtggctggtgccaatgaatatgccactcactgttgtttttgtagtttttacaaattgcctcaatatttttctaatattgtagaatagtctaacatttagttcagacaaataaataatagataatcaaataagcaaataaatgatactaaaatatttgattaaaaaatattttgctatgacatattatgattcttctatccatagcaaagtatgagcattttgctagtatgagaaatgtgtgacacctccttacagcatagagaaaggcacaagaaggcaattgtctcttggttagtggtattaggccatccccaacccagaaactatcaattagtttccatatttgctatgttatatatacattatgcatagaa

SEQ ID NO: 10489 - DNA, 1501 bp, Oryza sativa
catccgtactgaattcaccacacttgaagtcgatcttgaacacactgagaattagcatgcgcgtcacgtaggttaattgaatgggaggcaacatttagtgctcgtgacgggcgtaacgcggcgcagcaaccggtcgaggtagagctgcatggtcgtctcgtccgtcagattgcgaacgattttagagcggagtagtacttggcgtggtagacagatcggtcgccgtgtgatccgtgtgaccctgtcgccccgtgcccaacatgcgctggtcccgtcaatctcggagagcgcaacccaactaaccaaaccaacaggatcattacggccccatttggtagggctctaaactccaactcactcctctcaggggactagctatgtgagttgaactatgaaagtttggtagttaactctgactgaaaaaagcaaaaaattgaaaaaagtgtaaaaaaaggaacctaccgccggagccaatcccaggcgccgcccgccgcgtggcgcatcgtcgccacccgcgctggccggccgcctcccgcgtgtcgtcgccgcgtgccccgcccgccgtcgtccggacgcctccgcacgtcgtcgcagcgcgcgccgcccactgcccgacggccgctgcccgctagctcgctgcccaccgcccacgtgtcgtcccgtcgccctgctaccgtcgtgtgcctgccgccgccgccgcatgctagctcgccgcccgccgcccgcgcgtcgtcccgccgccgccgacgccgcgggatagcactgaccggagcgccgccgccgcgccctccaccgcagcaaccgacgccatcgcccccgatccctcttcctcctccgccgccatggccaacaccgcctgccgtcgccgacgccgcccaccaccgcccgccgcagctattgggactcgggagaaagatgggggaggagaggaggtgagtaggggtagttcaatggtatttttatgtaaatacactaaagaattaaaggttagtgggtcttttggggtggagtggagctgtggagcagcaaaaacccagctccacccccgtagtacaattttgtggagcagctctcccaactccgctcccaaaaacggagtatctggactgtttgacacaactccagctccaggtaagttggagttgggagctggagctgtgccaaacggggccatttgtcgataaattttcacctaaaaatttgacagatgtaattatagtataattgtgatgtaattacattgtaactcacttatgtttaagtttcaaaaatctcttcgtaaaattctatttcggtaaaacggaggtcgtggaaacgaatcctctcatatgtgtgcgcgtagtgacttttttcctcctccatttgcacaaatcttgaaacaaatctaacggtttaaaattatgtgcaagttacattgtagttacatatgttactacgattaaactgtaattatatatgttcacagcgtcttcacgtgacgccgcgagatagttatcaaccg

SEQ ID NO: 10490 - DNA, 1501 bp, Oryza sativa
aggaacggtagcacaatggatggtccaagcgatcgatcagactgtatgggggcagaaccagtcaaccagatacacaatatcaagtagcaattagtcaaatcaataaaatcaacagcaacaattttaaggaaatttcctccaaaatattaggataaaccctttccgtgcacaagcaccctaaactaaaaatccaaaaatttccacaaatcaagaatctgatcagaacccgcctgcaagaactgggtttatgcaagcaaacaagatactcacacagcaacagagataaagggggggagagggtaaaccaacgcgatctctgcctcaccttctgccccctctcgatgaacttgacggcaaacagctccttggtccgcacatcccggacaagcttggccacgccgaagttccccgaccctatgtcccttgatcacctcgtacctctccatccccacctcccacgacaactcccccgcacgcacaagcgattcttgagaccgcccaaaccgctcggcctcagcacaccgccctgaaagcccaaagacaagggcagagcaagaagcagagcagctgctgctaatccagcagagcaaagaagccaagaattggagagaccagcgagtgggctagacgagagaagaggaggaaggcgtggagtggtgcggtgtggaaggggaggaggaggggagaggagaggggggcttttgatgatgggggcggaggcgaaggaggtggagtagtcgagggaagtggggaggagggagagagagagagagacgtaggcgtaccaaccgtcgtggtggactggtgggctcgctctcactctgaagtggtcgcctcgctggtaaatttggccataaaaaccttacttagaaaaataaatttagatgcattgcatattcagacttataatattgattttttaaagatagagagagtaagaatgcacttacatgctattactgctccccatatactactccgtctaaaaaaagataaatcagaacacgtatatattaagatttatagtgagaattggttttcttttttttaatatagggggtagatatctctaatcatgaagtaatcacttagtgctacttgtacttacaccaatgaaaattatcatcaatccaaacagctataccagatcctactcctaccaagttaccaaaacaattgattacttatgtgctagtagtcaactataatcggccccgacaaaattcaaatacaattctgttactctatttaagtgtactgaacaagtattgctatcatgacagtggttacgtttggctagactagctaccacaacggttgtggctacaactgttttgactggtttgaactgtcgctgcggctaaggcagcaagtgccttcgaatagggccagcatatgaatcaccaatattataagctaggtacgtcaatactctcttaatcccaaaaaagaaaagtttaacctagaataagatttttaagttttttttatagagggagta

SEQ ID NO: 10491 - DNA, 1066 bp, Oryza sativa
ctctctttggtctcggttggtgttaccaaccgggactaaagatcccctctctttagtcccggttggtaacagatcgatctttagtcccgggtatttgaaccgggactaaagataacgatctttagttccagattagtagtcccggtttgaaaaccgggactacagggggttacgaaccgggactaaaaagcaattctccaccggtggccggacgctctcacggcaaggcaacacgtacgtacgcacgacgccacggcgtcgagagggcggggggggggggggggggaactcgtggattctccaccggtgacgccgacctttgctgctcgcgcaaacgcacgatggatcgatcgaaacacgactggttcaacgagaccatcacgtcaccgatcactaccagcagcaacggccggtttgccctttgcagacggagaaatttaaagaccatgtggcgattgagagcgagacaaatctacgccagtttctcgcctcctcaccccgtccctgtctctgcgtataatatcgtactagataattaaagagacaattttacgccatttttttttctttagtgtcctctctctatctatgcctttgtctctgcgtagataattaaagagggaaatgagaaaaatagagaaaggacgtgcacacagaggaggccttttgtttgatgctacctgaacgtgatgagaacgtccgtgggcctctggcttaacgtatgatagccggtgcagcaagctgaaacgaagggctggtttggtttgaggtctaaattagggttattaacatttgacaattttaatagtgtttagtgtctatttggtttaaagccaaattttgacatatcaaaaaaacagaccattttaatagtgaacttaggctattttggcttcaatccaaacacaattttgttttaccaaaattagtcatgataaacttaccagaatttagcattgataaaatttagtaatgcctatttagggcccctttgaatcgcagggtagaaaaaacggaggaataggaaaaacacagtattctgacaggaattgaagtgtaaaacaga

SEQ ID NO: 10492 - DNA, 1501 bp, Oryza sativa
tggtgttgggtgattaggtcaaatgcttcggcagttctgaaatactaaggaattatagacaagacattttgcaaaagaaaaagcattaaaaataactaaagaaatggatcacgaggaattttagaaatcgccaatatatcacggttttttaccaacttgtaaaatgtattgggatctagtagtatgagagacataagaaacaaggcaaaactagaaccaagccacttggtaatgctaatgttcgtctctatctctctactccctccgtaaaaaaaaaactcaatcctagatttgaacacgtgtgtccaggttcagatctagaattaggtattttttgacagagggagtagaatttaacttgaaatgaaagttatatgattttttgaagagacaaatgtgtctattaatataacatactccctctataaaaaaaacttaaaaatcttattctaggttaaacttttcttttttgggattaagagagtattgacgtacctagcttataatattggtgattcatatgctggccctattcgaaggcacttgctgccttagccgcagcgacagttcaaaccagtcaaaacagttgtagccacaaccgttgtggtagctagtctagccaaacgtaaccactgtcatgatagcaatacttgttcagtacacttaaatagagtaacagaattgtatttgaattttgtcggggccgattatagttgactactagcacataagtaatcaattgttttggtaacttggtaggagtaggatctggtatagctgtttggattgatgataattttcattggtgtaagtacaagtagcactaagtgattacttcatgattagagatatctaccccctatattaaaaaaaagaaaaccaattctcactataaatcttaatatatacgtgttctgatttatctttttttagacggagtagtatatggggagcagtaatagcatgtaagtgcattcttactctctctatctttaaaaaatcaatattataagtctgaatatgcaatgcatctaaatttatttttctaagtaaggtttttatggccaaatttaccagcgaggcgaccacttcagagtgagagcgagcccaccagtccaccacgacggttggtacgcctacgtctctctctctctctccctcctccccacttccctcgactactccacctccttcgcctccgcccccatcatcaaaagcccccctctcctctcccctcctcctccccttccacaccgcaccactccacgccttcctcctcttctctcgtctagcccactcgctggtctctccaattcttggcttctttgctctgctggattagcagcagctgctctgcttcttgctctgcccttgtctttgggctttcagggcggtgtgctgaggccgagcggtttgggcggtctcaagaatcgcttgtgcgtgcgggggagttgtcgtgggaggtggggatggagaggtacgaggtgatcaagggacatag

SEQ ID NO: 10493 - DNA, 1501 bp, Oryza sativa
cacgtatagctatgagacttacgcgctagccaactgcgaaaccaccccgttgtgctgtgtgttacatccaatcttcaaatctggtacaaacattgatctctccaccgccattactttccccatctcagaatatgatactattgattttacggcttatcttactaacaaaggtcgagtttagttccgcagccaattatttttttaagtatatagacacacatttaatgtattaaacataaactaataataaaataaattatagatttcgcatgtaaactgcgggacgaatttattaagcctaattaatctatcattagcaaatatttaatgtagcactacattaggctaaaaatattcgtctcgcaatgtacatacaaactgtgcaattgtttttttattcatatttaatgttttatatatgtgtttaaatatttaacgtgactgatttttttggaagtttaaagggaactcaaacacagccaaacaccacatatgttgcccatgagtacaagtacaagtcgagcctcaccaaattaggcaactactgcccagacgcagcgcatcccgtgaaaccaaaacggtaaatgtcccatttatttttctgatggatcgatccgtgggagcgcaccgcctcaccgtaaaaaggcgaattttttttatttataattttttttattaaaagttttacaaaaataattttccattttgaaaattgacggaaggagtcgcctaccgccctctggaaaaatcgccctctcagagggcggcgaaaatgacgtggcagacagccgttcgctctcgggcgacggccgtcaacgaaatttgcaggcggcccccttgccgccctccgctagggcgattttatactgtgcggggggccgcctgcaaattggcggcgaggggggggcatggaattttgcaggcggcccccttgccgccctccgctagggcgattttgtactgtggggggggccgcttgcaaatgggcggcgagggggcatggaattttgcaggcggcccccttgccgccctgggggagggcgatttttgcctctccccctataaagcccagtacctcctctgtgaaatttcattatattcactaaaaatccaaaaaaacaaaagagagagaggggagggcagcagaaggggagcggcgaagccctgctggttcgctcaattcatcacaggtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 10494 - DNA, 1501 bp, Oryza sativa
tatgacgaaactctgtccaagtaacctctgccccagctggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcttcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcaccgttggcacgtgctccattgttcggctcttcgctgccactggcgttgttcgagtcgcgtgaaccattccttatctccatctgaaggggataggtagaaatatgagaaaaggaggaaaaacaggggggctcagaaactaatcttgcttatgaatttaagtgcaattatcttaatcttgattaaaacactgaaaaagaggcacgcactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggaccgacatctaaagtagacaagggataggaaccaattcatgctcaaatccaaattaaaccaagcaaaagaagactcaaataaataaccgagcatgatgatttttatgcatagaacatttttcatgaactcaaataaagacactaatgcaactaaacaataaattaatgcatagactagttgcatagaaaatgatgcgcataacattgcccccatcgaatatagacacgacctaatgcataacccccaataaattcccgactgactgtcgaataaactccaactaaaatttttctaaagccctagactgagctaataatttttttttaaaaaaaaaatccgatccgaatgaacgaccaagatttttcccgcaaaccaaagaggcaaaactccaaattttcccgaaacaattccaggtgcaaaaaggcatatgcagatgaaaaaaggggttcagagggctcttagggtttccagttggcttgtcttacggtcaaagtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagataaaccgggaagcttgacttaagc

SEQ ID NO: 10495 - DNA, 1501 bp, Oryza sativa
ccactgaccggtggggcccgcttgccggcgccgcccctcccctttgatgacgtcagcaaccctcttttcctttggaaaaataaataataattgcgtcataattcgttaataattctagaaattcatttaaatggctcaaaacttctaaaattcatatctaattcattcgaactccgaattgaaccgttcaacttgcaaaattcatctaaaattgagctctacatgtttgtttagtttttatgtactgtttccttggtttttattagagttgttcctcgttttgtgtgccagcatgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacatagctagaactatatgcttagccatgcttaattaccactagctcagttgatggggtaattacagttttagaccttttagtatcagaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttatcacaagccagcgtgggcaacggctgggcttgtagtgtagctttcctctagccgacgcatccaggcaagggtgggcgtgatggagtttcgatgggccctgcgatggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcgtcgcacggaaacgtgtcgtggggctgtgtcttgtgggtacagttgtacacctctgatcagagtaaaactattcgaatagccgtgcccgcggttatgggcagtcgaccagattcaccgtgattagtcccatcttaacaaatcgactcaatacacaaatcgactcaatacactgtagttcaggtgggttggttgggcctgttcaacgtggtgtagtgttgatcagtggagattcaatattactttaattactcaacagttttactgttttgctcaataaaatgttttacaactgcctttatgcaaatagccacaaacccctccttgtatccccttgcacgtctgcatcgttggtgtggcttactgagtacggtggttgtactcagtcttgctattattcccccttttcagaagtgtagtgcttctgagctgaa

SEQ ID NO: 10496 - DNA, 1501 bp, Oryza sativa
ccaaggaattttttttctaaaaacaatacaaaccaaagaaactataattactagagaacatcagcatggctttattacagtaagttcatcaaggaacaagtaatgcaagcatattgttcaagacgttgacttgattagagtcctaaaatggtatcctcaagacagaatatgacatttccagttgtatggtttacaggactactgttggagtatattttaaaaaatatatgtacaccaacccatacattgactatttatacatccaaactattgattctggcacattttcagtaaataacagtttttctaaacggtaaaagatgttttctcaaaataactaaacggaattgtgttctcaaagaaattaaattgataaaaaaataaactaactacagaagtacaaaaatattaaataaatggatatttgtccattatgaatgaaatgcaagcttaaaagcaagaggtaaaaaaaagaatagaaggctgggaagctgacattcagatgtaagtaactggagggcccaacttggggacatgtagattggtactggacttctgacaggctgtaatgacaagataaaccctgggaaccccttatgtcgaacactgaacaaggtgatttttctgatgacaagatagtagcattaattactttgatttctgaagaactgtcatcattgctccttgccaaagaagtattatctactgtgagctcgacagattgtgcttgatcattcatttttccagccaggttctccgatggaccattagacatattgaaattactgccatttaatttactccattctgctgaagactcatccacagaacagacctgtttctttttgctgcggcgctgccaactgtataacctttttcttttcctggtgttgtgggtatagcagttgcaacactctcctgatctaccatcagaaggaaattttggacaattacatccttcacttggatctttggattctgctcttcttatggaaccacatgtttcacagctttgttgagtaacaattttgcaagtgctgctaaacgaagaattaactccagaatttgaactgtcatgacaaatagataagttttccgccatgtttgcacttttccacaggtagcactgatgacacaaagacatgtagtgacttgtcagcttatttaatactccctccgttcccaaaatataagcacttctagaaaaaaaattcactgagattaagaagacaggtgaaacacgagattgttgtgattggttgagatggagaaggtaggtggagaaattgaatgaggaggttgtaattggttgcgacgacaagatttgagcactagaagtagctatatattgtgatggagtaattcatctgaacactctacatgtgcttgtattattaaagaatataattatcatgtggctcatcaaataatataactgatgacattttataggactagaatcagatacaaatcaacagccaaaattaatgaagcttgcaaa

SEQ ID NO: 10497 - DNA, 1501 bp, Oryza sativa
agccgctcctagaaaagtgaagctaaacggtgcttttgttggaacagtaaaacggtcacacagtacaaacagtgacatgtactcctgttgttttatatagccatggaacgagagatcctttgtgattgggaaaatacatactggcagtatactgcatacttcatatgtgtacttaacaactgtcgttatattcacaaatgaacatctgagattcacctatgttttttactccagatttaacagtgagtagtttgtttactcatagatttatatgtaactaatccttttactcagaagacatggatatatatgagacgtctgagacgtctatttatatattcgatgaatttttaggtttgctgtacatagtttttctctattgagtatgtagtatgggtgaaaacagaacgaacatttcctgaccgtccgctcgacggaaagctcgtgggaaggatacgagagagaaaatgagatatctggtaatattctaattcgagtctaaatccgaatccaaacctgcaaacaaatatgggttaggataagcgaagagttgtatctacccgtatatccaatttgatcaaacatgtatgaaaatttattatgaatatgatgaaagattggttcatatttttttacgagctcaccaaaaaatattacttaattttttcttgactatctttttaagactaattgcctcactagatttaaaatctatgaattagaaatataaaattgataggatacgggataagtgatttattatctgataccatctgtgtcggttacagtttaaatggaaaatatggttatgatataggaattttgtgattcgaccataatttcacccatactcttaagtgcaatactactcctttgtcccataaaaacaaatctaatataggatgtggaacattccctatccagattcatagtactagaatgtgtcgtatctcgtaccagtagtctataaacatctagatagtagaatgtttagaataagtactatcaacctaaacatatctcatgtgacttctattgcatgtgtacggttctaatagattgacgtgcaatctttttgcgtcttcgcaggaaaaaaaatgtgtactgaggagttgttgtgtcattagcatcaaaaaatgtgtactgaggagttgttgtgtcattagcatcatcagctcaagtcagtagtactcccttccgtccaaaaaaggcaaaccctgggttttcgtatccaacgtttgatcatctgtcttatttagaaaaattatgaaaaaaaattaaaaagataagtcacgcataaagtattaatcatgttttatcatctaacaacaataaaaatactaattataaaaaaattcatataagacggacagttaaactttagacacggaaacttagggacatttcacacagatgcagaggatccaatgccccagtcaatttccccacgtgccatctcgctgcatccgccgccgtgcttgcgcttgcgattgcagagttg

SEQ ID NO: 10498 - DNA, 1501 bp, Oryza sativa
tcatcccatatggacgcgcaggatgatacagtgccgcacctccgcccatgcgcacggttgagaaaggtgtgtgcggtgtgccaccactgctgcttggtcgaccggtatcgttctagctgattgatgagatcaaggcggcgatggaggagtgctatcctaacacgtccacttcaaggctatctctagttacattgacaacatcttctcctgcaccttggatgcccagcgcgaccttctaaatcccacctttggctcatctacgacttccgccgcaagaaattcaccattgaggagctcgtcatccttttctggcatgcaccattgatgtcggccaacaatccccctccacactcacctcactggctcactgcaccactagaacaaatataattaacctcctcgccgataacttgcacaactaggagtggccccgttgtttccctcattcttgctaaagctaaggggaggtggagttcttgtacaacaattactaccacaacaatctagcgagggtcgtcaccttcaactccgactattgttgatgggaaaggaggcgcggccatgtgagagagtactccaagaatagcacattataggatgtacttataagtacccatcctattaccgcacgagtgccacgtctgatatatgcctgctaaccaggattagtatctatgagtatcaggctggtaactacatattcgaacatagtataataccgttttgcgaaaaaaagggcactccctccattgtaaaatatagcatcttaggattaaattagatattttctcatgtccaaattcttaatactagaaaatttccaatcttatcttagtttgctatatatttttggaacgaaggaaaagtaactagactattgctttagatatcttttaccacgtaacagagaacctatgatataaggcataatataattagaccaattgaagaagttccaggatttaattcatatcttccaaaaaccttttaatgtttctctcttcatgcttaaaagcagaagagactcatttaatcacccccttaaatttgcactcccttcaattgtctccacaagaaacttccagattcacatttaatgacactccaaaatacaccacatataaatcaattaaatcaatacatgcaactttgtacttacagtccatatcacacattcacactggatacaacaacagtagtagtatctccactctccactggccactgtgtcggccacctgtcacccaaaccaagcaaaagccaggcagactccgcctcaaacccagcagcgccgcgcgcgcgcgcgcgcgacgcgcccgcgctcgtgtcgcgtcgcgtcgcgcccacaaaacccagcagcggctagccgcaaccgcgcgcgccctcctcgcccacctatatataccccctcctctcccctctccctcctcaccgccgcagcagagagcgagcgagagaggcaaacacacgcagagctcgagaatgaggggaggagtgaagc

SEQ ID NO: 10499 - DNA, 1501 bp, Oryza sativa
tcacgccacaaattcctgtcaccttcgaccgacagccccatcatcattatctccatgatgaggcggtaaaaaggatgtaaaaatggcaacggtttcagattggagatctctgtctgtctatctgttaatatgtgtttttacacatcattttcgcgtggagaaaatggcttctgctgtgaaaagttgtttgttgtctagcctcttgatgggctgcatcaaagcccaggaatcagttggcccagctactgtcgttgggcccacgatccagggagatggtggcggcccggcctactgagttggttcttggtgggccggcccagcacgtgagacgttttctgacaagtaggcccggcgcgcaaaccctagatccgtggccgcagacttacacgacgacgcgccttatctcccccggtcgccgtgcccgcccgtcgccgtcgccgtcgccgtcgccgtcgacgccgcagcagccgggagggaggcctcgtcgtagctcctctcctctcccgcctcagggtcggggagcccccgcccccccgccgcgggttccgttgacgtggagccctagcgcgcgccaccgccgggcgtcgccctcccgtagcgacaccgccgccggcgtcgccgccggtggaccgctgatccatcgtaggtaacccccgaagtgcgtctgctacggttcgtgaatttatcgattcgattcgtccggcaaaacttgattgttcgacacagcactataaagagaggcggttatattacttcttagctttgtaaaatttcgaaagattagtgtattattggcctcctccgatgaataaattttagtgcttccgctccgcggctgcttgcgggtttgggattctggcaggagtggtactactacttgttttactctgaattcagctaatttctgccatcttagttatgcaattggccattatggattcttggtaaatcttgtttacatgatttggaaaagtagcgtgaatgcgtagttattattatgcctgaatactgggctgggcaaggtacacaattcctgtgttgtcgaatttgaaattagaagggcagctagccttaaaaccttctttaaagccctgaattcctgggtccaggtcacccaccaattcgatcataattggacacgtgggaccagctaaaccaatgtttaagttctaccgttcatcattacttgaccaggcagagtttgtgcttcacaaccacactgttttacacccctgtagtttcacatggttgcccttgtttgaatttacaaaagagaaactacaaggtctgcaggtctgattatgaaatccttgaggtaaattgttctgttggaaaatccatataatcttcaggattctcgaatcttgcttattaatcgctaagcaaatagttgctttcctactaaggctaactcatgtgactcatttccctgaaagtcacaactttttacataagcctaattgttggattgatcgcttgtattttaggacataagcgctca

SEQ ID NO: 10500 - DNA, 844 bp, Oryza sativa
catttatagcggattgaacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccggaaaagctgacgagcggggcaggagacgtgcgctctgcttgtcaaagatcacttccggctgtagactagccctcattgtaaaaagcatgtttcctttcttaggcagctagaggcccatgtggtgaccccagaccagataaaaaggaggcctaggcctaagggagaaggggggaggacggggggggggggctaaagcggaaactctgtctggctctccggcactctgtattccttcacacacagatccaccagaacacaggagtagggtgttacgcttctcagcggcccgaacctgtctacgtcgcccgtgtcttgtgcgcttcctctctcgcggacgttcctcagatcgagggcgaagaacctcacttagcgcccctggccgaaccggcaaaggggggcctgtgcggtctccctgtgaggagccccacgctccgtcatctggcgcgccaggtagggggcgcgtgtctttctgagccctcgtcctcctttcgtgtgcgccaagcttctcccgctcagcccaa

SEQ ID NO: 10501 - DNA, 1501 bp, Oryza sativa
cttcgccctcgatctgaggaacgtccgcgagagaggaagcgcacaagacacgggcgacgtagacaggttcgggccgctgagaagcgtaacaccctactcctgtgttctggtggatctgtgtgtgaaggaatacagagtgccggagagccagacagagtttccgctctagcccccccccgtcctccccccttctcccttaggcctgggcctcctttttatctggtcaggggtcaccacatgggcctctagctgcctaagaaaggaaacatgctttttacaatgagggctagtctacagccggaagtgatctttgacaagcagagcgcacgtctcctgccccgctcgtcagcttttccggaggacgcccatttcaaacttcatttaatggccggcgacttccttgccatacttgcgctgaaccctggaatgaatctgaccgggactgacataccaactccaggagttagcacgccggctccggctagggacgagagccaggaagctctcatcattccgacgggacggggcgaggcgtgtgacaggcccgcctgtgccacctaacccgcgatctgaccggtctgtgaccggtcacacaccgcgactggtcacggaccggataaacgtgcgctgcgccgcattaaatgcggcgtgacgcgctcattcaatccgctataaatgcggttaggtgagcgccgctgtgctcacctaacccacacacgtggcgccaataccacggggagtcggggcgccccagccctcggggccgaaacgggagcggcccgacccctcggggagacagagtgtggggtggccacgtcacccttgggcccgacccccccaagggggtcaggccacgtgggtgaccgcggctgcccaagcctctagtcatgatacccccggtcccatgtcaccgacagtagcccccggcgttacgccagggcgatcgcccccctcgagggaagcgctcgggcgtgacgccactccttaggcctggtgacaggtggggccggtctctacaggcgggcagaaacccagcggtcgcaaatcgcgtgcatcggcaagggaaaaccgaccgacaataatgagcggtctcttcaagaccgctacattactcgagcagcgcgcgaatcgggacgagccggttcgtttcgcctggagacatgatgatggcgctcttctcggttggcaaacgtagttaatgcgcgcacgatctgtcccatctcaaccgccacggccgcacatctgccgcgtgcgccgcaaacgggcgagtgggattagtggaggcgtgggcgcgagaaacgagggggcgagatagtgggcgcgggaagcgaggagccgggcatagcgttggcaagggaataaagacgccgaggaagggattcgtttccttcctctcgccactcttccccttgccttcgccacctgtgctctaactcttcgtttcctgtgccctacccttgccgcactcgctcgctctcaagctcctcctccgccggcgtca

SEQ ID NO: 10502 - DNA, 691 bp, Oryza sativa
aggtttatatagggttgggaggggaagagagcggccggacgagggggaaacgggcgcggaagatccggccgccattgatggcgccggcgaggttaggggaggggtttccaaacgaatccgagggagagagagagggaaaaatggggggaaagagggagggaatcacggggaatatttcccccctcttgattgcacgcggggcggacgggggcggcgggattcgcggcggcggcggcggcgctagggcgcgggcggggcggcgggagcgacgggaggaaggggatgacgggtgggccccacctgtcagcgagggaggcgggcgggcccgcccgtcagcggcacgccacgggcaggaggccgaatgggccgcggggagaggagagggagggggagggagctggccggaccggcccaagagggagagagggagggaaagggaactttttagggtttttctttttataaaacctttttaactttgtttatttcttcttaattattatttgtgctctgaaaattccactaaaatttatttacgccttttaggcttttaggaaatataaaaaatcctccaagccttatttgacttttaactttgcacattttaattgttggaggctttcacacggattttaattattctaggcataatttcgaggatgtattttagagtcgttttgggacgcgacat

SEQ ID NO: 10503 - DNA, 539 bp, Oryza sativa
acccctcggggagacagagggaggggtggccacgtcaccctcgggcccgacccccccgagggggtcaggccatgtgggtgaccgcggctgcccaagcctctagtcacgatacccccggtcccatgtcaccgacaatgtggacccctttttttgctgatttggatgccacgtcaatgaaaaccacccatatatactgccatgggacctcctttgaacggtttgagtgagtttaggggtacacatttctggttttgttgttaagggacactggtggagaaagcgtttgtagtcccggttcgtaacccccctttaatcccggttttcaaaccgggactaccaatccaggactaaagatcgagctgaccttttttttttgcatggccctgttgctgcatggtttatatatatatatatatatatatatatatatatatatatatatatataaaaaccatgcatatatatgtttcaatacatatacatgcataatatatatgtatttatacatatatatatatatatgttatgcaaatgcatat

SEQ ID NO: 10504 - DNA, 1501 bp, Oryza sativa
ccgagcgaggccggcgacgagcgggtgctacggagctcgggcggcgacggcggcgagcacacggcgagcgacggcaacggtcggggcggcgccggctagctacggggaggctactcgtgctaccaccgaaaactaaggggggggagatggagcgaggaggaagaacggagagaggcactaccgtgcgggtcggggcgctgtgacgagaggccgacggcgcgggagtaatctctccggcctcgggccggggaagaggaaggagagggcgcggccggagtcctcttccgcgtccttgctcgtgccggctcctccgacacatgcaacgacgatcggcgacggcgaaacagagggcggcaatggcgcggaggcgaaaatgagggagtttggagggggagggcttgggcttaaatggacggcaatgtcggtttgggagaggggaaccgacattggacggttaaggcgcgagctggcgctcggcgcttgtagccaaagcggcggcaggaggatgacgccggcgaggaggaaaaaggggaaaaggagggggagaaaggggcttgcccctttgccgattcgggaaaaagagggggaggggaacgggagcatcgcggcagagggaggaggggcgcggctccgtcccttggcggcttgcgcgcggaggggcgggggccgggcgatgacgacggcgatgacggcggggcgatttggagcggagcggcgacactggcgacaggcgcgtgcagaggctgacggcggcggcgaccgggcggtcggccaccacggcacgcgcgcgcgggaagcaacgggcggcgtccgcgcgggcgcgcacacgctggctcgcgaggacgagcggctgcgcggctgcaggcgcggcagagcgaggggaaagggagggggcgctcggcgcggcggcttacgcgcacgcgcgcgcggcgtgcgggcgaggctgagcgggggaggagagatgggagagcgcgcgagagagagagagagagagagagagagagagagcgcccggggagagagggggccggggaagaggggaagatgggtcgagcgagattcggcccatcgacctcgggggaggcaaaatagacttttgcggaggaatttgattggaaggatttggattcggaattgaactcgatgatagatcggggattgagatcttgagatggcacggacactagacaacaagcaaagaaacaaatttcgcaattagggtttttaagagatgattttcccgctaggcgccacgacggaacgggcgctacaatacacctctccgtgggtggttgatcttgacggtggagatcaaccttattcctgcaagcaaatcgaagaaacaagtaagaacaagataaaagcaatttgaattacagataggaattgaatacaaatgataagttggggctccgtaacgagtaaaccggcaatctaaccgatcacgggattacacggcaaagtagcaaagctaaactttaatctaaacaaaacccaagaa

SEQ ID NO: 10505 - DNA, 988 bp, Oryza sativa
tattatggagttcttgatagctatttagattgaaggatctgatttctttctctctctgatatgctgcatttgggatcaaatgtatgcaagcaaagagatggggtaaaaggggacaagtttcagtgcgtgacaggggaggggctacagaactccaatccaccgtaggtttgtttacaagattagtcatagcgagggatgcacataaataagatctgtactggtatactccatcccttctaaacaaaaagagactaacctaagagagtccgacatagacaacccgcttctctctcttatgttactgtcaggggagtccgtctttcccgaaactaaggccctatttagttgggaaaagtttttgggtttggttatcacattggatatatggacacacatctgaagtattaaacgtagtataatgacaaaataaattacagattccgtcagaaaaactgcgggatgaatttattaagcctaattaatccgtcatcagcaaatgtttattgtagcaccacttatcaaatcatggcgcaattaggcttaaaagattcgtctcgcaatttacatgtaatatgtgtaattgattttttttttgcctacatttaatgttttatacatatgtccaaacattcaatgtaacagcgcgattttttttccagaaactaaacagggcctagacccctgcatgggccacccatgtcatactcatagaccatctatctgcgagacagcgagaggtagtgtagcaaaacggctccgtgcaccttgtcccgaggtcccacgagtgcaccgggtccagtgcaccaaaaccaaaccaaaaccccccacccccacccactccgctcctcgtcctcctcctcctgcaagcttcctccctcctcgcggccatggcggcgccgttcgtctactgccgccccaccgacgacggcaccagttcgtccagcctccccccacctctccgcatctcctcctagctcgatcggcttgc

SEQ ID NO: 10506 - DNA, 1501 bp, Oryza sativa
atatgtgtgcctagattcattaacatctatatgaatatgggcaatgttagaaagtcttataacctaaaacggaggtagtagtacagtatcaattttgagaaactaggctatcaggcacagagaaagaaatcttcaagagtagaggggaactgtggacgtccaccggagtgattcgaatccatctccatagggggggggttgaacttgtttatatcttttgttttaatttctttttcaaaattttcactgagttttgagagaatctaatagtaatctatatctatataatatatatagttgatccccactaagtatagttattagtatttttctcacttgtggtgcttctacatcaccttaattctttttagccattagattgaaatccaacattccagattatctcaaagccatttcactattcaccattggattatcttggacagctcagatttacttttgagtgtgatacgttttgtagcttgcatttagttattccttccatcatgcactcaatgcattcgatgccacaattttgctagccgggcgtttcatcaacatgcatgcatgaagtaggattgaacaaccctccttaatgccatccacaaatcaactaaggcgattgaagagcctggcctccttaatgacaacgattgagctttagttgacaaagtacatatccgttctattgttatgagtaccaccgtcccatcattactcaccgacccttggagtttgatatcttcttttgccttaccatcggttgaaatatatagacacacacatctaggaacatgtttcttagaaaagaaaatatatacatcttcataatttagtactactagacaacagagtttataaagtttttaactataatttcagacttctctttggagtatatttttatttgattataatatattactgtacacaaaatcccacgacaacgcgcggggttctatctagtttagtagacaaatctagctcaaggcctagctaccctaagcttctctttgtgctaggccttgagctagactttaattattagaattgtctttgttaattggctcaaggctattgtttttctaataaggaaattaacaaaatctattatattattaaaggaatagaaaaaggagtctccacgttcgctctcatggcttagaaattctcacattaatcgaagaaaaagaaaaatcatagtccatattgaaatacaatttagaaatagctgaaattcggaattaaaaaataagaaatattaaaagaggagactagagtccatatagaaatacaatttagaaatagttgaaattcggaattaaaaaataaggaatattagaagaggacactagagtccatatagaaatacaattaggaaataactgaaattcagaattaaaaataaggaatattagaagtagagtatagagtccatataggaatttaaaactaactaaacttcggaataaacataacaaaattaaaagtagagttttga

SEQ ID NO: 10507 - DNA, 1501 bp, Oryza sativa
taattgagttacaacttgaaaaataaatttatttgatatattaaatttcctttaacaattacaatgtttaatcgtttaaaaacgtactaattaaaaccaaagataaaatctactactccatccgttttagattataaaacgttttgattttggtgaaagtcaaaatactttaaatttgactaagtttatgcacaaatatagtaatatttataaataccaaattagtttcattaaatcaataattgaatatattttcataataaatttgtgttgagttgaaattattattatttttttctacaaacttggtaaaacttgaagcaatttaacttggaccaaagtcaaaacgtcttataacctaaaaacagagggagtatagccctgtttagttcctctaaaatgacaaaagttttgatgttttgaagcactttttgctacatggataagcactagtagcgcaatttgtcatttgtcatttgggagtttagggtagcaaattttgaaaaaaaaaacgttgggagtcgttctctctttctttactagtaaagtggcaaaactttaccctacatctaaggctctgtttagatgggactaaaattttccctatcacatcggatgtttggatactaattataaatattaaacgtagactattaataaaacccatacataatcttggactaattcgcgagacgaatctattgagcctaattaatacatgattagcctatgtgatgctacagtaaacattctctaattatggattaattaggcttaaaaaatttgtctcgcgaattagctttcatttatgtaattagttttgtaagtagtctatatttaatactctaaattagtgtctaaagacagggactaaagttaagtccctggatccaaacaccacctaaacgccagctagcagaacttgaatgccaaatcttttgccaaaaaaaattgtcacagcaaattatctttttaaaaaaacaggatggagttaaacttggtcttatgatatgtgccgaaaaagaaaaataaaaaggtaatctactatagccgctacaaacatttctccctctgaccctacgcagtcagtgtgtctcagggtcaaacactgtgtaacggtcacccgtaggcccccgagacccaaccccagctcctcccaacgtacacctgacccctctcctcctccccccaattcaaatcccaccaccacgctctgcgcctgtgaggctgtgaccaccacccccccttccccaaagcaatcatactcccctcctccttccacatttcgaaaaggcaatccaatccagcgaagcttttttcaccaccccagaagcccagatccaatccagcctcgccgccatgggagccgacctggacttctcgccgccgccgccgccgccggagcccgcgctgtcgccggagccggagatcctcgcccccgaccaccaggtgagcgccgccgccgccccccgccttcctcctgttcgtcgaattgtcggag

SEQ ID NO: 10508 - DNA, 1303 bp, Oryza sativa
agctaattcgcgagacaaattttttaagcctaattaatccataattagagaatgtttcctgtagcatcacataggctaatcatgtattaattaggctcaatagattcgtctcgcgaattagtccaagattatgtatgggttttattaatagtctacgtttaatatttataattagtatccaaacatccgatgtgatagggaaaattttagtcccatctaaacagagccttagatgtagggtaaagttttgccactttactagtaaagaaagagagaacgactcccaacgttttttttttcaaaatttgctaccctaaactcccaaatgacaaatgacaaattgcgctactagtgcttatccatgtagcaaaaagtgcttcaaaacatcaaaacttttgtcattttagaggaactaaacagggctatactccctctgtttttaggttataagacgttttgactttggtccaagttaaattgcttcaagttttaccaagtttgtagaaaaaaataataataatttcaactcaacacaaatttattatgaaaatatattcaattattgatttaatgaaactaatttggtatttataaatattactatatttgtgcataaacttagtcaaatttaaagtattttgactttcaccaaaatcaaaacgttttataatctaaaacggatggagtagtagattttatctttggttttaattagtacgtttttaaacgattaaacattgtaattgttaaaggaaatttaatatatcaaataaatttatttttcaagttgtaactcaattaattattcgctaatgattttcttgttttacgtgcactaactctttctaatcttaatttgtattaatctatcttaattactacctccatccatgttattcaagctaccttttctaaaatgaaactattttatcacctgtctccttgtctcaaccaatcacaatcattctccttcactaactttctcttctcatccaatcatacactttctccaattatttccacgtactttcttagtacctgtgtcaacctttaaaatacgtacattttttgatggagctagtaattaagatggattaatataaattaagataaagatgaagtcaacacacgtaaaatgagaaaaccattaacgtatgattaattgagctttaattattacaaacttgaaaaatagatgtatttgatattttaaatcaacttctgcattgaatttattttaacactgtccaaagtacattactacactcaactttggtaccctctttaaatactacactacagt

SEQ ID NO: 10509 - DNA, 1501 bp, Oryza sativa
taaaacctttttactttgtttatttcttttcaattattatttgttttctgaaaattccactaaaatttatttacgcattttaggcttttaggaaatatacaaaaatcctccaagcctcatttgacttttatcttgcaccttttaattgttggaggctttcacattgaattttacttattcttttgcacaatttcgaggatgaattttagagtcgatttgggacgcgacagccgccgccgctccggacttcctcccgactcggcgacccctccatccgcttcgccgtgttgccgccgaccccgtccgccgctccgcttcgcccgcagaccgtcggagcgccgtcgccatcgtcatcccgagccgcgccgccgtcttcttccgctccgtccgccattctcgtcgtcgtcgttgtcccggggtgagctgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgtgggtgcggctgacgcgcgggacccacggggccgaccgccgccagccgcgtgcgcccggtccaccgtggaccgagcggctgacgcgtgggccccacccccgtggacccggtccgcgcgtcccctccctcggctgacgcaataaataggttttttaattaaaatttaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagagtaaaagcctttttcttttccgttggtcgtgtagacgctgcagcttcagaagatccgctcttcgtggaagtcgaagccgtcgattggggaaaacgagcaaggcaagacacatcatcttgatcatattgaatcccattttataaaattatgttgatttaaattattgcattatcgctttatttaaattcccgcgttatcactgttttacttagccatgcctatttacctttgttatgaccatattattattgtcattgttattactaccttgttcaccctagaataaacaaaaccccaactagtggacactctatttatggttccactagtatgaatttaggtagatgcttcgctgattaataggtaacattaggaggttttacaactttagactttgggaattctcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 10510 - DNA, 377 bp, Oryza sativa
gtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 10511 - DNA, 464 bp, Oryza sativa
ctatataaggcgcagcgatatgatatcgaacgaagtccggttgtcagtatcctgattcgtattctagtatcttatgatactacgatcctaccaagccgaaacgataccgatcccacctagtatcctaattttcatagtatctcgatcctactattcattactacacgatcctacgaaatcttaagtggtatcccgattctacgatccctacgttactacaaaatattatttaaaataagatggtttggaaataatgtaaatgaatatgctcaagtatatatagaaatcagttaaatatatcaaaccaacgtggtttctcatgataaatgtctatatttgcataatatatatgtaattaatatgaatattaattaaacttaaaaaaagaaaatctcatagtattccaatattacgatacgataatacttggagcaaaacattactacctaatatcccgatccaga

SEQ ID NO: 10512 - DNA, 1405 bp, Oryza sativa
actagaggatcccccccatgtgactggccttgagcttcttcaaacgcttctgaaccttcctcaacgaaaacgctctcctccagaacgtcagaaactaaagcaaatgaacaaaatcaacaaaacagtacaaaaacaagcataaacagaacatgtggatatttttaacatgtagatctcgattttagatgaatttagcaacttgaaccactcgaatccgagttacgatgatttagttatgaatttctgaagtttaatcagattttcatcaaatacagaaaattattacgaattaaataaaagatttatgacgtcattacgacatcatcgccggccatggtgcgggatgacgcgaccaccggtggtagagggctcggccgggctatccaaggacacctacgcgtagaggacgacgacgcgaactcaccggtgcaaagaacaacgacggacgacgacgaacaacggccggcgacgaggaccgaggacggcgcggctcggctcgacggtggcgacggcgctctggcggcttgcgacggcggcgaaggggttgccggggtactcctcctccgcacgcacccgacggcggcaatgggaagcggcggcgacggctacagcggcggcgcggcgcggctggaacggcatcggcggcggcggcgactagttcaacgcggcggcggtgctatgggcaacggcgacggctaggacttcgggcaaacagaagaggatgactaggggatgctatttataggcttggattagagaaatcggactccaaacgagaggaatcgaagccggaaaatcctagggttaggtggaaagataaactcgaaatcgagtttgattcggataaaatacgaagcaattagctccaattcttggggaaaggatagaggacaacaaagggataaaaacccctcaaccaatcggactcagagatggccggttggggcggatttggcggggaacggcggcggcttgggctcggcaggccggctggaggttgaagacaaccccgacatgtgggccccacatgtcggcggctaaaaggaggggggcggtggcggctcggcttgggccggcttgggccgcacggccgcgcgcgaggaaaagaggagttgggccggaaacggcccaacggcctagggaattttaaagactttttcaattaaaataattcgtgaaatgatgtttcatttattaaaaatacttcccttgctcaaataatttccaaaaaaatctagacaatagataaccaagcaaagtatttaataaaattttatctagctcaattttatgttgaaatttttcctagattattagagtttaacttgtaagcttctaaaataatttctaaaaatgatttaaagaatgaattattaaactaggctattttcatggcgtgacaagt

SEQ ID NO: 10513 - DNA, 1501 bp, Oryza sativa
gtccagcccacttgcatcacggattcgcggcgctcagcagtcaggatcttcggccaccatcaccgccgtccgccactatcgcacgatctctcgctggtgaaacgcgtacgcagtcaatagtcctcaaacaactacaacatgctcatcgacgaggtgaccagcattgaggacaaatcgaagggaaaaaccactcattttctcttcaattgtgtgcagaggatcctttcattggtcaacatctgcactctcttcgtctctcgtttaacagaaggggaagaaagtatttgttggcaaggccatattttttttctttaggctactcggtcaaattttctaccggcaagaatttcaatcacataccgaaggcgtcagcaagattttcaactacttcccaaagatctcaggtgaagcggcctcagcttctttagcttcttcagtgtcacatccggtaatgtgaatctgaacatatatattgcagcttcttcagcttcaagtagttagcaaatttttggaagcaactctagcaaaatatctaaaattatttttcacctgcaaaattgggatttgaatggcaaaaaatgttgtggcaattaatgtgcctaaaatgtggtcgcgaatatagatagtactctgtgatttgtggcacagatgagctctaaggctatatatatagctttcatactgtggtcttccgtcagcattcatgggttgtcaagtattggccattgtcagataataaacagtaagtccaagcaaggccagcttggtttacatggctacaataaaatttgatcgaggaagattgaaagccaatgatgttggtttaatggggaacaaattggaatggtcgagattacattatccaaggaagcattgttcagtgaccatctaaatgttgtagtactccctcgttccataaaaattacaaatataacttttgtcaccaacaaaaaaaaaactcatcttgcatggaacaaatatcaaggagtgtatgtacgcatgcaaccaataagtattaaaatagctcatctggctctgattaaacatttaatttacctttttatttaagtcttggatacatagaaactacgaataagaataacttatttgaaaaatctcaaatatgaaatatgtctacttttacttttatggatggatggagtaatattttgaacaaggagcccgacaagtagcattgaatttaggacaacagtgtggtggtagatttcacaagcagattcctatttcacaaagaagataaacttgttctcattctatattatattatactacaacaattgcatttttatcaggaattacaatggtgcaaaaggaagacaaaaaaaataatagggcaaaaaaataaaacataaaaaattaaaattaaaagaaaaaaaaaagaaaaacagagaaaccaaccatgcacatcatcccccccagctctgagcgactttcctcacgacccaatcttgtcgaggctctcggcgacggccttcatccg

SEQ ID NO: 10514 - DNA, 1501 bp, Oryza sativa
agctaggtcgacgtgtatatgtttaaatggatgagtgacaactagggatgcaggtgggccgggttaacccactgacccagtgacctagcccaagaatcatgggacaaaaatcagatgggtcgacccatgatttttcgccggtcaacataggtcgtggtccccttgacccaatcaacataagtgggccgacccattgagtaggcatttgactaatcgccggtcatctccgcccccgccgccgatcctgcattcttgctgtgctccgcccccgccgccatcgccctcacgagctcggcgctctgcgatcgctgtcccgtctccgagacgagccctactggcaggcatcctgcccattcatcttctcctcgctcggcgccagctactgcacgacaggcagcggcgacgcggcagacacacgcaaggccgagagacctgcagacccgccgccgacggagcttaccggcggtgccacagccggcggacgcgcggaggtagcggcgccatggatgattaataattctgtgcgtgttcctttcttctgtccatgctaaaactagaaaagaatcaaagatattggattctcggtggattggatgcagatgtagctcatggatttcacttttcaggcatagcatgatgtctaaattcaaaagcagttgcttcctcgtctttgcttacataatagttacatatggtttaagcgatttggttaatctctcgttcctcgggcctcagttctgcagttttctcgtatttgtttgatttcagctgatgtcaaatgattaatataatcatctatgaattttaggtttgatgctgtctgctatctgttcgatttctgctgatgtcaaatgcttaatcttccagtatgattttttttggtttgatgatccgtgctgctgttgatctgtttagacgatctggctgttgtgcgtactagtcgttgctttgtgaattgccactccacggcgtgattggccaatctgaatccggtcgccccatggacagctcgtgggtcagtggtccatgcatgttttgtgggtcggaaatcaccgccttgggtatcgtgggtcagactttgggtcgacccagcccgacccccccagcacattacgagtgtagaggaaataaataaataaggaaccacctatatatttatcgataaattttcttctaaaattgacagtgtaatttttgtaggagaaaatttatcgacaaatatatagcaaatatatagcaaaattgataaataaaatataggagtatctatcaaagaaaataaaatttgtgttagaaaatcgagcggtttgataagaaaaaaaaggtgagatatagcaaaatcaataaaatattgcgccacctgtccgtcgtctcgtctccagtagacgggcccctgtggtggctgtgtgcgagcaaaatactagcagcaagaagcaatcatcctctcctcgccccgcaccatctctccagtctccatccttgatggtctccttgctccccc

SEQ ID NO: 10515 - DNA, 1501 bp, Oryza sativa
tggtctatcacaatgtatattcggtattttccatctacctaaagtgatgattgaaaaggataataaactgatttcaattgtacacctacctccctgggtaggcaaacataaacacggttcaataaggaatacacattaaatgcacatatgtgaaccatcgaaccaagccataccagttttatcctggtcttgttttaccctacaacagaagttatgaccttatgaaagcattataagttttcgccagtgaaaaatagtgcatgccatcacatgaaattttttgaagtaatcatcagtgacatgtggggatgagaatctgataggttgaccaattctatggtagaaaaataatcatcaaaagctgattttcgtaaagaacaatacaaactacctgtgcattgaactacccaaatatcacaaacctagatcatgcattataaatgaatatgcaattcttcatataagatcaattagatataaccctttttcttttttgatgaaaactaagtgatagattatctggtaactttaacaccgtgctagaagagcacatatatggttaaaaccatcaaataagtaaatacctgtgaaaatcggacctaaaagttttctaaatttatgagaaaattactagagaaagatgtaggaatgtaatacatcctcatcaaatcttaagttataactcaactttacttgggagtaaaaaaacaaattttgggtaaatagtaacatgacactaatcaactgaattttgtctttttccattgctctcaaatgaagttgagtttggactatagatttggtatgaatatatgttatgcctatacctatctctagattttttttatgaatttagagaacttttaggtatggttttcacttattcgaaggttttcactgaatatttccccgtgcaagaatcagagaagtgaaattaaataacaatgatttcttcatcaaccaattagtggacaacaatacatgtctttgatcttgcacaaattcatcatgttttctttgaaccttctgatatattaatcacaaaccaataatgaaatccattgtaaggtggcagctaattggtgttgggaagtttaggcaacttaaaatagaatcaaagcaatagatggattgtggaacaaacactgagataaattgattttatacagtgcaaaaagagcagatatatagtgagctttagccatcgcatccaaaaaaataccgagagaagtgttggattattctcttaaataggaattagtcaaattgcataatactactagttggttaatttggttgcttattgctgcttaagtttctggcacaaattagcttagcttagttgtaaatgagtgataatgggctctagaatacacaagtgagttgtatgcttttgtatggtggcatggtaggatgcaaagaaaattttactagttagcaaggttgtacagtgtactagtagttttgttggtagcttgtgcttggtagcaagctatagttt

SEQ ID NO: 10516 - DNA, 1501 bp, Oryza sativa
agcaaatttgcagctaactaatgatagactgttggagcaatctagaagaaatgtgatagttcaatcatgtttataaggacatctctgtctttttttttaaaaaaaaaacctgtagaaggattatctatctcaaatacaacattagatatggcttcacgctctctcacgtgttatatgaagcatatatctgcgattcttgtagcaggcttagctcatctgaaaatgcaaacagccaacattagtttcttttccgttgaagcaatccagtaattggttaattatgatgcacatttgtcttctccaatacggcttttcttttctatttttttagggcaaactgtgcttatcgatcggtcaaattaagagttgaagaggatcactaaacaagtaatcatcatgtctgtgatgtagctttgcaatttattttagtcgtagcttttctttgatatggaacatcgtgaataattaaatttcaggcaaagagacaggcatttgctttataatccctccgtttctaaatatttaacactgttgactttttagtaaatatttgaccgttcgtcttattaaaaacttttataaaatatgtaaaactatatgtatacatataagtatatttaacaatgaatcaaatgatagaaaataaattaataattatttatttttttattagacgagaggttaaatatatttaaaaaagttagcgatgtcaaatatttagaaatggagggactatcattgaagtactttacaaaagatagtatgaacattgttgcgcatgcattaggcaaatccatcaaaaatgaaaacgagatgcaaattaagttgtgttaatattttaatatgacggatggagactgctatgattcattagtctttgtttactccatctgtaaatgtgttcgctatgttttccactcttaggaagaaattaaattgaactaaccaatagagaggacgaagctctacttttcaagtacaaattaaagtcgtttgaataatctttcggttgtaaacctgccggccagatgaagattttcttagagacaagacatcattaaactgtggtttccacattctacacgatttattaatttggtcaaaatagagatattatttcgtacttctgatacggagcgtgacaattaatgcaataacatttagttacttggtgactgtttcttcttatctccaaatccaattggcaaaatttgctacaggacatccaaaaaacgtgtaattagctatgggacatcgcaaaaacacgtatttgctgtagaacatcacaaaaaaccggttattagctcctggacacccgcgacattattttattatttttggaggaataggagagagaaacggctgtgtaagtacggttctacccttcgaattatttttctttattcttccttaatcttcaagtgagcccgagggagagggaaagcgctggcgatggcgtgggctggtgcagcgccttggttggggcggcgctgcgcggtca

SEQ ID NO: 10517 - DNA, 520 bp, Oryza sativa
aaaagaaaacgcttttactctaataaacttcatataacaagcaggaacaaagcacaaaaatgggttcttcacttcttaaggaaaaaatagagacttgaatggtccaattccgagttcaaatggccaagttatggccatttgaagtttatatgctctttaaatgaatatttgcgattttcttcatttaaaatttaatttaaaaagggtttattgcgtcagccgagggggaggggcgcgcggaccgggtccacgggagtggggcccacgcggcagcctcacggtccacggtggaccgggtgcacccgggctcacaccggccggcgccgtgggccccacacgtcagccgcacccgagggcgcgggcggctgacggccgggccccacgcggcagccactcggcgcgcccgagggcggccatgccggcgcggtcggcgggaggcggcgcgcccgcgtccctatggtcgccggcggcggccataggcacggcggagtggcggccgagagaggggagggaaaggggg

SEQ ID NO: 10518 - DNA, 1501 bp, Oryza sativa
gaggagttcctggaagatgaaggctttggtgtctagctcatgcctgccgtcaagcgcctgtggtcgtcgccctagtcttccgctgtttttcgtttgtcttcttgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttatttccggtcgtgacaagttggtatcagaacctccttgaccctagaacgagctttagatcccaagccttagcaatattttcgaaataaaaatccttccttatttgtgaaaatcctctagtctctctctgtcctgctgcttcatttatcgtcaaaatctgatctttaaaatgttgcttttctcttttgtttttgtttgtagatggccggcagcatcaaccgtcgtggcctggacctgactggcttcgttttggagctgcggagcatgtgcgttgtcctagggtatccgcatggagtggactaccagggcaaacagctcccggagcaggagggtgacgatgcagagccccacgctatttgggaggtcactgcagtgatcctcactggctcacccgagaggactttattggcagtcaccgcgggtggagattctttccccgccgcttgccagaacgccgcactcctcgccatcggcactcttcaccagcgctacccggacgagttgcagcactcgccgtaccgctaccaccctcgtcgcggaggagcccgtgactacgccaccttcagggatgctagctcggaggatgacgctaccatcatgcacctggcacgcatggtggaggcgtatgacgcagcccgtatcgacttccatcatatggtgcgccgtgggttggtcgagaacaacatgaagatcctggagctgcgtcaggagaatctgcagctgaagaaggacttggacgcggtggaggcgcagctgtgtcagctcaagatcgcccaatgagaggtctgtcgccccaagcaccgccgcgtctgccgcagcatgaagatcaccgcccgcaagagtacctccaggcccgagcttgttcgtcagtccttggcatggacctgcttcgtcgagacccctcgcgccgagcccgcgccctcggttcattaggaggcgggagcctctggcgttggcagcacggaggatgcgctgctgctcaccttccgccctggcccgtcgcagaagtaaacgagcagttagtaggctcgcgcgtgtgttcttttcgtttgttttcctgctagagtcgtgtggggcatggttataccggtgtgtggtataactgtgtcggagcctgtctttattttatttgcttaagcaacttgaaccttaatgaaccaatttaatagcagtaataaattcaagaattatggtggtcgtgggtggttagttttaatagtcagctctctctgtttgccggttctgtgtgggattttc

SEQ ID NO: 10519 - DNA, 916 bp, Oryza sativa
gtggggccaggccgtcagccgcccgcgccctcgggtgcggctgacgtgtggggcccacggcgccggccagtgtgagcccgggtgcacccggtccaccgtggaccgtgaggcttccgcgtgggccccactcccgtggacccggttcgcgcgcccctccccctcggctgacgcaataaaccctttttaaattaaattttaaatgaagaaaatcgcaaatattcatttaaagagcatataaacttcaaatggccataacttggccatttgaactcggaattggaccgttcaagtctctaatttttctttaagaagtcaagaacccatttttgtgctttgttcctgcttgttatatagagtttattagagtaaaagccttttcttttccgttggtcttgtagacgctgcagcttcagaagatccgctcttcgtggaggttgaagccgacgtttaggaaagcgagcaaggcaagtcacatcatccttgaacatattgaatcccaatttataaaattattttgatttaaattattgcattatcgctttatttaaattcccgcgttatcactgttttatttagccatgcctatttacctttgttatgatcttattattattgctattgttattattaccttgttcaccctagaataaacaaaaccccaactagtggacactctactcatggtaccactagtatgaatttaggtagatgcttcgccgcttaattaggcaacattaggtggttttacaactctagactttaggaatattcatatcacctggacattatggaatggttggattattgtggaattggattcacacctccccctctattcaaaaccctcaaaatggttttaggctgggctcggggtgcatggttttgatagtagcacctcggccatataaggaccggt

SEQ ID NO: 10520 - DNA, 1501 bp, Oryza sativa
acgaatcttttgagcctaattaattcgtcattagcacatatgggttactttagtatttatggctaattatggactaataggctcaaaaggttcgtctcgtgatttcccccctaaatgtgcatttagttttttaatctatatttaatgctccatgcatgtgtccaaagattcgatgtgatgtttttgggaaaaaagtttggggaaccaaaccaggctttgagcttaggtggtgtttggatgcagggagccagggactaaactttagtctctatcatatatgatgtttggacattaatttgaaggactaaacatagactacttacaaaactagttatataaatgagagctaattcgcgtgacatttttttaagcctaattaatccataaatgagagcacatgttttctgtagcatcactgttggcggctgttaaatgtcaattctataccgccaacatctacataaagttcagataatagagcatatattccacagtgttggtgtatatttgtatgcagatgataaaacctgatgttgggaggaaatctggactaaagtgaggagaattacgtatccatacaaggaggggttgtgaacttcatcaaaacattagtaaatcaacccaaaactccgaagaatggatagaggaggactaggagaggagccaggccaaaggccaggccaggagggaacttcatcaaaacatcagtaaatcaacccaaaactctgaagaatggatagatgaggaccaggagaggagccaggccaaaggccaggctaggggggcccagcccaggttcggccgaaccctggtgatcaccgttgatcccaggttttggcatggacgctccagatgcattcctgatggcggttagggggcacttcggataattccccttcctataaccgtcatacctgtcctataaatagacctcacttcattcactctcacacacacttccaagcttgagctgaattataagaggctctattgtactatattgtgtactagaataggaagagagtagaatagaagaagtcggaagaattccggagttgtcggtaatcttctcctatttcttttattctgtttattactctgagttcaatataatattcttcttgagtaatttagatttatctcatgagaattatctcttggttagttcctaaatagcatacaggattattgttcactataaccaactaaaatatagtgattgctttagtgagttataaaaactaaagtagatattaattgcttagacgtggtgtttaggtagttgttatccagtaattactgcgtatcccacagtacgtttgaggtgggtgtagaggtggtgacagccctcgagatcacttaagtcctccctatccgggtacgtagtagagcgatatctgggaacaacgggtttccagtgcctgaagtattgcgttacgattaaaattaagctttccctagatgtttctcactactaaatcctctctatcctagcctatca

SEQ ID NO: 10521 - DNA, 300 bp, Oryza sativa
tagaactgcagaagcaagttcagatgaactaacaatgtccctggagcattgtttttttgtgaaaatgtatatatagcagtgtagtaaatgtgtccgaggaggaaatgggggacaaaattgctcagagttccaactgagaatgtatcaacagttgtgagattagatagcaatatatcgtactgtatcaaatcatcaagtgcacacaaagaagaaaaccatgttcaagagaaaatgagaagtatatggctaatagtttaatcgttacaggaacaaagaacactgacctcctttctccatagt

SEQ ID NO: 10522 - DNA, 1366 bp, Oryza sativa
cccacgtgttctatacttctgtgccctaagaggcatcgtactccaccaggcaccagcctccatgacgagcagataaggcaccagccattgcggtgaggaagaaggtgactgcaagccaactagggttctaggatgagcttacccctatcttcttttcctttttctactgtttttttctctaaggccttcttctttcccttacatatatgaaaagtcaaataaaaagacaagacaactgggagaaaacaatactgtgtaaagggacgctacattgattcacaagaaccaatttcatttggaaggaaggaaaacagaaccaacttaaagaaacatagcaagataggacattcccttttctttctctctctctcttttttttttttggggggggggggcagaaagaagtagagaaaggattacagcacttgttcagctgctaaaacacaacctagaggtaaaagaagatagctatgctccgattgcacaaaactttgaagggaccaccaccacagacaatacagctctagagataggccagagatatttctggtaaggacactgaaaaattaaatatggacaaaaaaaagtacattttcagagccatctattagtaacatcatacaagaaactcttacacatattagtagtacgtatgcaagtgggatggatgacccacctactcaatctctgcacatggcctatagctatcgtacggcatctttatgaacaaagccagatattagggtaaagcaactgaatgatcagtgtgtgggttggctgaccaagcccagttacatacttgcatcctaacagaaaccccattaatcttatccaataaattccaaacaaaccggatgatgccgacaatactgagtagcaaataaaaggccaaagggcagatgctaccaattgtacaaatacagcccaatttacttatctaaagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggacca

SEQ ID NO: 10523 - DNA, 1035 bp, Oryza sativa
cctgcagccctataattcaccaactcgttttactcatcttttactcttacactcttacattcatcattcaacgggggggatcatccgcgttaaatccgaacgggtcagaatcgatcccacctccacctccctcaatcagcggacgacccgcaccgccccccccccctccctatcgctctcccaccacacctgcaccttcgccctccgccggaattccgctcctgcacctccgccatcagtgctccgctccgtatcagccgccgcgccgtcctctgcatcgcatgtctgccaccgatccccgccgccggctcgccctccacgatcctccgcctccccgctgcacgaggtcctcccgtcgccaggtcgtcgccgccgttctgctccaccgatccccgccgcacgaggtgctcccgtcgctaggtagccaccgcgccgtcctctgcatcgcctgtctccaccaatcccctctgcatcgcaggggtgagctgcagctatggagttccttgccggtgggggagcagcaggtgaatcccgtgagaggtgagtagttgaacaaaactcatcatgcagttcatcagcaggtgaccagtccggaacttggcatcgtggaggttcatccggattcatcatgcattctgaaacaaaacccatcatccagcgcttgccgcttttcctcagagtacaatgaacgcggggtgctcggcgaaatgtcccgtccggctcctcacctgcaatgcatgtgttctggagagtgtttatggattctggatcttagaccccctcaacgacttggatcgtcagtaaagcttcatcttgaaggtgcacatctgccgttgtttcgtcaaaatactatgcatgatctttaggtgataaaatattgattgaattgtctactgctatcgctcagaatccatactccatcaatcttacatatacacatatttgttgcgtcaaacacaagcttgctttccatacatccctgaacaattcagcctcacaactgctcttgacatatctcattcagaattttttttc

SEQ ID NO: 10524 - DNA, 182 bp, Oryza sativa
cctgcagccctataattcaccaactcgttttactcatcttttactcttacactcttacattcatcattcaacgggggggatcatccgcgttaaatccgaacgggtcagaatcgatcccacctccacctccctcaatcagcggacgacccgcaccgccccccccccctccctatcgctctccc

SEQ ID NO: 10525 - DNA, 1349 bp, Oryza sativa
gtcatctattaaaaaacagagggagtattatattatatttccttcatcaatcttaatataaactaaagcaactataattatgtactccctccgtcctaaaatataagcatttttccgactctgagacagtctctgagatataactctaaaatataagctttttcgattctgcgacggtctccgagatataactttgaccaccaatatatatatgaataatatgttttaaataaaaagagttatatattatgatagtttttgtttattgataaatctaataacatcaattttaaatgattgatctttttaattttattttttttctattgatagtcaaaattaatgatgtttgactcgttactatttaaaaatgcttatattttgggatatgggagtaactattttgagacagaggtggcacctaactacccattgatgtgacaggctgtgagtgaatgttgttttttttatagctaccactaattaattaatggttttttgaagtacgtttatagcactactctttgatttcaatctaacctattcaaccaagatgggccttcatatatcttgctcgtctgatcgctctatttatatatatcctgaccacacacacaactcccgatcgagaaccctaagcgaccaagcagccggggcgccaattgattttgcttagatatatagctgcatcgcgatgatgatcaacgcatcaggcgagggcgcgaaatagctagagatcgagacggagatgggtgagccccacatccttattccgctaaagtagctaagctgtacataagtccattacattatttgaaattaaaccgtgcattacatcaataattcttgaaaaaggaatggcaatgttgtatttttgtatattatcagaaggatttcactaaagatgaaattacaactggcctctacatcaactaggtatacacaaagcctagacaaaacaaactgattcaaacatgaagatatcatgtagttttacaccaacacactcaaatagaatcaaaacaataacataaagtcataaatatcatctccgaaaacaacacttataatatattgacgtgtaatctttttcgcgttcggaaaaaaaacacttttaaggacttgtaagcaccacgtgggacaaagactaatcaaacaagcatcgtgttagctgaaagccggcctaatactactaagggacataatttgtactaattgtggatgttgagggacaatggttttacaattgagagaggcggattaatctctccccctatttgagggacgtagagtgaaccttttaccattgataactatccagatgggtgggccgaattgggccgcagtga

SEQ ID NO: 10526 - DNA, 1501 bp, Oryza sativa
attccaaacctgtaagataggacacatctgtcaagcaatatctatctatctatctatctattatattattaaaacaactttgaaatgacgcaccatgttcgttgtgggggttagaaattcccacattaatcggagaaaaagaaaaagaaaagaaaaaggagagtccaagtagaagtacaatttaaaaatagctgaaattcaaaattaaaaataagcaatattgaaagaagtttctatataagaacccaatacgagattaatcaaaattcgaaataaaaatataaaaatccaaaatcagaaaaggaaaggagagtccaagtaaaaaaaacaatttaaaaatagctgaaattcggaattaaaaataaggaatattaaaataagtttccatataagaacccaatacgagattaatcaaaaatcgaaataaaaataaaataaaatccaaaattaaaaaagaaaatgagagtccaagtaggaatacaatttaaaaatatctgaaattcggaattaaaaataagaaatattaaaataagagtctatataataactcaatacaagattaattaaaattcggaataaaaataattcccacattaattggagaaaaataaaaaaagaaaaaggagagtccaagtagaagtataatttaaaaataactgaaattcgaaattaaaaataagcaatattgaaagaagaatccaatacgagattaattaaaaattagaataaaaataaaataatatctaaaactagaaaaaataaaagagagttcaaataggaatacaattttgaaacaactgaaattgaaaataaaaaataaaaacattaaaataacacaatacgatattaactaaaattttttaaaaaaattctgaaattagaaaatgaaaaataagatatcaattaggaatacaatttataaataactaaaatttgtgataaaaataaagattattgaaagaaaagaccatctaaaacacatgacaaaataaattaagtaacatgcctataaagaagtagagtggtggcggttgatatgagatataaaaattgttaataaaacaccaaatagaatcctaatgacgattaaaaggagagacgtcaggcaggccgtgaagcaaatgagtaagacgattgccgggacttctagaaagtaaaaaaaaatcaattgataatcatattcaatttttaaaatttcaatgataataaaaaggagaagcagcaggcggggcgtataagagtatagttgcagagccgccgacggttgacaggacttctagaaaataaaaaatgaattccaacgacagttatgtttgatttttagaatcacaacaataaagagttggcggcggacgggctgtagaggggcattgtagcatcgtttgatgggacttctaaaaattataaaaaataaaactacaagtccaatttttaaaggttttgaacttctaaaaagtaaaaaaaaaaccaatgataatcatgttcgattttaaaatctcaa

SEQ ID NO: 10527 - DNA, 1501 bp, Oryza sativa
gcctccgaccactggctgcggatgtacggccacctcatcaggtacggcgaggacggtagcagcctcgtcagggtgatgaatctgcactccgtcgccgtagcagccgccgccgaaatccggtggttcgtaagtgtgtagagcgaacatttgtttgtcatgctgcagcgtgtgtgatgtgagcgaacattttggcactgaattttgttcaaatttcaacgggatttactgagggaaataatggattgtatcgtgagtagaattgtagaaatagaatcgaacagcaactgcagcaagcagtttccaatccctgtgaagtcgtggagaggggagaaggagaaaatggcgacgtgctcaccgttcgcttccggaagctggcggccgaccagatcaagggcgcccgacgccgacgacgccctcctccacggcgccgcttgcgtcccgacgctccgctcctgcgccaccgccgccagtcactagtcactaccgcttgcgccctggggccccgcgcgccgccgacgccctccttgacgccaccgccgcttgcaccctgtggccctgcgcgccgccaccgccctgctcccgcgccgccgacgcccaatagccgcatcggtggcccggtgccctcctcaaacccgtcgccatcggcgtcgtcgtcttcgacagcggcggcggggaagcaggtggagagaagcgggagctcgcccgccaccacccatagcgaggacgccgtcgaggtcagtgagcggcgtggaggacggtggaaacggtggcggggccgcagatggtgaggtcaggaggaagaagatgagggtgagaatgacttgtggggcccacgtgggtcccaccatttttattaatttgtatatgaaactgatatgtgggccccacaaggtttattattattttttggtcgaattgccacgtaagcaccacgtgaccgagtcaaattcgccacgtagctgccacgtcagccaaaaccaccatctaaaccgccgagggaccttatatgcaccggttttgatagttgagggacccgttatatctggttttggggttcaaggacgaaaatcgaattcgttgataagttaagggacctcagatgaacttattccgactcggaaatggtggccgacacggaacgagctttcctaattttgttccccgtcaccgggactccgacaccgaccctatccagattccagagcgtacctcggacgtacgcgacgtgtataaatccagccctacgccgcttcaacgagctaccaaccaaaccaacaccaaccgctacgtgtacgatcaggcgagcaatttcagcctgaaatattttcagcgcgcaaaccaagcaaacaggaaggcgatcgacgtccgccgccaccagccggcgagatggtgtccccggacttgatccgcaacgtggtgggcatcgtcggcaacgtcatctcctttggcctcttcctctcgccggtgcccattttctggcggatcatcaagaataagaatg

SEQ ID NO: 10528 - DNA, 1501 bp, Oryza sativa
tggctcttccgtctcaacattgtcaaatgagacatcaagataacaaactttttttgtgttctatagaaatttgtggtgttgttggagctagtggtcattatgtttttgaacgaacaataaagctcgtgtgcttaattttaaaaagaataggtcttattttaatatctaaatgaaatcttccacaacgctctcgattccaataattattattttttgcatgtgcatttagttctctgtttttttgttgggttccatgtttaaatgcagtcaagaaatttcctttacttctgttgttcctctgtaccgtaaacaaccgagcttcagaaattgaaagcaaataagttctaatgtgaatttatccaaaagaaagttaattcaccaggacaactaattctttccaaggaaaaataaataaatctcggaaattccatcccagtaatttacaaatgcggtacagtactccccgcaaaaaaaaaaatgcggtacagtacaacatggcctaaatcctcaaaagatacagccgtcacaaaaccaatagagtgaattacatcaatattgattaaaaacgaaaaaaatattaaatgtgttaaatttatgtatatgctggcacttcaactaaggaaaaaggaaaaataaatggctttaatagaccgaaagctcgttactttagttggttgatatcatgtacattatgatactactatggacattataatattatgtgacttgctagcatgtattttaaacttttctattgttgatataatgttaattgtgttgtatacatattcagcgtgtcaaaattatatccaatgtccttaaaaaaattatatccaatgccatgcggcattttttttaagaaaagtccttaatttgattaaaattttattatatagtttgtaatttaacaagaaactagtcagattttgacgcaagtaatcgctttctacaaaattcattcgatattctaacttttcggtttaaaaacaatattgaaccggtccacccagcttaaagccttacccttgacacgaatattctcagctaattattccttatataagtggtagacaacgtatcaatcgatagcgagatatccgtggtgccttttaatctcaaaaatatgtcggtccaattttatgcatgtgctcaaaatatgtaaacacacgtgtgttgtgtgtgccacatttattatgtgttttaaaaaaaattcgttctgacattttgattcgaaacaaatcaccgggatttaaatcgcaacctacaaagtcccatcgtttttcccaccacaaattcgctcgatattcatgaatttcgtcaaattcgcccggggtcccattttgacgttcaaaccgtctggtaaaccctgcgtgcaggggagaggtttatatataccccccacacgcctccgcatccttcgccaccatcaccagcagcagcagcagcagcaaagcctttccatccatcgccggcgatcagaggcgatcgagagagagtgaga

SEQ ID NO: 10529 - DNA, 1501 bp, Oryza sativa
gctcagtgataaatcatccaaatcaggttttagtcttgttggtaaatcgtatatcatttttactcaagcaaattaagtacatcgcctaatcatcttaatatgtacttcgtcctactaccaaaatgatttttcttcatttttgtagttttattaagttgaatcatagcaattcctcaatacacattgttttttagtccacgaaaacctgcaagtgccatctatgaaaatcgaaagagatactagactttgttcttttcagattatttaccggattgttaaaacatattatttgctctatgctttgaaaaatattttcccaaataaactttttttatacatcacttgttttaagctatttttaaatttattttctaaaatatttgttttattattataataaagtagataatcccccgtagtaatatattgaacaatcttataagaatattgcctacatctagcgattaaaaagcggtcgatacttcgaattaccatcaaacatgagttatattaaatgctatagcatatgcatttttctttctttttaccatcgtgattagtattttgccaactgttctctagtgaatgctcggaaaagacactccttagaatatactaagggcgaaatgacgatgtggagaagagaagagaagagagagaggagtcacacctcatatatacaagagacaacctccacacaaattttaagaaacaagagaaaataagaggggttgattggtggcaagtgtattgggactagtgtattaaatgtaatgtatttatataagttagttttaattttttggatggatgatgtggataaaattaaaagtgaccaccacatctattataaaacttgccctaagcactccctagcctagcgtatactttttagggtaagatagacattttgcaacgtaacaaggaagacacaaaaaaatggaaagaaaatgcatgtgtgaaggcatttagaagaaatcacgttcgcaatggttcctaaaatcgatcgtttgtctaatgacggagctaagatttagatatagaagggttccaagagtcttggaaggaacgggtgtgtttagatccaaactttggatccaaagtttgcacaattccatcacatcaacctatcgtacacacaacttttcagtcacatcatctccaatttcaaccaaaattcaaattttggatggaactaaacgcagtcctaatacgtattagtattacttagcttaattatctaattaattgaatgattccatgtaaaaaaatgttggaggggacctgacctctcgccgtgccccgtgtttccgccgttgcattgtcaatgacaaaatatagaaaatctcaaaattgaatcacccaccatcatttcacttcctgagataggatgttaactattccaccattctaatcgaaccaacattttaatcgaagaatgagcttttaaaattataagatataacttaattactagctaacattttcaaacacacgtgtc

SEQ ID NO: 10530 - DNA, 1501 bp, Oryza sativa
tataatccaaaatgttgtaaatattaataatactcaacgatatatatagtcatataaaaatatataatttatagataaattaaagatcgacgcttgttataaatccaattgtcatagtgcactatatatattatcgaagtgagttgtggctttcgctatttactagctacatgcccatgcataacaatgggtctagagatacaaatatgacttatttctatatagtttttttaatgatttttgagcttttttatatttagttagaagggtttttgtagcgatagttttctaagagaaggaaataactttgagaaggaagtgcggtcgaatttccttttgtttttttaaggtttttaagggaattacacatttttttcaaaaggtgaaggggatgcgcttttaaagtagtgaggctggaaacctacatacatatgaagtaaaaataattgaatttgtgaatctaagtcattactattctaaagacaaaattgaatttgtgaatataagtcattagtattctaaagacaattaatttgtgggattaaaagttctgttttgactattatataataactgttaaccatgtattggtcagctttcttatttaatacatgaaaaatataactttatttttcagtgaatgatcaaacattaaaagctatttaaacaatatttttttttgctaatataattcaattatgctctagaaaaagctaaaagtaaaagaaaaagttatctggtttgtaagctaattacccttatttcttatatataaatttcgttataattgataaaatatgaaaatataacatatgtttattatgttagtaaatacaatatttattagaatgtagatagttagttgaagaaaaagagacagaaggtctaatatctggccactattgaaatgtaaacaatttgatataatttgtcatataacagaataactttattggtgaaatttgaagaagtgactaggtatataaaagacatgtctatacaacctaagctagttttcttagtgacttacatcatagcatgttattttgtgaaaatggttagataatcaatttttatctttaatgggttttaattgttgcgaagctctaaacttagaaacaattatatgcacaaacatttttttaatagatataaataagttcactatttttttcttgttcatgcttttatagtcaattgagttaccgaatttatttttagtcattattacactattggatttaaatgctgtctgcttgtaatagtaattagcaattttgaaagcttataccaattttgaatactttatcataatattaattaccattttattgtaatttattatttaagtttcaattcactctctattcaattataattctcatatatatttggttagttttggtatgccttatgtcgacgtttgatgtcacgactacggtatttggacagtatggggatcgttggtgctaggatatacgcgagactgaggtaaaagaga

SEQ ID NO: 10531 - DNA, 1501 bp, Oryza sativa
ctgtccgcagcccaacatgactgtacttctactctataataaagagacctttgttgctgtgatactctgtctccctgtgataccagcactgtttcctgggactggtatcgattaacaggttaatttggagcgtcacgggctagttccggtcgggactagttcggggcgtgacagttttcgcgcatgacttctgacagactccctccgtcctaaaaaagtcaacctagtctgtccagatttattggactaggaaacatcatatctaatactggttggctttttctgggacggagcgagtagactgctgcactggtacccaacaaattcctcgacaaaatgcaaatggtgcccaggaagtcaggtttgtacctccaaccaaacaactcttataatgtgccatactagttgagcagaatgtttgatgaattttttaaccaaaattcatagaaaaaaataataaatcatttggcattaattttacatgctaatgatatttgcagccgttatttacaaaatatatttgacgaacatctatatgatgtgtgggaccagaaaattcaaatatcatacgatgtctgaatatattcaaatttggactcgttttgttgtacattttaagcataaaaaaccattggttcaaatggaaatcaaatgtgatacataatagaggaaatatgtgctgctcaacaaagaattatctaccttcacaaacggtacgttactagtagtttgattgtttggtcattaattaattatctgtgacatggcgattcaagcaagcacatatgacatgtggcccactgtcattgattattctaatctcaggattatctctaagcttgtgcatggttcttatctgtgccgaggagataaattggcaaacaaacacatatgatatatttatggggcccaccgtcattagctagctatttaatctcgtgattgcttctgcatgcaggcgctttgttgagcatcaccaagagatatccaataaacccattctctagatgatgttttagagatttctaatcatgatttgagcttgtaaaatatactctcctctaacagattatgtaaacatgacttccttaataaaaagcggagacttgcttaaaagatgtcgacatctttttgggctgatctcagtcggctttaacgtccgtccgattgctcgtacgagactacatgtctttggctgtgcctgttcggaccgttcgatttcctcctgatcatctcctgtaaagtaagtgctgcatatgcttttgttttataacttttccaatgtaaaatttaaatttatactccacttacatatgtaattactatgtaattttgaaacttacatatgcaatttttgaaacttacattataaatacactaaacttacatatctaatttaggaacttacaaagtaaatacataccgactattttttttgaaaaatatgacgccataaatatacagttactcccataaaaagtgggaccacatgatctcctcc

SEQ ID NO: 10532 - DNA, 1501 bp, Oryza sativa
tgatggtgagatgagaggagaggatgtgtgcaaaatggtgggttttatagtggaagtatggaatgtattgcaatggaaggttctttgttgggtgcagcagcaaggaacaacaatgggggtttcagagcctctttgttcttttcagaattgagaacttgagatgaccttttctcctaggtaacctctgagatggatgcaaggtcaggtggtgtggtggtggtggttatatgcctttttgttgatgctgtggagaaaggtattttgcatgtggtttgatcatctttacatcattagtgaaaaaggctaaaagtgtactttagttctaagatgcatttggttttgacacgtgtgtttgaaaatgttagctagtaattaagttatatcttataattttaaaagctcattcttcgattaaaatgttggttcgattagaatggtggaatagttaacatcctatctcaggaagtgaaatgatggtgggtgattcaattttgagattttctatattttgtcattgacaatgcaacggcggaaacacggggcacggcgagaggtcaggtcccctccaacatttttttacatggaatcattcaattaattagataattaagctaagtaatactaatacgtattaggactgcgtttagttccatccaaaatttgaattttggttgaaattggagatgatgtgactgaaaagttgtgtgtacgataggttgatgtgatggaattgtgcaaactttggatccaaagtttggatctaaacacacccgttccttccaagactcttggaacccttctatatctaaatcttagctccgtcattagacaaacgatcgattttaggaaccattgcgaacgtgatttcttctaaatgccttcacacatgcattttctttccatttttttgtgtcttccttgttacgttgcaaaatgtctatcttaccctaaaaagtatacgctaggctagggagtgcttagggcaagttttataatagatgtggtggtcacttttaattttatccacatcatccatccaaaaaattaaaactaacttatataaatacattacatttaatacactagtcccaatacacttgccaccaatcaacccctcttattttctcttgtttcttaaaatttgtgtggaggttgtctcttgtatatatgaggtgtgactcctctctctcttctcttctcttctccacatcgtcatttcgcccttagtatattctaaggagtgtcttttccgagcattcactagagaacagttggcaaaatactaatcacgatggtaaaaagaaagaaaaatgcatatgctatagcatttaatataactcatgtttgatggtaattcgaagtatcgaccgctttttaatcgctagatgtaggcaatattcttataagattgttcaatatattactacgggggattatctactttattataataataaaacaaatattttagaaaataaatttaaaaatagcttaaaacaag

SEQ ID NO: 10533 - DNA, 1501 bp, Oryza sativa
ataaacacagcttacccttatgagtactgaaattatcatcctactcttcacaatttatgatagttgcaagcgcgatatttgcactctataaattcctcaaaaaatatttgtaagaatttgtaaaatttgctcctctggttctaaagttgttgtcatcgtctttttcagaaatttttttttgtcaaatttcaagacatgatacttgccctacaagtgcctcaaaaataattgtaagagtttataaaatttgctctaacaaaattgaaggaaacaatcctcttttgcccccaaaccctagctggggatgaaagatccatgctctatagttgccttgtaaggggaaaattgaagatatatggtcctaagagtgcggagattgttttggtaattaatgacaacccattgttgcaactaactattttcatgagttggtgagattaggttgagttccggcgtcaagttgaaaaattgaagctaaaagatagacactataatttgatgatgagcaagtgaatacattgacgatatggggtatgaagtggctatctatggaaagatggtgaagggcaagcaaggctcagttacgatacctggccaggctaagatcaatcgagagcacgatacctcgaaacctgataaagacggagatgagaatccatttttatgtctatcagactatcacttaattaaaaggtataaattgtggttcacttacaatttatgaattaatccataacacctccgtgggttgcagagaaatttgagattataccatagtcaaagatgggttctctcaaatgcaaatctctcagattcgccagaattatattctcaaacatggtggtgctccatgttaaaatgtctttcatcctcttttgtttgtgaccagacgaaattgcccttgggtttttccttccactcacagtcaccctcgccgtgtccggggagctcggagctattctaagcccaagctcttcctctcctctatgccagaagctcgaaactttctctttgtcaccgctcctagcccaagcttgtcctcctcgtgccacaggctgagctcaagcccttcctcactactgagcttcgagctcaacctcttcctccactttatgccggagtcttgtctttatttcccttgactagaaaaaatacccgtgcattgtaacgggtgaaggctattttaattgtactattgttagatatatttgtttttgtctaagaagtatatgggatttttgttttgagatgatatccaattgaaacccttgtattttcaaaaacgaacgaatttaaaaaccaacttaaatacagatgacataccaaaactatcggtatttttgttttgagatgatatccaattgaaacccttgtattttcaaaagcgaacgaatttaaaaaccaacttaaatacggatgacgtaccaaaactatcggtagaaacttcttcaatttttattaacatatgtaaatactccgtagagagtcccgcctctcccaa

SEQ ID NO: 10534 - DNA, 1501 bp, Oryza sativa
aaacggccacccgggccaacaacttttcaaacggccacccgggcctagctgatcccgtcagctgctgatttttcaaacatcgaatccccttttcacaacagcaatttcacaagcagtagtcaaacaaaactacgctaggaatcacctcacatccgcccatgactgtgggcacggctgttcgaacagtttgttaacctctgcagagggggtacactttacccacacgacattactaacccggatcacccagcccgtggggatcagccacgtcgggagacctccaagctttcatgacaaggcattttgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattatcaatggaaggatcaaatgtaacaaattaggtaggtctgccaatctgccttgcagacgggacaacagattaagtgtgatcctatcaatgcataatatttcgcaagcaatataattaaatttcaaatataggctcaagatgttcaaaggtggcttgccttgctcgcgatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagatttattggatttttggtctaaaggaaaaaggatttatttaaatccttttttttgaaaagaaaaagaaaagatgggagggagggaatatagacttttctcgggtggctagggtgcggcccaagagatttggggcggctcggccgagctcaacggaccggccggcccaagacaagcgcgcgcgcgcgggagggggagccggtggaccgggctcaccacgcgtggtcccgggtgggacccgcttgtcagcggctcggctcaccgtgcggagggagtatgcggcgtacgcgcgcgggcggggctgggacgcggtgcacgcgcgcggttcgcggaggaacggatg

SEQ ID NO: 10535 - DNA, 1501 bp, Oryza sativa
aaagtttgtacatctcaagtttacacatctaaagtttatacacccaaagtttataagtcaaaagtttatatacccgattcaaatttaaatttaaattcaaatatcttatatatatatatatagtattttctataaataaagtttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttacacgtgcaaagttttatttatacgtacccaaagtttatatacccgattcaaatttgaatttaaattcaaatattttttatatatagtatttctatatataaagtttatacgtgcgaagtttacggtacaaattctatacataagtatataatctatgcactaaaaacagtagtagattttttttctgtatttttttaaaaaatttctaacttgttttttttatttttaaaaatttatgacgtaggaagaaaaaaaagaagggaagaggaagaggagaggagaaccccgacgagcgacacccgctcattagcgatgcccgccggagccagtagtagcgttgagtcgttgtcgcgagatggattccaacttgggcctgtaggcctagagagggaatagaagagagaacgggccggcaggctcggcccaaaatagcgccggagtccgtaaatacgaacagcccagcccaccgccgcatcctcgcaaccactgtctcgctctccgccgccatcgccgccgccgccttcctttccgccgccgccgttggtactcgcgcttgccgcccgtcgagctcccctcaccgataaaggctcaccgaaggtttcgtcgtcgaccccgggaggtaagcgtcgatcccgccccctggccgttcttagggtttttcctagggtttggttccggttctccccagtctcaggcaggagatttcggtttcgcgccatccatcggagtcgcgttgcgaagcggaaagctttgcggcgaatcacgtagagcgagggaccttgacccgccacttgcacattcatgtgcgtgaagaacacgattttatgcggaagatttctgcaagccacacataagtgactgtggatctagatacgggctcccccactcctttggaaggtgtgatgatttgtgggtgttctggtagtgtgaatttgttgctctgtgaaggatttacagattgctgtttaaaatgtctgtattctgatttctgaaacttatggcaagtttagcagctcctgtatatgccgattgaaatacaagtagaattatgcacactgtagtttagttagttcaaatgtcatgggtggagatagtgtgttttctgttttacctgctgcaattggtattaaggccgtaggtgaccttgcttttgcagtttcaa

SEQ ID NO: 10536 - DNA, 1501 bp, Oryza sativa
caaagagaggacatttgaagaggaaaattgagatatatagtgagtttttggagaaaaatttagatatgtacaaaagtacaaggccattactagattactttaatctggcatccttaggacatatgaacaatgtctaacgcaattcctatcttcatttatgtcactaggatgcaaccatagaaacgataatgtctatcttcgtttatggcgcaatttatattttctaatatgtttagaactctaattcctttttcacttcctcttacttctcacaatcgatcatgtttgtttagaaagtgtgttgaagacattcttctctaattccttttctattttctctcatttctcataatagattatatttgtctagaactctaattccttctttttttcctcttctcaaaatcgatcatactatttgtttagaaagtgtgttgaagatattttctctatctcaatgcagtgtcttccttcttaggttttgtgtttaaactgcaaaaacgtttccgtgaggacgtcccacgtgcgccatatcagatgcattaatcttagaagattgttctattcctttcctccaaattacaaaatcatatatgattcaaccaaaaaattttttgaatgacagtgcgaagttcatactgatagagcagaaaaaaattacaagattacaaccctggaaggccgtaaccaggaaaaaaaagtataccatcacccacacaccgacagcgccaaacacaaacccaagaggaggctagcaccggaccggccgtcgctaagcgtgaccgaccaccgctatgtcaacaaaggaactacaacagggaacgcccaaaacccaacccttacacctgacacaaaacccgctctatccacatataagggattcagggtgagagagaagatggaaccgctctcccccctagccccccgacacggccagcttgtataaactaggacgtcgatacgagaggaagagactctaaagtgagctcgcaatagttatttgggtggctttggcaagggtgctgccatgacgacatctctagggagagaaacgacgaaggcatcgccgccgtcgtccgtcaagtcacaagaaccttaactgagctttcacccggcaaccccactagagggggtgagatgccagagcgccatcattgccggcccggccaaagccgggctgggttttcacccgccatccaccgccagcttatccccgatgacgcaccgatgctccactgccatctaacctccgccggcgcgtgagcaacactgcaccgacgcccctcccaccggccagcctatgcctgccaccaccgtgcgccgaccactgcctccgccgaccacaccacaaatggcaccaccattgccgctactggccaagcctcgtgccacggccaaccccgccgccccgctgccagcgcctcgtcggcctacgcagcctctggccatgccgcgcctccacgcctcctcgcgccgcggtccccacgccagtcaccgccgc

SEQ ID NO: 10537 - DNA, 1501 bp, Oryza sativa; identical to SEQ ID NO: 5895

SEQ ID NO: 10538 - DNA, 1501 bp, Oryza sativa
cactcgggaagcctagtctttgatgcccgtagacatcccgaatcacacagatttgtttctgaccactcaggtcatccatctgccacataggctgattctggttacgattcccacaccacaacaacttttaacaaagcacaggcaatcaaatctacgcaacaggaaccacctcacatccgcccatgaccgtgggcacggctgttcgaacagttaattaatctctacagagaggtacactttacccacaagacacgaacttactccagacactggccggtgtcagaggttcgcgacaaagcctttcccaagccgactcagggttacctcatgccacatagaaggatcaaatcctcacttaaatataggccattttaggcattcacaaatcaactccaaccaccttgatcggtaagtgagcaagcttctcgtccttgccttaccaggaacccggtttgtccaaccccgccccggcgttcccaactattggcatgcgaggttttcctgaaccaactagttacttagccagggtgtcccattctaccttgtggttgcactttgattatgttcgatgagtttcccacaggaatcggtccttatatgcgaatacgggatagtgccacataggcacaacccccgcatcgcgagttttcacaatttattttattttcaaacacaccgacaccacatgtcgggttttcaaggcttcacaaacccatttcccaagttttcgacaatcaacggtgtatgtgggatatttggtacacgcgctcagagagcacatatacctaagtacaacaagggtggagcgacaaggaatcagggtagtacagcctacaggaattagtgcgactactgggtaggtccgtcggtttggcacgcaaaccgaggccaagcaaattaagtgtgtgaccctaataatgcaagttgcaaacaaaataataatgattttccaattataggagcaattgatcaaagggtgacttgccttgctcaaggtcttcacgaagcttcacgaatcttcgagaaaaccacgatcggtgaaaaatccggtaaccgcaactatacgcaaacaatcgaaaacctagacaaaagaccaaaagaaagatcctaattagactaattaatagtgccattagatagatctcaattttatggaattactggaagttgaacggagtcaaacggatgagcggttgagaagatatggattttctaaagattaaggaatttctgtctaaaggaaaaaggatttaataatttattaaaccctttttttggaaagaaattgaaggagggaggaatatcagacttcctcagggtggctagggtgcggcccgaggggatttgcgtggctcagccgagcttattgggccggcgcgggctacggggaggcggcccaggagaggggtgcggggagagagaggggggagccgggtggaccgggctcacctcgcggggtcccgagcgggcccgcttgtcggtgaggcggtgcacggtggaa

SEQ ID NO: 10539 - DNA, 1501 bp, Oryza sativa
ccttcgccgagcgccggaagagccggtgcgttcgaggacgcggaaggggacttcggccgcgccctcttcttcctcttcctcggcccgaggctggagagattactcccgcgccgtcggcctctcgtcacagcgcccctcctcatctcggtgatgcctccctccgttcttcctcctcgctccatctcctccccctagcttttggtagtagctcgagtagactccccgtagatagccggcgccgccccgaccgttgccgtcgctcgccgtgctctcgccgccgtcgccgctcgagctccgtagcacccacacgtcgctagcctcgctcggcgtagctccgtccaatccgacgctagcatcgagttcccgaaaccgcgtagatgctctcaccgtcgggaatcggtccctcgtgacctcgtcggcgtttccctcttccctccccgccggttgtcgccgccgcgattcgccgccgtcgaactccctctggcgaatccgagccgttggctcgtctcccctcatcacgaacagccgcccggtgtgctcgcttttgcccgtatcgccgtggttcgctccgccgctcgccgccaccacccgccgtccattcgcggccgggtcgtcgtctacctcccgccggcccgcgtggcagccacgtaggcgccacgtcggcgccagctcagcctagactgggtcgagccgaccccggtcagtccctccccgtgcgcgcgttccaccgcgagccgtgaggctgctcgtgggcccgccgcatccgcatccaccgcgagccgcgcgcgtgcaccgcgtccctccctcgcccgcgcgcgtacgccgcatgctccctccgcacggtgagccgagccactgacaagcgggtcccacccgggaccgcgcgtggtgagcccggtccaccggccccctctctcctcccctcccgcgcgcgctctgggccgggtcctcttgggccggccggcccattagctcggccgagccgcgcttcttctctcgggccacgccctagccgcccgagggaagtctacttctcctccctctttcttttctttttcaaaaaggatttaatttaatcctttttcctttagaccaaaaatcaaataaccttagaaattcaatatctttccaaccgtaaatccgtttgactccgttcaacttccaaaattcctcaaatctcgagatctttctaatggcatgcttagaggtcattaatagggctttattttcgccgtttgttgagttgtcccgtttcgcgtgtagtatcggagcccgaagacccgcggtgcgaggatttcgaggatcaagctccagatctcgagcaaggcaagccacctttgaacatcttgagcctatatttgaaatctaattatattgcttgcaaaatattatgcattgataggattgcacttaatctgttgttccgtctgcaaggcagattggcagacctacctaacttgttacatttgatccttccattgttaattgctataccatgtcc

SEQ ID NO: 10540 - DNA, 1501 bp, Oryza sativa
gcacatacgggttactttagcacttatggctaatcatggcctaattaggctcaaaagattcgtctcgagatttaaatgcaaactgtgcaattagtttttcttttatctatatttaatgatttatatatgtgtccaaagatttgatgtgatgttttttgaaaaagtttctggggaactaaacatggtctaaatgtcatgaaaaatgacctcccaaatggtgttagaggtgtggatatgtaatactttgaaaaaattacaaacataattaattttttctataaaattaaaaaaatgaaaaaaatctaaagtaggagaaggcgagcagtacattataataaaaaacacagaaatactacgaaacaatatactattataatgaaatatctaacatcaatatgatacagattctgatgtcaacggtacaatgctaacatcagcatgatacttagtaataaattaagtacatacatgtatcatgttaagatatgatacttacgtgtgatgacatcagcatgatatggtatcgaaagtaccagatcggtatatatttgctattccgttacatattctgttcggtagtcttccttaaaaaaaaagaggtcatttatttcggagtttttattgattgctagtagtagtttcgtttgcaatagaaaaggatcagattagaatcaacgaagaaaaaggcaaagttagaatagtaactatacagcagcataacgtatatacagatacatattgctacgcagataccgtacgcgagcagacacggacgagacgagcgcccaaagccctcgctggcaagaggtgaagaggggggagaaagacgcgtcaaagccatcaaccagatcgattgatccatccatccatcaatcgatcgatcgagcgatccaaccgaggtacgcgagcaaccatccccgcttccccttttcctcctccgattcgagatccatggcggggcctctgccgtgcggcacctcaaaccctctccggtcgtactctttgtctgcagccggcgagcagatctgaaggcgcggccggccgacctccttccgcctacctcaagtcttgtctcgactcgaattgaaggtcttgcgattacttccctcgcgtagattgcaaattcatcagggctttgattgattggtctccgtccaatcaaaccgtcgagtttgttgtgaatttatttgatgcgtggtgtagtgctaatagcagcttgtgtttcaaaaaagaaaaaaaatcgttaggtctatccgctgtttattaggttttgttgtgggtgtagagcacagtattgctcgcagatacttttaaatgagtagagacactggaaggcgaaatctttgctagcatattattgaccttcgtaaaccataattaaccaatgctcttttatatctcagaagggacaataccgtgaagtatctgggctgttgcttcgtattttcgtggattcaccttggaacttcagaacgaatcttcctgatattttccgtgacaa

SEQ ID NO: 10541 - DNA, 1501 bp, Oryza sativa
cggtcagctggatccatcagcgtccgcttcctccccctcccgccgccgccgccgcctcttcctcctcctgctgtacccacaccctccgttacattagggaaccccacaaccatattcccctccacggccgttgccctagggtcatcctccctagccaggaaatcctccagcgtcatctcaggcccgccacccctacccgcagcgccggccgcgggagctggagcgggagcagatagccctcccgaggacgagatctccttccacacctcctccgccgtccgccgcgcggcgacctccgccacgggggcccccgccgcctcccccgccgggggcggggccggggccgagccggcggccccaggcggcggcgcggcctcgccgtatatgttgcggaggatgtcgtccatgttcatggatccgatgccgctgctggtgctcctgaaccgcgcgagatcggcggccccgccggccgcggccgccgccgggggcgggggcgggggcgacgacgacgacgacgccgccgccgccgccatcaccctcgacgacgccatccgcccgccggcccccgagcctcggcgacctcgcgccgcgcggcagcttgctggctgtacggcggctctcgccgtggtggggggggggggggtggttggttggttggagccggaatgaaagagggagagagtgctcgacacgagggcgaagcaagcgagcgacgcgacgcgtgtgacgtgacgtgagggagggagggagggagaccgcgagtgtgagtgactgcgctgtgcgcggcgtgcgtgtgcttttgtgtttttgcgaggccccccgcgcgcggccgcggattatcggcgcggctgaggtcctttacaagggtaggggtgaaaacggttgaaatcggtatcatacttgccatttaaactagtatctccctctcaaaatacttatcgttttattatgtttttacttataacttttaatcatttatcttatttaaaaaattatagaattattatttattttgtttttgacttgatttattatcaaaagcaatttaagtatgatttatctttttttatatttacataaatttttcaaataagacgaatggtcaaacgttacaagaaaaatactattttgggttgaaggtagtactcagtatcgatattaatacgatgtagatagaaattagaaaaaaaacaaaatttataaataacaaaaaaaacagtatgataaaaaaaacggtacttcttatacggaaacgacatcggtcgataaccgttttcgtccctaatcgtgactatcacatgtggtaacttaatttttaaagtcaccttatatctcatagtaatcataaggttttcgcggtaacagcgataacaattaaattgtggggggtgacgataacttcaccctcaaacagttcagtaaactcttgagtgagccgtttcacctcgtgcttccgggcgtggcgtcgtgtacccgtgtgtcgcggtttcacgcacggtga

SEQ ID NO: 10542 - DNA, 1501 bp, Oryza sativa
agccgacgccggccgcgcggggagcaccgcgaccgcgtagggcggcgccgcgtggatgaggctctcgatctcgtccatgtccgactgcgcggacgaggagtggagcgggatggtgtcaccgtgcgacatcgcggcggcggtgtgcccaccggcggcgattttaccgtgcgatcgcgagtcgcgacggcggcggggagagagggtggagacgtgtgcgcgaatcgcagaaatggtggtggtgcgcgcggtcgtgtttttgtgcgacccgacccgatcgtgtttttcgctagtggggcgtggaatggatccgcggctcacgggcgacacgatgcggggggctccgtgcctccgtgtacgacatcaccgtgcgtgaaaccgcgacacacgggtacacgacgccacgcccggaagcacgaggtgaaacggctcactcaagagtttactgaactgtttgagggtgaagttatcgtcaccccccacaatttaattgttatcgctgttaccgcgaaaaccttatgattactatgagatataaggtgactttaaaaattaagttaccacatgtgatagtcacgattagggacgaaaacggttatcgaccgatgtcgtttccgtataagaagtaccgttttttttatcatactgttttttttgttatttataaattttgttttttttctaatttctatctacatcgtattaatatcgatactgagtactaccttcaacccaaaatagtatttttcttgtaacgtttgaccattcgtcttatttgaaaaatttatgtaaatataaaaaaagataaatcatacttaaattgcttttgataataaatcaagtcaaaaacaaaataaataataattctataattttttaaataagataaatgattaaaagttataagtaaaaacataataaaacgataagtattttgagagggagatactagtttaaatggcaagtatgataccgatttcaaccgttttcacccctacccttgtaaaggacctcagccgcgccgataatccgcggccgcgcgcggggggcctcgcaaaaacacaaaagcacacgcacgccgcgcacagcgcagtcactcacactcgcggtctccctccctccctccctcacgtcacgtcacacgcgtcgcgtcgctcgcttgcttcgccctcgtgtcgagcactctctccctctttcattccggctccaaccaaccaaccaccccccccccccccaccacggcgagagccgccgtacagccagcaagctgccgcgcggcgcgaggtcgccgaggctcgggggccggcgggcggatggcgtcgtcgagggtgatggcggcggcggcggcgtcgtcgtcgtcgtcgcccccgcccccgcccccggcggcggccgcggccggcggggccgccgatctcgcgcggttcaggagcaccagcagcggcatcggatccatgaacatggacgacatcctccgcaacatatacggcgaggccgcgccgccgcc

SEQ ID NO: 10543 - DNA, 713 bp, Oryza sativa
tgaaattaaacctcatcgataagatgctctacatacatgtgggtatgcaaatgtgcaattgaatgcatacaagacatgcgacgatgtcatttatgcacggataaacgaatagacatactataattgcatttactctgcacacataaacaaacaaaacgtaacaattttatttatttatgcacgaataaacaaatagatatcagttagatgatgattaatttgaaaagacctcaacaaatttagaggatgatcaaatgggatggagtatatatccaagagtgccaattaggcccgcaggcgaattgtactggtaaatatcagcgtactccctccgtcccaaatataacaggagtatgtctcaaatataataacttttaggactcaggatttatcccaaaatataacaacttctccaccaacattttctttctaaccaatcacaactctccaccattcccctttttcacttcttagccaatcacaacctttttctatttattttaacctacttaccaattacaaccctttaccattcactttttcgacctatctctacttctcaaccaatcacaacctctcgctatttaattttgcctattttttaataaacgtgaccaattctaaaactttttatatttctataccatttttccatgctcatgctgtcccttttaataaccgatactgtcgtactcatgctgtccttttccagt

SEQ ID NO: 10544 - DNA, 1501 bp, Oryza sativa
ataaaaataaagactattgaacgaaaagaccatttaaaacatatgacgagataaattaagtaacatgcctataatggagtagagtggtggcggttgatacgacatataaaaactgttaataaaacacaaaatagaatcctaataacgattaaaaggagagacgataggaaggccgtgaagcaaatgaacaagacgattgccgggacttctaaaaagtaaaaaaaaatccaatgataattatattcgatttttaaaatctcaatgacaataaaaaggaaaagcagcgggcggggtgtataggagtatagttgcagagccgccgacggttgacgggacttctaggaaataaaaaaatgaattccaacgatagttatgttcgatttttagaaccacaatgacaataaaaagtaggcggcgtacgggccgtagagaagcatagtggcatcgtttgacaagacttctaaaaattataaaaaataaaacccaacaagacaatcaactctaaaaactacaaggttcaatttttaaaggttcggaatttctaaaaagtaaaagaaaataatgataatcatgttcgattttaaaatctcaatgacaataaagaagggaggcagcgggcgaggcgtagagaagtacaatggcaaagccgctgacggtttggcgggacttctagaaagtaaaaatgaacccaaacgataattatgttcgatttttaaaatctcaatgacaataaagagaagagatagtggacggactatagaggagtataatggcaatgtttgacgggacgcctagaaattataaaaacgaaacccaacgtgacaaaaaaaactctaaaaactataagatccaatttttaaagtttctaaggagaatgaataaaaatagtggtagatcgagcaagcaaataaagaaggagatgacataaggggtagcaactggtgtgacttttaaaaaactatataattaaaaacacggggatgataaggtttggtctttcaaactcttaagacaatgagatagctatttaataaattttaagtaaaatcatactaaaaatatatgattttatttaggtgctagccgggagctagttattactattgcgcacaagtctgaaacaaccacccggccgtgttttagaaccaaagacagagagagaggtagtacaaagtatataaagactaaaggaaattagagtccacttcgaataattaatgcatggtttctgcaagcacaattgaaatagacaagtcaatgcatggtttcaagtcttcgttgtactgtgcgccaaactttcctggctagaaagtacactgcaaaaattgccatctagtttttcaaagttggaacggttcaattcaaccatgcatatatgcatccaccccctataaaatggccaccccgcaagccacaaactccaccaccaagcaaatcacgtagtccctccacacacctcgtacctcgatctcgaagcttaattactagttaacattaacaa

SEQ ID NO: 10545 - DNA, 1501 bp, Oryza sativa
aaaactacttataatatggaacggagggagtataaaattctacctaaaatttcagttacaattcagaatctaaattaaaaattacacttgcttgttggtggtaaactgctctacaaaatatatatgaattagagcaactccagcaaaaccctaaacgcaccccccccaaaaaaaacaattttggagttaagagtcgacagcgaggcgcttgtggtgacttcgtcaatctcaaggatttactggtccagtcttcaaagatgctcataggggtagaatttgtgtgcgtgtgtcggtgacatgggaccgggagtatcatgacttagagacttgaggcagacacgatcacccacgtggcctaaccccctcggggggggggggggggcgggcccgagggtgatatggccgcccttctctttgtctccccgaggggtcgggcccgagggtgatatggccgcccttctctttgtctccccgaggggtcggaccactcccgtcttggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgccaggacaagagcctccaagcactcgtccctatcaggaagcggcgtggtaagctcctggaaaaggcccgttggttccggtcagatatatgccacgcttcttcctaacctttacaggcaaaatattgtatgaagaagggcgaacatgcagattgttaaactgacacgtggtggacaagaatgaccgatttgtgaccggtctgacaatggtcatgtcgtcagcagacagccatgttcccacgtcgcgcctgcttccggcggaagtggaggtaggtatgggccgtcccatcagaaggtcattcggacggcagccatacaaatctctgtccattaatgaagagaagtgaagtaagaaagagagggagagatggtgcatgtggtatccccttgagatataaaaggaggaccttgcccacttagagaaaggggagaaaaaaggatcccagaacgattgggggctggctcgcactttgtagcttcttcatacacagatccaccaaaacacaggagtagggtattacgcttctcagcggcccgaacctgtatacatcgcccgtgtcttgtgtgatttcactctcgcgaactttccacagaccaagagcttagaacctcacccagggcccccggccgaaccggcaaaggggggcctgcgcggtctcccggtgaggagccccacactccgtcatctggcgcgccaggtagggggctctgtgagtgatcttctgagctctcgcactctttcgtgtgcgccaagcttttcctgttcagcccga

SEQ ID NO: 10546 - DNA, 1501 bp, Oryza sativa; identical to SEQ ID NO: 5893

SEQ ID NO: 10547 - DNA, 1501 bp, Oryza sativa
cacctgccggcggggcgctccctgccgggagttccggcctctttctttttgtcgctcgcaggcctcccctttcgggtggcccgcggagcgccctcgacggcgaggacatgaccctcgtcgccggaacggtccgtcctcttcttcctcctcctatcacgccgccctgtctgagcggcggatccgggggcggccgaagctgccactccggaaccggaggagttccaggtccacgcttcctccttacgagccactcggtccgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatacgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcaatcccggtcgtatagacctggagaaactcggtggggttgacgctcccgtcgtacttctcggtgatggtgggccggaaccttgggggccaacggacgttccgaagactcgccacaaaggctctacagccaacaccaccggccgggggcacggagggctgatcttcacgtccatgtcgaggtgacactctggacgaggaggctccctccgttgcacggggagtacgccggctattacaccggcgcccgatgttgaggcgggcatccggctccccatgctgatcctcccgagtcgacggtgtagacgagggagtggcagccgaatgacgtgcagccgccgccactcgccgcgccctccgccttgatgatacggagccggtggtagcggcgccggaggtcttggtggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcttgaagcgcaccctgaggcgtgctgccgtcgccgtagacgaggaggcgacgctccccgtctcgccgttctcctgcatcacctgcggccggtgacgctgcggacttgtcgaccctctcaagcgcctccccctgcttagggctttggcgcggaggaggtggaggagtacgagctcgacggcgtggattcggctccccgtcgtcgccgctcacactcggcgagaggtcgtgcgtttttccttgctcggccattaggctgaacaagaaaaacttggggcacacggaagagtctgagagctctgaaagcacacgctgagccccctacctgg

SEQ ID NO: 10548 - DNA, 1501 bp, Oryza sativa
cgagtctagacatgacaaattcttccagtggtaggcgacgtacctgtcgatagcgaggtgtacgtggtgacttcgtcaatctcaaaatatatcagcctagtctctcagaagtactcataggggtatttgtatgtgtgtgttcaaagatatgggtgcgcgcgcatgtgtttgtactttgtttaaaaaaatttcaaacattatttctcttttattttagtagatacaacaatagggaggggacgacagtgttatatacatgtgagggtgagggggaggtgaagattatatttttctattttttctaaatgatttatgtgaaagccaatgacaaggtgtttcatttttttatatgaatttttaaggttttctccattttttataggacgtgacacactgtgacttaagatttttttttaaaaaaatagatttaatcgttaaaaataatggacaagtcaatttaattgttttttcttataatttaattacaatatctaatctaatggtttattatagatctagtttacatgcatatacttctgtatatattatgtagtattatattttatctttttctatattatacaaaatcctattttagaccatagttttttccacgggtactacgtacgcaatttttttttgggctttatcattttttatcatacatagatgtctatttttttttcttccagctaacagtaggaagctttatttgttattttaattgcccagccaccgtttgcatatctttttttaggaaaagttatcaccattttaataataaatctaatctaatggtataaataaacgggtacaccaatttaagtgaaaatcgatggtgagattagatagtgccacatggcggcctaagagtatttgtaggaacgccacgtggcggtttaggagcgtttataggaagtttaattattcctagttcactatcggcaccctcaaagacgattgcatcggtaattagtaagttgagtactattatcaattctggcctccattgggccagtctcgactcaaccatatgtgatgaggacatcactttatcggatatgttcataacttcacacgttccaatgataattcctagtccaagtccagttcggccttcggagacagcactgactttaaacggacctagcgccttcatgccaacttcgatttgggtgatcttggacttcatggaaagcttatctcgctacctttcaaacgcatccggtctcatgtccaaattcatctcgagatgatggaaatcgccaaaacaaaacagtgctgttgctgaaaccgaacttgggccttgggctttgtaatagattagacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgacttt

SEQ ID NO: 10549 - DNA, 1501 bp, Oryza sativa
agcagcttcccattgggggaaactgccatcttctgcacaggtccaatctccagctccaacccgagtgtctgcacatcatcctcatcaaccgccagcactcgatcaccaaccgcaagcagtacctctgggctcccggacatgacaaactgcggctccaccacagccatgcacagcacctgctcgtcctggccaacgcaagggtcggcgaactcacgcgggtgagggtccgcggcgtcgatgtccgtggtcaccacgacgcggttgtcctccgtgaggacagctacgccgcctccccagaaggcagcgtcggcaacgccgccggaggacgtggggagcaggggcacgggggtggggctagggttgggcttcagatcagggaggcggaagcggaggagggacccatcggagagcagcgcgacgaggttgagggagctggagaacgcgagcgagtggaggcgggggagctggggcggccacggggaggacgcgatggggtggccggaggaggagtagaggaggaggcggcgccgcgacggctccgagtggagctgcacgatcttcgagtcgtcccggacggcggcgatcgggcccccgaacggcgccgcggcgacgatgtgcgtggagaggtcgaggcggccgagcacgccaccgctccccccgccgccgccgccgccaccggaggtggaggacgaggacgcggcggcggcggaagggggcgaccagggcagcggggagtagacggtgatgcggcggtagaaccggtcggagaggaggtcccactccgccgcgacggagacggaggaggacatcgccggcggcgaggcggcggcggcgtcgcgcgcgagatgggctgtgaggaaggaggtggactgtctcggggatcgagacgggacggttagtcccctgacatgtgggtccaatcggatgggaacgagctccacacggtagcccattgaaaagcccagatgagacgacaatgagcagcccacggatgcggggtgcgggagaaagcggcccaaacaaactaaccacacaagcaaaattataggagtagaagtaaaattgctaagatcctcgatctgcaagttgcacgggctgctattatagactacctagtgggggattaccacgtgaagtttataattcattgggagttagatttaatgcgcaactctgaaattttatatgtctatatgtaacattatatgtagaagtatatttatatttcatatacaactcttaagttctatttctataagatctggatttcatatacaacccttatattctagtattactatatgcttagattttatatacaactcttgacttctatttctctagacataattgaaatttgtatacaactatatcaattaatctatacttttaatttggacacaccatgatctaatgttaagatttttttctttgattaatgttgggtgagacgcgctgatgatggtgaatacgaattttcgtggcaggccgcattgcgcct

SEQ ID NO: 10550 - DNA, 168 bp, Oryza sativa
atgatgaaattgacggaactgctcgatagggcaacggaaagagattttagatgctaataaagcgaatgatgaactttcaatgctataaagccaaaaacgaaaacttttgttactataaatacaattttgccttaaaactttattgtacgtactttctatatctaaagt

SEQ ID NO: 10551 - DNA, 272 bp, Oryza sativa
gagtttcggatggtaaccttgaagcatgtatctcgagagcaaaatattgaagctaatgatttggcccaaggggcatcgggatataagccgatgatcaaagatgtcaaggttgagattgttgcattaacagccgatgattggagatatgacgtacatcaatatttacagaatccatctcaatcggcttcttggaaactgcgatataaagcgttgaagtatactttattggatgatgagctctattatcggacgattgatgtggtgttgcttaa

SEQ ID NO: 10552 - DNA, 1501 bp, Oryza sativa
ccttgtgccgctgaccggtggggcccgcttgccggcgccgcccctcccctttgatgacgtcagcgaggtccatttcctttgtaaaaataaataataattgcgcaataaatcgagtttaattatataaatccatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagttcccgtcgtttcggaagtccgcggtcgcgaggaaaagagttcggaagatcaaagtgaagaagcaaggcaagtcacacattctccttgagcatgttgatcccaatttataaatgttttaccgtttgcaaataaatatgcatgttttgctaattacacgggatcagggtttacctatctgctcgcttgtgccatgtttacttgatatctgtcctttgtcagccgtgggtaataaatcgcctagcttgtgttactttgatgacctagctagaactttatgcttagccatgcttaattaccactagctcagtcgatgggataattgcagtattagacattctagtttcttgttgagccgcgtgctcgagacatctggccatgtttcatggtcgtaattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggcgtagcgttgatcagtggagattcaatattactttaattactcaactgttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagat

SEQ ID NO: 10553 - DNA, 1501 bp, Oryza sativa
tcagtatccttcgctcctccctcattcttctcagcctcatccgctctctcgccgctcctcctaagcccggcctcctgcttgtcaccgctcctctccgcgcctcccactgcgctctccatgctgcccaatgcgcatcgccctaaagatgggaagagtgtcagagtgaggaagcgaggtgggagacaggggcggagctagagcgaaatggatggtggtgccacttgcttaatttactctactttatatcgagtttaaactgatgcgggtacctaagtttgtattgagggggtgcatacattgagaaaataatgaagtatagctaaaatttttttttgaccgggttcctaaggcacccccctaatatatactagctccgcccctggtgggagaggagggagaagatgtggccgatgacatgtaggtcccacttaccacgttagtgaaaacagtccactatactaccgatgaactaaagttatattgtgagttgggggatgggcaatacccggtatttctatccagggacgaatttcagactcagtgacaactgaagggatctaaagtgaacttattgcttttgtgatggtttcagcccatcggtagcggcttcggttgagagacacggacgcagtaaccggcaagcacctcgctgaggcccagctcgctttccacaattactcgtacatcgacatcggtactccttgggaagagcagctacatgtcgaacccgttgttttatggacttgggagtgatgcctgatgcggcgtttgctcaaccttgtggaggatttacgtgatcctcttttcctcagaggctcagacgtcagtgttcacgctgttacgtacgcccgcggtcgtcacgaccgcagcgagcgcagccatctccccccctcaaaaatattcagaaatgtgtgcaccgatagacacaccggacccttgctcgtcattcgcttgcgaactgaaaaccaaacgaccggtccgggtgacacatgcgttttgccccggtcagcaagacgaaaccaagacccggacaacgccaccaaaaccgtctcacgtcaaaatcgccaccggctcacggctcgcccgctctcgttctccaccttatcacccaacccgtcgtgccaatccacacacacacatcgttgcagcctcgcaccgcccgataataatacgaccaaaccaaagacagagcagcgcgacgcggggggcaacaacccgcagctaaccgcggcgacctcgtccgcaccgcgccacgcgaccacactccacacgcctttcttttcctttttcccccaaaaatccaaagcaacctcgcccgaaaagaagagagaacgcgccgcgccgcgccgagccgcgtgggtataattgaagggaagcggtgcgctcgctcgctgcatccagctcaacgcgcgggggaggcggagcgaatcggcggatcggtgggttgcgggcttgcacgtagtcgaggctcgagaggagggggggatggcggcggcggcgg

SEQ ID NO: 10554 - DNA, 1096 bp, Oryza sativa
cccggtctggttatgccctggacttggagtaggagtgtagccaggggtctcggcgcggttttcaaccgctcgttcgcagcctttccggccgcagcctccgccccctcttcttcctccccttcctcctcgtcgtcacgctcttcgacgtcatcctcgtcgtcggcgtcagaatcggagcaagcagggacccatcgctttctaggggccagtttcacttgtccacgcgtccctttcgcgaaggccctgcatcgtcgtcggccttgtgggggttcgcccggggaggcagttcgccgtcataaacaaggttcgcccgaccggcagcctgtcgtgtgagcagctggctgtactcgatgaccgacacatcgccgatcatcttccaggcttcagcgtcggcctgatcgagagtcaacactatgaaaataaaaggtgtagccatattaagcgttgaaccgggaaaatagcaaaacacagaagtgcatagcgaaagcgtggtctcaccattcgtcccctcaggaagaaccagcttcggcaaaccgtcgacctcttcgtcttggtcaaccgtgacttgccacgacagggagaggggaaaaatgtgaagcatacagaactcctccaccaagtcgcggcagctgaggcgggagcagaccttgcgtagcaaggcgaaccgtgcctccattgcgccgtccacggcgatcttgggtttccggttcggcgcaatcaccatgcgccgacatcggagggccttcgccgactcggacccagcctcgaaggggatggtgtgatagaaccacctcgccatctagtggcgatcgcacttcgacatggcggcattcacaggccagagatcggagcgcttggggcgaacgttgaagttcacgctcccgaacaccgtcttcttcgttccggccggggtcaccaccatcttcgaattcatggtggcaaaaaatatggcgccgaagagttcggcgctgggttcaaacccggaggtccggcacgcctagtcgaagatggcaatccggactagcgccgacggtctcaactgtgggaactctacctggaaaaggtgaaggatctccggcaacaacatgttgcacgg

SEQ ID NO: 10555 - DNA, 672 bp, Oryza sativa
cgaatcacacggatttgagggaggaagggagtagggtttcacgggaagagagagagaggtggccgggcggaggaagaagacgacggcggcctggcgcgtgggccccgcgcggccaggcgcgctctcagcgcacgcgcggcgcacgtgcgcgggggggggggaggggcggctcgggcaggagaggcccggctgggccgggacacggcccatgaggggaggagggggaggcggcctgggccggacaggccgggaggggagggggggggaaaagaggcagcccgggagagagagggaggaggagggagtgggccgggaggggaagggggcccaagaggagggagagaaggagagggagagaaagagagggaggagagaaggacttcgggtgggcttggcccaaaggaggaagaggaggattatttttagattttctttttattgaactttgataattgttgttgttgtttaataaatatttccggtgctctgaaaattcaagtaaaatttgagggctcattttagaccaaggagaatttaacaaaaattctccgggtcacatttgaatttttcttgcacgtattttagtgtttgccaatttcttttcgaattttaattaattctattattccttttaggaaaacgaattttaattcggaatggatttatcaggac

SEQ ID NO: 10556 - DNA, 1438 bp, Oryza sativa
agattaggtggagtccttaagtcaattgtaatcaaggaatgaatcaaaatatactcaggcaacctttaggcaaaatatgaatctcttgagttcttctcgccaacctttagtcttcactcatcccaaccaagctcgggtgtgtgggtttcctaccaacctttactcaggactctttatcctctccttaatataatgatacacagatctcctgcgtgttcaaggcaaaaaaaaagccaacgtcgtctggctatcttaccagcggtgtttatcccccaataaaaccttgcctataacacccactatagtgttgtggatgccacaatttgacgaaactactaatgttggcttatttgcatcatcttagatctcgacacccatgtatcaccttaagtttaacgaagcaaacaaattaagtatttacaagttttcatgcctaaatagcccaacaagatgtgaggtcatcagacacatcagatgctggacagaaagggtaggattgtgacgagagggagctgggctatttgtttgccgaggctgcattgtgaggagtgctcagcgcgaccgagcagattgcttggtacagtaaagaggtctcggcgcttttagttcggggtttgattgattggaagttatgctctcaaatatacagctctgcttttattttgtcaccttctgttgtgttgtcaattattatgcttttgaaatttgaaaatctaattagctagcacttctcaactgaatgtcatccaactagaactgatttattttatttcattttatttatctagttatggtagtgcatgttctacatttgttgttgatagaacaaatagtccaactgcagtggacactgtttatgattttgaacacagttctgtcctgattcgttgtactaggatgtgttacatccagttctagattcgttttttatgggacggtgagagtaattgattttgaacactgtttatgatttatttatgatctatacgcctatacctagttaaacatgtatctacttcacctacaaagtaaaatggaccgtactaatcttaactttttaaaataacttaatcttacatgtatctctatctcagagcaatataacttgaactacaaacttactgggtcttagcctgcggaactcctaaaattcctccgccatcctttgatgcaagaggatttaatttggtttagtagttatgtcttttgaaacaaaaatgggccgtcacacaacgctgaaacggttaataatactatttgtttgacttattctaattttttgcagtttcaagtagcatttattctacgtgatcgagattgagaaacgagcagtagggctccctctctgcggttctatatcatctcacacggcaccaataagctttgcaccctggtgaacattgggctatcgttctatggcccttgctgcaaccagaga

SEQ ID NO: 10557 - DNA, 1229 bp, Oryza sativa
gaaacatttgtaacaagtttgtggagcaagtaccacatttaaggcacgtttcaaccggaatgattggataaatacaagcaagagaaacacgcttatatatttttttaagatataaaaattttaggtgtttacttcgatagaagatatacaaaatgcacttatcatctcaaaataataaaaagggttaaaaaacaacaaaatccagatgaaaaaacattatttagaaagcaattgtttgtttaaatctccatccataaatagtggaaattttatgaccatcttctttagattttgacatccaagttgtatgtttccttatcatcctcatacttgtgtagctggactcggaattaaatctatattatctatatagttgatgcccactaacttctaaagctcaatatgcaagtgtaccatattatcacctactagcaattattatataaaatattttaaatcacatgtaagcgtgtattttaaatataatgcaaacatgacatattatttacaattttgttgtatttttagaatacaatatgcaaaaaatgtcaagtcattattttcatattatctaaacatatacatctatcatttttataatgtataacatgcattcgttcacatatatgtaccgcagcaaagcggggagtatcaactagttcaataaataagcaagagcaatatcatgtcatggtttattttcatattatctaaacatatacatctatcatttttataatgtataacatgcattcattcacatatatataccgcagcaaagcggggagtatcaactagttcaataaataagcaagagcaatatcctgtcatggtttagaggaaccatttcttgaggcagtaacaccatcggacacattctaatcttttagagaatggtattttgtacccggcctctacatccaactggatgtatacggctattaaaatagggaacttagccccgtaaacaacccaatctaaaattcgcttatatggagatttgaactcaagaccttgtgatacaactcaggtcactgcaccactaggagcattctaattggatgattaaatagattatggacagataaactcatgtaaatgaattaaatatcataaatgctctgaaaaaaaatcatctaattaaagttgatataaaaagcttctgaagagattgtacttaagagaagcatggcgtaaataatcgatatctccattaacagtttagaaca

SEQ ID NO: 10558 - DNA, 1501 bp, Oryza sativa
ttgacgtttcacatcggattttatataggatgtcgcaaggggtgttcgggcactaataaaaaaactaattacagaatccatcagtaaaccatgagacgaatttattaagtctaattaatccatcattagtaaatatttaccgtggcaccacattgtcaaatcatggcgtaattaggctcaaaatatttatcttgcaaattaatcgcaatatgtgcaattagttattttttagcctatatttaatacttaatgcaggggttcaaacgttcgatgtgacggggtgtaaaagttttttttacgttggatctaaaatttttagtggtagtcttcaattcaaaacacgtccaatcacaagaacagtttaaccatcacatcgaaggtacagaacacaaacatcgacggatccaaactcatcaacctgaccccgaatcccactgccacacgggccccaaatcccacggcccacatccccccacccacaccacaggccgcggatacttcactggattcccaatccgacccaacccaactggcacgccaggcacaccaagtaccccaccaccaaccagggccccacactcccaaactcctcccacccgcacgccgccgttgccacagaagatccacgcccagttctacgccacctatgaacacgcgcgcacacacgccgcgcacatacatgatcaaatctcattcgctcgccaacgccgcaagatcgagcgaaccccagcgaatccgagcgcccacgcagccacatcccatcattattccgcacctttcctcgctttccttcgcacactcccggactcctctcctctcctctccccatcgcgaagagaaaaaaaaaggatagcaccaccaacaccaacatacacagcggaagtaagcagaggcggcagaagagtcaggcagccagccaggagcagcgaataataaaggggggtttttattaggagagtagtagtagtaacaccacgatggaacgagcgatccaaatcctgaccagtccggatcgagcggtgaaagaacaggtttggagtggcctcccgtgttgctcctcctcatcctcctcctcttttctttcgattcctcttcttccccgcggtctctttcccctctcgcacgcaccctccttctcctcatcatcttgctcctcccctcgttttgttgttgttgttgctgctgctgctgcggatcgaggtcgtcgccggattcggttcgggtcgtcgttggcccgtgggctatatatcgaggggatttaggtttgctggattttggagtttgtgtgttgaatcgatcgtgttggcggcgggcggaatcggcgaatctagggtttgggattctcgatttgattgatcgggtggggggatggattcgtccggcgatggaggggacgagggagcgggagctgcgccggctggggtggaggaggagagccctgccccggcgtcggctccggctccggctccggcttccgcttccgctcccgttcccgccgccg

SEQ ID NO: 10559 - DNA, 1278 bp, Oryza sativa
tttttaggttgattttttttatcggagtactaccatgacaaaccaactggatttgatgtaagcataacaagaaaacaaaaaacgttttgaccctacttaggcccacacctcagcctccgtgccatgcatactctgtcgaaagcaaccaatacgaagtgaggctttcactgcgtttcactaattaatcgcattgatttgtccctagtagtggggggaggttttcatttcaggtggaacgaaatgcatcaatcgatcgagtggatcgggtccagtagtccagcactccagctgagctgcattccccaaatcctcctgctggactgccggcaggcagctgagaggctgaggtggtgtctagaaatgagggactaaactttagtcactctcacaaaaatataattccctagggtaaggacttactctctccgttttgaaatgtttgacaccgttaactttttagcgtatgtttgaccgttcgtcttattcaaaaacttttgtgaaatatgtaaaattatatgcctacataaaaatatatttaacaataaattaaatgataggaaaagaattaataattacttaatttttttgaataagacgaatgggtcaaatatgtgctaaaaagtcaacggtgtcaaacattttaaaacggagagagtatgtttttgtgagagggagtaaagtttagcccctcccacccaaaaccccctgagacgagcgagaggaaagcccgtgcagcggcagccatgatgactgcctcttctctccattttcccttttccaacgcccactgcatctgcttgaccagccacggtgcctgccgaatgggacgccccagataagccggattgttcgtttgggccacgacacgcacgcggggcctgcttcggccgtgctgtttacggtcaaactcatgactgaccacccacgggccacggatcgatattaccatcatctatctcttcgtgactttgccacttcagaccttgttttgggagcttcttgaagtagtagcaattcttcccaaaatcttcggctctctccaaacaatcagattatcactctgattatgaaaatctgtatcaatataatctagaagatgaataaggtgctgtttgaatctactgaagatgaagataaagattaaatatttcacgtaaaacgaggtggtaataatgtgtgattaattgagttttaattattacaaacttgaaaaatggattaatctgatattttagagcaactttcatatataaaattttcacataaaacacaccgttt

SEQ ID NO: 10560 - DNA, 1501 bp, Oryza sativa
ttcacctctttgatatataacacatgtaattcttgtattgatgttgatcagttgatgatccttggatgtgaccagaaaagccttttgccctcagcatccacaagtaattaacgtacgtgcttatccatatacgcagaggtgtgatcgatcgaaccaatccgatcgagcccaacccaattaaacggctgtctgcgtgctgatagcccattgctaagcttaggtctaaaagcccatttcagcagaatgatcgtgccgttgtctagctctgtttttatccatttgctccgtgacgacgtgacgttgttgcctgtcgctcttgcagacacagatcatatatatcggcagtaaaaaagtacgtagcaaaacgctcgacgtctgtgtaaaatcaccccctgtaattgacgattcaggagtcgacaagaggctcgaattgcagatacggtggtcgatcaattaagctaggaggatagctagtgcctaagcggcaaaaatccaccgtgcaattcaggatatatattggttaagagtaatatagttgactaagtggctggggctgtatgccaagatagattttagatagagatgaaaaaccttttaagattaaggcccgggtcgatttgacatgtaacgaaggtgcgcgatagcacaacccctaaaaatttggagccttaaaatttccatgttttacttcaaaacaatgtatctcgttctactgatttggctagaatgagtttattttctgtttaagtaaagaaatcgaataaattgcatcaggacccatttgtcgttgctggaacctcattttgtgttagcagcggtccctaacaatttaggtacggccctgggctctagtcctggctcatatacactctgattttctctctttttaataaagtaaatataattttctctgcactaactaagaatacacgtatatcgcggtgtggttgtattttctttttctggtatgtgctcttccatgactatagattgtatttttctcctgctttataaatacatgaaactcgcactatcttgtgcggttcgtttcaaaaaaaaaagaatacacatatataactatatacacctctgtattttaataaatcgtgctattgactttttgtcacgtgtttgacgattcgtcctattataaaaaggttacgtaattataatttattttgttgtgagttattttattacttaaaataatttaaatacgatttatatcttatacatctgcatgaaaattttgaataagataaataatcaaacatgtgtttaaaagttaatagtattatctattaaaaaatagatggagtatatatttctggacagcaaaatttgaaacatagtacgtggatatacgtggtcatacacccacatctgaacctgttatgtttttgcatgtacgtactgtgaacttgtgatgaggcgtgatcagctgcctcactcgcgctctctatataagctagccgatcagggagtacgtgaacgccatcag

SEQ ID NO: 10561 - DNA, 1501 bp, Oryza sativa
gtcatcagccaaaacgcgggtcagtttgaaatatttgaacgaactgttagtactataatttttctatttattatatagataaataaacttaacaaatgatttgtaataaatggtccaaacaatacagtagagaaaagtatctttttaaaaaaaatgtgtttttttcgaagcgttaaataactaatccatttcaacgaatctagagataatactgccttcgtattttaaataggtgacattgttgacttgaataacgtttgatcatttatcttaaaagttgtacttaaaagttttccaatgataaaacatgttccagcaaaataaattatatgtacatattttttttaataaaacgagctggcaaatgtcacgaaaagtatattaaattttaaaaacaatgagtgtaacaggaccgacgtataggtttgagtggttttctttcttataacgcttaaaagccaaaaaaaaaagtcaatttaaaagcctaaaccaaccagattaagatctcgttcttttctctaacaagagttggatgaatatgaagataaagattttcgtgtcatgtttttcaaactgctaaacggtgtgtctcttacgaaaactttttatatgaaattgctctaaaatatcatattaatctatttttcaactttgtaataattaaaacttaattaataatacgttaataccacctcgttttgcgtaaaaaacttaatcttcgtcttcttaatcttcaggggaaaagaacaccacctaagccaaaacaagatgcagcttagttaccctctgacactatcttccgttttgattcgatgttagtcgtcagtgttgttatctctatctttaacgttgtattataagtagtttttttaattaagccgtaattttacaatttacagtagctataataactggttatagtttatttttgtcagggttatagataccacatacctaatagtagttgactaaatctcgacaggacccaccacataccatgtcctatacgaaaacaacctgcggatataggaagagttccacataaggaaagacaaccagagttctacatggaaacgacaagtactactcggattatatccatattggttttcctagttctacttggacaatgggacacctatgagtataaatacaaggccccctaggaggagaggagacgaccacctcaatcaacacacccaccacagtctacggaacaacagaagatcaacatacaagccaacatacaccaagacaagatgccggatatcgaattcagggataagtacggctagtcccctacggtgtctccggatactgtcaagagagacaaaagcgctgtctctgatctcgccgggtacggattcgaggaggaagactacctgttgtcgactacgagtcagatcttcagaccgccatgttgacaaaagttagataggctaccccaaatattgtactggtgtgattatggtgaataagagcaataccggcttcggccaac

SEQ ID NO: 10562 - DNA, 1302 bp, Oryza sativa
tttaaagatacttctatgctcagagcataatagtgatttacactgatcttaaagcggttcggcaattctggaaccttttgtattgtgtgcgtaggttgttcggttttttgctttcatacgagtaacgtgagccctgaaggggcggaggacgcattgccaccgcgcgcgcgcgagaggccgggcagaggcagagacctcacgcgctacgcgttgcatctcattctcgcgcgcagggggcttcgcttcgctttgccccggaagagccgcaggatttcctgcgtaatccaagggaggaccggccgctggctgctaccgtgctcgctatgacctactccagctactcccaggctacaggccatgccatggacgagtgcccggaccggacgacagcgagcggcagctagctacacactagtacgtagttactgtagtcccgcgtcgcacggcatccggccggcctctcctaactccgccggttggcgggcgggtcggtggacgacgcatcaaccgcgcacgtccttgcgttggcccgacgagtgcctgccctgcaaagcttgcaaagggttcaccgatcctcgtaccaaattaaaatccgctcactagcagcataatcagatttcgtggagcctatcgataaaccaataaaaaccgataaaatctaaaaaaagatttagataatggaaatggattacatctccggtctctccatgtgaaaaatccaaataaatttgattaaaaagatataattcagttttattttttgaacttgactgaaaaactaagtggtttgtgtttctcacccgctctgaaaagtcctgattttgcgaaatccaaaccggatttcactaaaattgtggatctgcctgcaactagtaggctggaaatgaagcatgatcagtagggaaaactgatgcaccttcagtaaccgttcgggcagtgggccgcgcgaaacccagcactcagcactcagatcatctgcattttacagtggtcttagcactgagtacaatcaagggagctcctgccaatgcatatgcaggttttacggtacggcatccatgtgtgcaaatcatcatccgcatgcaagggtcagatcgctctcccaagtcagtgaaggtcacagtgaaccttttccggttcataattgcccggctagccgccgggagtccggtctaagtcgccgggtctgactctgaccaagatgttcgacctcgacatctgactgcaggacaatcaatatatctttggaccaacccaatgaatgaattgaacttgataacatatccaagctaggattaggag

SEQ ID NO: 10563 - DNA, 1501 bp, Oryza sativa
ttacctccatggtggatccatcctcggagacttgttttgacgggacaaattcgacgatgtgatcggagactgacaagagccagtcgatctccctcctccaccgcgccttctgatcggcggccatcggctggaggcggcgctgctcgccgaagacggaagctggaatttagcaagaaacgaagcatgcaacaacatcatcatcgaaccagagattcttcttttcttcagaaaaaaacagaagtgaattacacactacctgcaagattggtgatggcgttggagagagcgagagcagaggacacccctttcccggtgccggacatgtcctccccgagtagaagcttcgagaacttctccctcaccatctccgcgtctgcaatttccggacgaaacccatcatttcttgaacgagagatggcaacaattttggccggcattgatcatcccagaagagatatatattagtcacctgaaggtgggccctcatgcagcgcggcgggtgcgggcctcgccggcgccggagccgacgacgtcctcggcggcgcctcctccttatccgacgggccaccggccagcggtggcagctcgaacgacagcctccccctcgaccccgagctcctcgacagcgcccgcctcgccgcgggcggcatctccgggtccatggggctccccgggtcgtcgtcggacaacgccgccgccgacgacgacgacagcgacagcgccagcggcgacgacgacgacgacgacgtcgacctccgccacctgaacctgtcgaggccgtgcccgatcttcagcagcggccgcgccatcaccgacgacgcgtcagcatcacaccacggccgaggcgaggctaagctacaccatttcttcttcttctctgtttcttttccttccgttttttttgcctgcctggcttggaaattcagggacgttccaaacatggagcacgagatatttatagctgcgtcaggctgtagctgggatgaaatttatacgtacaaatgtacgtattcctatatttaatcctcgcgtgattaattcagcacgtacgtactccagtgtactcccgcccagtaattgctgtgcgatgtgatgaacagcagtgtactgcttatggtgatttctttctgattgtttcagggaacaggagggatcctgtgcgtctgtgccctctgtcccaaggtgaaaaatgggagttgagacagaaatctcgatgtaaattgtcgatggaactgtagaatatttttactactctatccgttttatattactcctgacattcataacctttttattcgtcaaacttctttgagtttaactgagtttgtagaaaaatataataatatttttattacaaaacgaaacaaaatattaaaatatatttaatgtttgatttaatgaaactaatttgacgttgctatttttttctattaattttattaaaccttaaaaaaattaactaagaaaaaaattaagatttataatatgaaacggagggagt

SEQ ID NO: 10564 - DNA, 1501 bp, Oryza sativa
taagtgattttttttccaatttcttgtagcataaatcgttgccaaacacaacctcttcctccatacctccacacaaagttgggcaatatttcagcccaccaaaaaatgtagtaagagcccatcagtagctttttcggcgagatggcacaattgggcctcctatctataggtcaacgttggctattttagcgagacagaccgagtaagagctcagttatgaaagtgggttgaagggggagggaacggcgagcaaaggataggatacactgacgcgcgcaatcaaccatggcccatggatgatgatagatcacagcgatgcaaagttcatggttgcacggaggagacagagaaaatacacatggaatcatgcatttcatgtgatttcactgaactataattggctgcgtgcatcatgctactctaggcagcaagctaagcaagtttggtttgggtttgggattgagcatgagagggagagaggaacacgtgagctgagctgctgagctaaggcctaagggtgcataagcggctaacccgtgaagcttatttatagaccaaaataaataattgaacccgcttattctaatctacaagtgagttcgcaggttagccacttacactcctatgctaagccactgtggataagtggatggatggagtcatggagaggcctcgagggttgtgatcaaggtggtgcatatgtgctctgcgtggccggtgatcatggcccaagtcaatcgtcacaagctccacaagctcttctggtaggagcaaaactattttagcataaaccgtgaagcacaattttaggaaggacatggagtagtttgtaaacattgatagcatttgtcaaacctcattcatagataccgtgtcttcacaatttatgcgatataaaaaggaataatataaagaactcacaaataaggaatttaagtttggctcatttttatgaaatttagcgggaataataggtgtatcaggtataaaaatgacacttctttcatccgtatatagaaaataggttgtaggtttgtcgtaagtctaactatgcatccactaccatttcgccgtccacttgtcattcttttcacattgttccatggctacaacaagccaacagctataatattaacccttttcaatatgatgacaaaaaacaaaagtaggtggccgcttgccaacttaaccgcactcgccacttctcggttgtcacgcctctctttcgtaccgtcacttatggtaacgctagctactttttatttcagtagcatcacaaaacgccatgtagactctacttaaaagacaataataatatcacgcttataaagatggctacaatatagaagagatagacttcctctcaatcctgtatgcacccagttgtcatccctatcaaaaactactcatcttccatgtttaaaccagaatgcatggcatgcattttccatgaactgttctagcaccacccttttccgttacccttttgcctcgtactggc

SEQ ID NO: 10565 - DNA, 1501 bp, Oryza sativa
gaaatggaggaagtaattaacaacaaaatatattatcgctaatcaattactaatagtcaaaattagcaagggcagatatcttcatatatctttgtggaatatttcctctctcgacgactcatccagcccaccaattaaacacactcaaaagttaaattgccatctcccatggagagatatccctccaaccaaaagttgatgcattgtcagtttgtcgcaatcatgcctctttgtgtcttaacctttttccctcttccccatgcgaccatgcctccccgtgagcgatattggcgttgactcgttgggaatgctctcttttcatcctcagtgcttctcccatactacggctgatctacttatcagatcagatcatgggaagctttggaaaaaggacggagtggtgtttgggcaacagaggtggctggatcttgccgccctcgcttcgtgtgggaggcttacaacgaggaacgacgcttggaggcggacatgatgggtgcactttgatctgatgcacgaaagaagtgatggtagttgacaaagggctattaacgtggcggaggaagcggcataaggtcccttgaggtctgcttcgaatggagagctggtcagtggaggggcgccagcttggcgaagatcgcatactggtagtagtagttgcttggtggtagggtgacagagctgcaatgttaggggagggcctacaagtgaaagcatagcttggtgatcttggtcgacaatggtgacgctttgggcgttgtgatctctcctgagggtgttgtcgagatacctccctctccttcctagtgagattctttacttgaaagccaagtgtaatcagtggataggtaggcaaggcagttgtggtagtgtttctagcaccgtgacttccttggaggcattgtctaagaagccttgtctcttaccatctcagccttcaaatggtttattctgcgcacgacgcacttagatgtcgccattgagtctttgtgggggacgagtgaatcttctctcacgctctcccctcacaacctttctctgtggcaatggctggatgtccatcagggtttggctacttggagctggtgatgggcatagcgtatttgacccctttgtagggctagcaattgtcgactgggcttggtgctagtttattttcttgggagtgtgtgggctagcaatcctagtttttgcaagaaaaaaatactttagaaacatactaatttattttttaaaagttttaaataattaatacttaattaatcgtgcgctaatgatttttctcattttgtatatcttttctatcttctagttcgttctactctaaaatacaccctaagttgggacaatgaagattaaggtggtgtttgtatctcctggagataaaaatgaagataaaaattaagtgtttcacgcaaaacgaggtggtaataacgtgcggttaattgagttttaattataacaaacttaaaaaatggattgatctgatattttagagcaactt

SEQ ID NO: 10566 - DNA, 226 bp, Oryza sativa
cctcaaggtcagctcaagattcaaccccccccccccctctaatctcacccacaaacatgctactaaatcataacctctcatcaacaacaagatctacaaagaacgcatcataaagatcacgaaaggaggacattttccctcaccacaaccgactgaatcaaccgaatctgtagattgaaaacagagagggaaagatggatcgagagagagagcggaggaggggaaa

SEQ ID NO: 10567 - DNA, 1501 bp, Oryza sativa
ttcctaatatcggcgtcttgattgtatactacgagccgtcccgtccccttaattttaataatactatttatatatttttaaaggaaaaaggtaagggttgttttaattctctttcctacccaaatttgtgttgcgtttagcaaaccaaacattccgctataaatttgacattatcaatattagcactgcagaactgtattgctaacacagattattgttcatgttagctgtaccacaggtgcagccaattctatacccatcaactttatcgaaccaatattttagtagtgctataacaaaccaaaacaggatattatattgccgcgggatattgtcggaccaaacatcccaatccaaagagcctttttactgccggtgtccacctgagcccagtgcttgattacgcggctagcttgttgttggttgccctatcaatcggaacgtccgcgtcagactagtgcagtgcagcccgcaactgataagcgatcaacttgttcccgacgcgcgtactacgaacaaaacacgcgcacgcatcgctgcatcagtttacgcctttaaatatttggagttccagaacccccactttttattcccccgttcctttcgcattatgtaatccatgaggtcatccatcacttgctcgttattagtagtaagtagtagtagttgttagctggagtggtagtggtacacgattagttcaacctataataacagcccgatccgtgatttgtacacgtactaattttttcttactaaacttttactatcaatcatctgaaccgtttaatttaagtagatgaaagttatataaaatctagatgcacttatagaatgacatatcagtgttagtaagaatttagcaagaaaaaaatagtcgtcccatgtaatattggtgtctgaacaacttcttcaaaaaaaaaaaaaagtatctgaacaaattctgaagcctgattagcgtatccgctgatacattagcggaaaccggcgaactgccaacatcccctgcccccatctggtagctatctcgtcctccgtcctcacccgccgccgccgcgaccgcgagctaaaccacggcaccgccggcgacctcgtggacctcgcctgtcgccacatcatcgctgccgtcgcctactcgcctcccctccccgaccccgacccgatccgctccgctccccatttgtttattccggcgcgtgagctaatcaccgcgaggtccaccgccgccgataacacccaagccaagcgcggtcgcttccgcgtcttgatttcctcctcctcctcctcctcccactcgcgtgcgtacctccgccttattatatagcgctggcctgggcggggcggaagagccaaatggtggcgctgcttcgctcgtgccgccgcctgatcccgcacctgtccgcctgcgccgccgccgcgccgtcgtcgtcatcgtcgtgcgctcctcgggctaggccgatctcgcggggactgcggctgctgccggtggtgctcgcaatgg

SEQ ID NO: 10568 - DNA, 718 bp, Oryza sativa
cttaccggttggtcatcttcaatgcagattaaattcgacaaattaaagctaaatcaaaagggaaaatcataggaaaaatgatgaggaaggagtgaggaatctttttttgcaatcaattagaggaggaaatacatgggagaagcagatcgacgtcgcgacaacgctagggtttggcacgggcggggcggaggcgcgctgcacacatgggatcgcgtgggaagagatatatggaaaaatattaggtatagatagatttagttatacataataactataactatttattacctaataacttactctatggcctatcacatttggaagattatggctagtcattacacaagttacttttctagtaaaagaaattatacattacttgggccggggccatgcaagcctcgatgatttcagcccgctcgttgtccgttatatgttaatctatccgatacttgtaatacttttatttcttctcggtaattaaccgaataagcaaactggaacagaatcggatcgggagacaagaaaaattgacgacgtacgaatattttaagaataacatcattaatttttataatagtagagataaagataaagaaaaataaaaaataaaaaaaaatcttgcaaccggtgggatcaggaccccctgcagttgtaatagggactgcaactttagcagtcgttgcctcaccgttagatcaaataagaaaagctcaga

SEQ ID NO: 10569 - DNA, 1501 bp, Oryza sativa
gcggcgcactttgctaccagggcgtcctcgacatcgcaagatcgtagcagttgcttacgtcaaatagctcaaggcagcggcgaatctagaataaaaattacccgggatccactacatagtagttatctaattattcactagtatactaatcaaaatagcataaattagttagaatttaacaattttacctggtgtccagtgacaccggtaaattgtatgtgggcatgccagtggctcaaggtgagggcagctatcatcgatggctgtcagctcgtcgtcatcaatgttgataccgtccagtccagaattagggttgtgtttagatccaaaatttggatctaaatttcagtctttttccatcacattaacatgtcatacacacacaacttttcagtcacatcatctccaatttcaaccaaaatccaaactacgcgttgaactaaacaggtgtcgcagctggtgcaacgtcgccatccccagcggcccataaccgtacccgaaacacgcaagccgcggatgagcttgtgtacatgtgctcagctggaggcagttcagccgcgggcacgtttcgccggtgatctcataaagcatgtgaaagacgacacttccacaaccaacgagggagagatcctctagcagtggacactttctcattaactgggttaatgcttccttggagatacaggagcagaaaacatgcaagggacagccgcttcagagagggcgacctgcagcaatgcaagcaaaacgaatgacagattagtgcgcaagatttttcaaatgattagaccatttcagagcaggatttaattaatatatcaccgaaattttgatatttcggtacgaaaaatttgaacaaaaaatgaataacttttgctaaattcactagtttttattttaaaaaaattcaggcgaattagggcgatagaacttcactctggaaatttcaaacctaatcaattcagagtcggagaaacactgatgcaatagaagtatcattagtatatataactacctgacccctatatactcgagcagcttatcatcaacaaagatcttcccatcaaactcctcaagccggccgcccatccgaacggtccacggccaccattgccattgcgtacaggaaatctctcaagatcaatctgtttacatcctcatggtgcaacatgtccacgcatcgccacagatcaggcccaggcacaggcccgaccgccgggccgtgcctgggcctcccccggcacgctgggctggcccggcacggtcgggctggcccggcacgatgggctggcaggctaggcccgacacacaaagtttagggactaaaaatagacatataaatgtcgctgtccaaagaatagggaccttaaatatacttaattttagctatttatatcacagcccaaagaagagggaggtaaaatagacttttttgagctatacatatatcacagcccagtaagagggagaaaaattagacttactctgagaaaaagcacga

SEQ ID NO: 10570 - DNA, 508 bp, Oryza sativa
ccgtgccgtgccagcccacgtgccgcgctcacggcccaggcacagcccaacacacctcgggccgtgccgggccggcccgaaagaatgacggcccatcgtgctttttctcagagtaagtctaatttttctccctcttactgggctgtgatatatgtatagctcaaaaaagtctattttacctccctcttctttgggctgtgatataaatagctaaaattaagtatatttaaggtccctattctttggacagcgacatttatatgtctatttttagtccctaaactttgtgtgtcgggcctagcctgccagcccatcgtgccgggccagcccgaccgtgccgggccagcccagcgtgccgggggaggcccaggcacggcccggcggtcgggcctgtgcctgggcctgatctgtggcgatgcgtggacatgttgcaccatgaggatgtaaacagattgatcttgagagatttcctgtacgcaatggcaatggtggccgtggaccgttcgga

SEQ ID NO: 10571 - DNA, 1085 bp, Oryza sativa
ggctctaatttacatccatgtcattcaaagcatcttgacaggaccattcttaggaaactattctaatccctcgaggggatgttccctcgtttgctcaaaaaccatttaaacggttatgaaaaattctgcaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggactagtaggtatcattatactctacattgtcatttttttcagattttttcacaactatttgcattgaatttggaagaaaaagatatacgaggggatatcccctcgagggattagaatacactccccattttcttatgtatgtgtgggaccaccaggtttgctccctttgggccatattggaatactgacatgcagcagttaacatattggggcattggcctatgcgcttgtgcttggccggctctcatgcaagcgtccgcttccctctctctccaacactttctcacttccacgtaggcgaaggttagctaagggcaagctcagtatatcctacccaactcggtaggagggtggacccaaacagtacatagcaatagtatatcacaggaagccacaaagcttatgtgcaatagggaggaataaggtggacccctcttgaaaaaggcaaattttgctacaggacacttgttatgtgtgcttttagcccaaggacactgcccaaactcacttttgggggaaaacactctataaatatggtaatttgccagtggacaccgtgccgattaaaataatactttctggttggggaggagatagaaatcgcgtgaaatgtcaaaaatgcccttgggcccacatgtcagttctatctcctatctctctcctcatctctctcttttctctctcttttctctctcagatggcgaggacagcggccggcggggtggagcggggcagcggcagcggtggacgagtgcgcagccggcggagc

SEQ ID NO: 10572 - DNA, 1501 bp, Oryza sativa
cgtgagcacagatcacagattctaagagaataaggtacggtctatgtgaacgaaaagtataaaatttcaaggctcgatctggttcaatcatttttttagttcaacaagttactcatcatacaaacgaaaaaacccaacagggcttctctactagtactgatttcttcaaaacaggcagcttgcactaaatcaacagcactacacaaattcactaaaaatgcttccaggttctcatagacagtgcatccatcgtacgaaacggcgatccaagcgtatcacacataatcgaaattgcagggctagggtttcccgtaccttgcacggcctggtagcccagggcgtagtacggcgcggcggccgggtacgtctgcgggggaagcggagggtagaccgcgtaggacggcgggggcggctgcgggtagtgccggagccccggcggcggggccggctgggggaacccgaccgccggctgcgggacctcaccgggggcggaggacggggccccgaacgtgccgtactggtactgctgcgcctgcggctgcggcggcgccgacggctggaacccggaggaggccgagcggggcttgccgtcggcgtcaggcatctcgccggccatgccgcggtggtggggggaaggtttgctcgcgacgcgggagagacgagagagactttggaaatatgatttagccagctctctcatgacactgatctctacttatatttagcttaaattgaaaaaaaaacggcgtttgaaattgggaaaagaacgtggggctccagcctgtaactgtaagatctgcgaaatttaaaccaaaatttatacaggcaaaacgcgctaaatcaacagtaacagcatgtagttagaacggttctttgcagctgtttcacaaataaaccgtgctggttactgcctggcgaatggcgatagctaagcgacaaagcatttgggttttttccccttatttcaaccttctcagataaaattccatggcatgtggaataaatgattttttttctaagatgctgatcaaggtcacagaaaaatgacaaggaacaaaacgtgtttcgggcgttacatcaggctggcgtgttcagaaatcatttacttaggtgtgtttagttttacgctaaaattgaaagtttgactaaaattggaagtttgaagaaaaaagttaaaaatttatgtgtatagaaaagttttgatgtgataaaaaagttagaagtttaaagaaaaagttaggaattaaacaagggctcctataatctttatacaaactactatttctgtcgcatgaagaatcaacctagaaatgaatggaaccctaaacctagaaataaatggaacactaaatctgaactagtgtgtagtattctccaatgaagtcaaaaaagggaaaacgcatgattcgttcaagctgcaaaatctgtcatctttcgcgtgcacaaggtacatcagaatttgagaatgatgccacaattcaaccgactttcgctgagagct

SEQ ID NO: 10573 - DNA, 534 bp, Oryza sativa
aatattcgtgcgtcgtcaatttttcttgtctcccgatccgattctgttccagtttgcttattcggttaattaccgagaagaaataaaagtattacaagtatcggatagattaacatataacggacaacgagcgggctgaaatcatcgaggcttgcatggccccggcccaagtaatgtataatttcttttactagaaaagtaacttgtgtaatgactagccataatcttccaaatgtgataggccatagagtaagttattaggtaataaatagttatagttattatgtataactaaatctatctatacctaatatttttccatatatctcttcccacgcgatcccatgtgtgcagcgcgcctccgccccgcccgtgccaaaccctagcgttgtcgcgacgtcgatctgcttctcccatgtatttcctcctctaattgattgcaaaaaaagattcctcactccttcctcatcatttttcctatgattttcccttttgatttagctttaatttgtcgaatttaatctgcattgaaga

SEQ ID NO: 10574 - DNA, 1501 bp, Oryza sativa
gaaggctgcttgtttaagtcctttaggacatacaggtcagtaactagaaatctaaaatgagtaacttaaattagcagtgcatctatgagataaaaactagtagaatgactaacaaagagaagtatttatgtaactctctcaccaccaatactagcacagtgtcctgatataggtgcatgaacctccgtccttgggaagcatatccccagaaacccagaatgagaaacatcatgcatgctgaacccagatgataattgcatgcatggcatttctagcaccacacaaaatatgattcatgatgcctagtggcgcacatgcatgcaggtccaacaaattgtctccctcctatgcaggaagagggtgcaggcatgaagcatctctattaacaccactagctttgcatatatccatgagttaaccagctgattttaccactctatcgcatagacatcttctgcagttatttgttggatgtccatcagtactataatgttagctagctatatgaaaattagagcatacatccaagcatccagctagttatcacccactaggccactactgcctactgggaaccctgtaacagtgtagctaatgggcaccaccatatataccttgtgacttcaaaagataaaataattgctggatttgtcatggtagatctgataccttaatatcgtgacactcccaatcttatcatcatgttctgtgtggttacaatgtaatgacattatatatcaacaataaacaaattttaacaaaacaaaaaggggcggtggagcttagttaaatgaaactaaacctcaggagaactacttcttttacaaggatataattttcagtcttttccaataactaattacgtattaggctaccactcaccaccagtctaccactacactcttatttatcacctattctaggttccgtaccctacagaatggttaacgtacgctgtgatcactcaacaattaatggaaggatctcaataatggtacatacagcatggtgcatttgacatttttattcgctaggcatgtatttttttagacggaagctaggcatatatttgagatattgacactgtgcaccatcagaatctacatttgaaagaaagcacttatatctcggaatcggcagagatacgatatatacccttcccttcttgtgggtcctcaacagagagcatcagaatctcactcgcctcccaatctgcaagccaaaaagtgtgtacactgttatattttccatatgagctacagctcactgctcacacaaccgcaccctcatgaacacgagtacagccggcgccccaatggcctataaatagctgccacccaagcagaacagatatcatatcaaaacagcagaaatctcttctgaagagaaaaaaacttcagtctagctgcacactagctagctagccagttcacttccaaagaaagacagtagtccaatccaaggatgtcttctaggtcaagcagctcctcccgcaacagca

SEQ ID NO: 10575 - DNA, 706 bp, Oryza sativa
agaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagc

SEQ ID NO: 10576 - DNA, 323 bp, Oryza sativa
ctttttcctctctttttcctcctttctttcgaatgggccgccggcccattccctccttccttccctcccccttactgggccggccgcaggccgaggcccagccaggcagccccgccgctcctctctcggggtcgccgacaggtggggcccacctgtcgggcccgtctccctcctcccgccgatctcgcgctcgcgccgccgcgccgaaaccaccgccgcgcccacgtccccgccttccccgggccacgtcgaccacgcccgcgcgtgcgccgcgtctccagcgcccactcccctctatctcccactcgcgcccgcgcccgaga

SEQ ID NO: 10577 - DNA, 1023 bp, Oryza sativa
ccttggttgaatatgattagaattttgatcatgtttagttgtatgtaactgattggtttcatgaggagatgaataatgcttgaaacatgcgaattttcttttcgttcgttataatacaggtggctgttcacatgaaaatgaattggacagttttgcatgaataggtttggggaaacatctcgttggttttatctcaggattgggttaagtcgtattttggtccttgaaatcttcttgaagtccacttttcacccttaactaaaaacaccatttgttgttgaccctcaacggttaacattcaaaaccgggtaaatcacaccctaaaccatattccaaggtggctttgattggcatgatagtaagcatgtacaccaattaagtttcatttcattgatgtgaacttatctaagtgtcatctatgtctggaaaatatgtataataggagttggcacttgtgaaaaccacctttgttttaaacaaaaccactataaaataggccttaaggtggtgtttgtccagttttgaaacttgaggctgaaaaacaactggtcttttagttgagatcgaaaaatgaattttgagaagggttcaaaagacaaaatggaattttcccgccaagatttctccatccattttgacacccccaatagaaaaggcaactgatgtacatcttggggagaatggcatcaccaggttctgcaatttgtgataacaaaatcttcactagttcccttctattccagttgatattaagctttggttatttagtgctatatatatattgctgccagtcaagttgcattaagcttttgcatcgactatgtagttttatgcagagcatacatatgtggtactggcacatatcctgattcccttctttacctgtgatatttaagataaggaaagtgaaggaaaacgattgtagctgtgttgactttctgcacttctccaggtacttattttgtgactttgccgctatggttcactgatactgcgatacgcttttttttttctgtattcaga

SEQ ID NO: 10578 - DNA, 515 bp, Oryza sativa
tctctttaatgcatataggcaataaaaatatgcttattttgtagtattacttttggaaccatcaattttaaaaatgttattgaaaagtacaataaattgtcataaacaagattagcataaattaattattttattccttgagttagacaccgttgatatttgaatatatgtctgaccattcatcttatttaagatttttatgcaaatatataaacatatagtcatattcaaaataacattagtaacaatataaataaaaaaaataaattataacaatatatttttttaaacaagattaacgatcaaatgcagatttaaacgcaaacataaaaaatagagttaaatgtacaatataaacatatccagaaatagacagcctataaataaagcgcgtcatacggcgtgcttattaattttctagtctaggaggaaagtcaatttatgtctccaacattggaaaaagtttacctgaggtccccctttttgttaagttacgaaccagattttagctaaca

SEQ ID NO: 10579 - DNA, 626 bp, Oryza sativa
tgctttcccccaatgagacagctttccctcacacagcagacaagaaactacctatgggtaaccttcacacctatcatctagttactgccagtagtagtgccaagactcggaatcatactagttcaggtattctcataagaacaaatgcctgtatggtaggctcacataaatggcttatgaagtgaagtcctcaattgatagggcaacttaccaaactacaatagcacacgacattggtagtatcatatatttataattaaggacacacagttgtcactttgagcaactaaatagcacacagcttgacagtaggctcacacatataccatacccggtaatgatcacataggtacattaccaccgaacccaggttcacacataaccacccatcaccctgatccaaaacgttttatccgcccgttgtttattacacaacaacacgtgctatcgaaaagatagtacacagtcacacggttcatatacaaataattataaatatatgattaatcaaaattatattttgcttcaaaacaaccttgagcagagctaagcataactactctaccttgaaatgagcccaatgttcaactcagaaaaactaggatgacaaggtatcataggtaatc

SEQ ID NO: 10580 - DNA, 219 bp, Oryza sativa
ttaaggttgatcggaagattcggcggcaagcgttcaaatattatatcgccgaaaaatagatggagtattacttagataatgatcaatctaaagttgctaggagagtagtacatgaagggatttgtggaattcatcaatcggcccgtaagataaattggttgcttacgagagtggggtttcattggccgaaaataatttatgattgtttcaaattctata

SEQ ID NO: 10581 - DNA, 1169 bp, Oryza sativa
ggcgcccgatctctgtgatgtagtttttttccctgatccgtgtgatatgtgcggtcgatctgtgggatgtcgattttttttcgatctgtgtgatgtgtgatgtgtaaatgaatatgtggagatgttttttgaatgatctgcgatgtatttggagataaaaatgcagcttgatgtatttggggatttttgtgaatgatacgtgatgtatttgggtttaaaaatgtagctggatgtatagggggattttgggaaggatatgtggcgttaaaatgatttgtgaataatatgaatggtggtgcctcgaaatcatgaaaagcatgaaaaaaaaaagaaagaacattagtcccggtgttaactctaaccgggactaaatctttagtcccggtttttaacactaaccgggacaaaagatggatcttttgtcccggttatttcaaccgggactaaaaataggcatctttagtcccggattcgtagtcccgtttgtataaccgggactatagggggttgcgaaccggtattaaaaagggtttgtccaccagtgtcatctccctgccagctgcttcccctacctctcttcccccaccccttctcccgcccctccccctcatgatgggttcccctttatctctccttcagcatttgttcccctaccatttgttcccctaccccgattcctcatgttgttgagacatcagcgacttccaccacttctctatagatttatccaggttttgcgttgaattttttttggaatttgaagaaggttgattgaaagtttaggctttcactgcttcgatgaaagttctatgatttttgagatgaaagttttgtgattttgagatgaaagttcaagttttcaatcaaaaatattttcagatgaaagtttcagatttttaattaaaagttttgtgattttgggataaaagtttcaattaaaagtttcttttttgagatgaaagttttgggtttctaatttaaatttttataattttcagacaaaagtttcatttgagtcgtttttttcaattttgatatggaagttttagattttgagttaaaagctttttaaatttgtgataaaagttttagcattcttgtggtcaggtggcatcaaggaagaagaacaagctctcgcctttgaatcaatggggagtggggctgaaaca

SEQ ID NO: 10582 - DNA, 653 bp, Oryza sativa
taccttgcataatatatattgaagcaaggagttgtaatataaaggtttgtaaggtgagaaaaacttgtttgtatctaccttcggggttcccgaaaggaaaaccgtatgtaagcctatttgcttaatatgaagtaattttctttaagtttccccgtttgtttgctctagataagcgtttatgctagggaccctataggagaaacctctcggttgttctcgtttttagcctgcatcttgcataggcgtctggagaaccagtatccgtagagaagtgttcccctcgggtggaactgcctggggagacggtaaacgcttagctagttcaaatatgactagggatacctgaagttggttgcttaaataggcagataagtgaggcatacggctagtaccgagtaggactttaaaatttctaaatcaagcgccggctgtttttggattcgccaccctgcaaagatcctaaaaatttaaagaaaattttcgagtgaacagtaacctgtaaacagtaattctgtactcataacagtgaattcagcactaagaatagtagtgaatagtagtgaattcagcacatatatatttctgaataataaagttaataataaagtggtatatatatatgtatatatatatatatacatatatatatgtac

SEQ ID NO: 10583 - DNA, 465 bp, Oryza sativa
tatatatatgtatatatatatatatatatatatatatatatatatatatatatgtatatatatatatatatatatgtatatacacatatatatatatgtatatatgtacatatatatatgtatatatatatatatacatatatatataccactttattattaactttattattcagaaatatatatgtgctgaattcactactattcactactattcttagtgctgaattcactgttatgagtacagaattactgtttacaggttactgttcactcgaaaattttctttaaatttttaggatctttgcagggtggcgaatccaaaaacagccggcgcttgatttagaaattttaaagtcctactcggtactagccgtatgcctcacttatctgcctatttaagcaaccaacttcaggtatccctagtcatatttgaactagctaagcgtttaccgtctccccagg

SEQ ID NO: 10584 - DNA, 355 bp, Oryza sativa
ttgaatatatgtctgaccattcatcttatttaagatttttatgcaaatatataaacatatagtcatattcaaaataacattagtaacaatataaataaaaaaaataaattataacaatatatttttttaacaagattaacgatcaaatgcagatttaaacgcaaacataaaaaatagagttaaatgtacaatataaacatatccagaaatagacagcctataaataaagcgcgtcatacggcgtgcttattaattttctagtctaggaggaaagtcaatttatgtctccaacattggaaaaagtttacctgaggtccccctttttgttaagttacgaaccagattttagctaaca

SEQ ID NO: 10585 - DNA, 1501 bp, Oryza sativa
aaaaccatattttctcctattaggtaaacataaaaaagacaaaaaaaaatctaaggtagagaggagaaaatatgattttttttaattttattttttctatatgactgacacgtggcacgtaggtgctatcgtggcatgccacatcagcgcatggagggggttagagctcctctggacctagatgacacctcaagacaagttcgaggacttgaaaatgcattttgagagtttagggacctagataatacgcccactcttttttttctatgagttctgctgacacgtgggccaccagtctatcataaaagaaagggtaacatagtaaatttgagataaaggtagagagtagccgagtgtctccccattccctcccgtctcgtctccgctcattgcgccatctcgcgcatgaacaggggaggggcgccgatctccatctggcgagcagagaagggggaggggatcctggtgagcaaccacatcctctttctgattcatctctctctcccaccttctttcgtgtggaatttgcttgcgctaaccatagcttctctccaagatctggaaggaagaaactttttctcttaatttcagagccttaaccttaatacaagaaacagtttgtttgttcctcaaaaagggagaaatgccgttaatctgcggggctgtgcttgcttgcgttcatcctccatttcctgcttgcaatgtggctgcaagaaaagattaaaagggcctctctcgtttaggtcggggtgctaggaagtagggaaacacctttctctcttcttttggtaggaaaaagatggcgcctttgatgggacaagccatctttgctgatccctagcacttgtttattccaaagtggggggagtgatggtcgatagatctgtagagacagtagagttgtatgattgcggttagtgggcggttggacaggttcagtgttttcgacattagcttttgtgatgatgcctttcttttgagcgagttagatggataaaatcagtgggtggcttcggttgtgacttgtgaggagtgagtctcgttgtagtggacctgtgggaggttgatggatctgcgtgtgcaggttggttcttgattattttgtttttttttttgtttgggattgttgggggatgatctcttgttcatcgaattggtggatttctgtatttttttgtgcagttcttttgtatctaggcatgttctaatcaattgaaattcttttgctgccctttgcagattctgaaggcaagtgtcaacaccaagcttataaatctttgattggtcagtagttctttctgcaatctggtctgatatatatacgtatcagttgtgggagcaatggcttcaaaggcaatgcctcgagcgccccctgcagctcccaacttacagtcactgaaactgtgttctcagaatgattcttctttggagacaaccagtccgagtaaacgaagtgcattggtgccaggaaggtcagctgaatcaagcaaaccgaatcccg

SEQ ID NO: 10586 - DNA, 379 bp, Oryza sativa
  unsure (1)..(379): unsure at all n locations
agggtttttatcctctcatcctcctctatttttcccctcaagaatcggagcaaatggttgggtatnttatccgaatcgagttcgtttcgattttatccccaaaaaccgagtttagatttcccgaaccgatttcttgcgggaagagtccgatctctttaatccaaagctataaataggaccctctagttgtcacgcccagaaattcccgaatagaattccaagcagaatgtgcattaaaatccccgtccaggaccagccggggtacacaaacaacaatgttgacattcagatccacgtcttacaaacatcataaaagtcttacaaaaatgcagcggaaaacaaaagataactggagctaatccttgactcgaactgcagc

SEQ ID NO: 10587 - DNA, 1501 bp, Oryza sativa
cataatagggtttcatttgcaaaagcagcatttagcaaacatttcagaatttaataaaacagttaagtaataattaaacaatattaatccaacgctatacaacataccctgttgtataggcccatccattctgaacaaccatcccggctgcacagttctatctccaaaccaggaatataccattccaaaccaggagctaatcaaattattaccagttatagcatcttctattatggtgagaagggtgagactaatcacgaaagacattgttcaacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgtacaacataacccattacagcgcacctttcctggatcataatcaccccctttaaaacaaggcatggactccccagcgacccccatggacttctcgccacttctcagtctggcgcactataatgaattacgctatacaaaagataaagccgttgcccacgctggcttgtggttggcacgataaatgtttcacaacagtagctcgcgaaccggtccttaattgtcatgagcacaaccatcaaaaccatatgctcacaacccaccttatccagattttaattatcaattagttaacatcacacgattgaccatcgtgagctaccattaaatataaccattattaacaataataattatgtaatataatttatatttaaccccttttagttagctaatgtttctatgcatggctaagcaaacctatatatagcatttagctgaaccaatccaatatataaggttcatgctaatcaaattatagcccataggaaaataaagtcatcttcggccaataaataactgggaaaggttcaccacccgatgacattcgaaaacaatgcatagttgaaataaaacaatagctttaaacgggatcaacatgctcaaagggttgtttgggatctgtgtgacttgccttgggcttccacaaacgcttcggaacctttctcaacggaaacgctctcctccggaacgtcggaaacaaaagcaaataaacaaaatcaacaaaacagtacaaaaacaagcataaacagtacatgaggatatttttaacatgtagatctcaattttagaaaaatttagagacttgaaccaactaaatcggagctacgatgaattagttatgattttttgaagatttaatcagattaaaacacttatattgattttaattgaattatgacgcaataatgaattatttttgaaaaggaaaaagggatttattgcgtcagcaggctagggtttcggtggaccgggcgcacggcggcagttcacgcgaacggacggccgagatcgatccatccaaaacagacggccgagatcgatcggtctacgaccggctcacgggagagggcgacga

SEQ ID NO: 10588 - DNA, 284 bp, Oryza sativa
aggggataccagtgacgggcctctgaatagaagcccgtcaaaggtatgaccaatacctttgacgggctttttttatctaacccgtttgaggtgtgttgggtctataaatacccctcaaactgccaactgctttccatcccgaccattttactgttcacaaatcggttgggagggcaaggggggcgattttttgctaaaattcaaggtaaaaaacacattattctccattcattctcaacatatcgattatcatttatttttcttcgtatgttgttgatttcaga

SEQ ID NO: 10589 - DNA, 544 bp, Oryza sativa
ccttcccatccgaaggccggcgggaccacacgcagcaggcagccagcggggccgcgcctgtggcgagtggcgaacggcggcagggggcagccactgccagcatcctttctctttttttttcaatttgtgattcacttagatgtataattttgtgattcgttgcatggatctaaaatgtataatatgtgatgtgtttgatttgtgtgtaatttttttaagatttgtgatgtatttgatttgtgtgtataagtaacttaagatctgtgatgtgaatgttatgggatgttactttgatttgggatttgggatatgcatcccactcgatttgggagaaaatacagggattaaactatggcaaaagaaacaatgaaaaaaaagaccgggactaaagataccttctctttagtcgcggttggtaacactaaccgggactaaagaagtgtatatttagtcccggattgctagtccctattggaaaaccgggactaaaaggggttaccaaccgagagtataaatggtttctccaccaatgaaccatcgagaa

SEQ ID NO: 10590 - DNA, 1501 bp, Oryza sativa
ccgccgctgccacgcccaacccctcttttcctctcgcagactcgcacgccacaccagcccccgggaggaagagagagatgagggggggggagacgccgccgtcgtggccaccaccaccgtcgccatcaccaccactccgcccggccttcgccaccgccgccgccaacaccggatctcgaagccacggtcaccagcgcatggcggagggagagagataagagagagagagaaagggagggagggaggaggaagaaggggaggggaggaaggatgacatgtcgggcccacatgcctgtgggtcccttttttgaatgacatgtgggcccataattttttgttccacgtaagcgacacgtgcacgaaaaccgggtcaacaccaccacgtaggcgccacgtcagccaaaaccgcttgcaaaaccacccagggagtcaaattgcaccggtttcaatagttcgaggagtcattttatccggttttctggttaagggttacgaattagattcggccgacatttaagggagtcaaagtggactttttcctctggtaaaaatagaggggtaagtactaaaatataaaaattgggctgggtgtatgtgaacccccttaggtttattgggctccgcccctgcatttattgcatgttatctgaatgattatgaaaaaaattgacaagatagatcaatatataatatatcactacacaaatatgcaagttaaaattcaacatctacaaattgtaacaaaagtaacaaaataaactcaaattagtaaggtaaatttgcagttaaatttgttgtttttattataacatgtataagttaaattttaacttgcatatctgtggagtgatatattacatattaacctattttatcattttttttattttttttcataaatacaccatcattccaaattgatcatgatatatatttatgcaccaaacccaaaaataatttaaatcacatcaataaagacaccatgcacacattctctcacaatgcatgtatcgattaaaacaccatgctaattacatcttagcatatacacattctcccattgctatattatctgtattctgatgaaatccgtatccatatgattatatgatgatcaatttagaaaggagagagtatttagttgacatgtaataaactggtgaaaaaaaaaattggatagaagaagatagagctgacacgtgggttttaggtattttggttaaaccagtgaaaccaaaatatatggcatcagtggagggtggaacggcgaacaggtcaagctccatggacacgcgttgcgcccgcgcgcggcgaaggcgagttttcctccgcaaagctacatggagtgcgcgccgccctcattttcttctcccgcggcctttggagagagagagagaggcgacacccttcttcctcccccaaccctttcacccgcccaaactcatccatccatcgatcgccctacctagctactctcgatcgatcgaccgcccgcccgcca

SEQ ID NO: 10591 - DNA, 1501 bp, Oryza sativa
attctaagtctagtgcatgctttggtttctccctcgacttgtttggatattggtgcttcatcgtcaaattctaccgctcttgctttaattaatgacatgtccgatgagcaactcgaacaattcgaggaggaggactgggctttggctgctaacaagatttctcaagctatgaacaatgtcaggtacaggaaaagaggaggtcaaactcgttgctttaaatgtggagcacttgatcacattcgttgaatattttggattttcagtgcaatattttgaattttttataatggatttttgtacaatatcatgaaatttcctatagcgtatatttaagctttgtgtgtacttactaaattttaatatttagttaggagttatcccaccaattcctttgatacaaacaaacatcccatggtgcaatcaattgttttttgccacaccgcgctaagtgcaagggaatcttgattttctttttaagtcattgacatgtagggatttaatttattggaatataatattgccacaacggttgctgtaaccaaatatctgtcaagttgatcaaactagcctaattttagatcaatgtagcaaactatggttaagtgtggctggcaatcaaacatccctggagtatttatggtacaaattagatgagtgaaaaataaagttatcatgggatggagagaatttgtctagaagaagtaaaaaaaaaatagacacaacttggccgcttgagtgttgagatcatggttcttgtctttctgtgtgccatattgccttgttggcagtgattgcttcttgaaatcatttcatttgtaaagtatgacacgctaagattttatgcgtttacaggaaagagataaattaacagaagtcaatggaaatatttggttgaatcaagaaaataaatagactcaaccacggttagtgacctggccatgctattgagtacggacttgaacaatgacataagtagtcgtgcaaggtattgacataaacaatgatataaggaatccagcgggcatgtgatgaccgcagactttcagttactgtttataggtcatgtagtccctccgaaaaaaaaaaaagaaagaaaacacaacctaagtaccaagatactccctctgttttatttatatctatctagattcattaacatcaatatgaatataggaaatgctagaatgacttacattgtgaaacgaaggaagtatcatacattctagtacaacgaatatggaatagtatatatactccctccgtaaaaaaaaagaaaacacaatctaagtactgagatgtgatacattctagtacaacgaatacggacatagtgtatatgtctagatttaggttgtttttttttaacggagggaatactcatcatattatatgattttttagctaaggacgcagtattaaattcattgacattgagagtgtgctccggatgccactatatataaatatataaatagacagagggagggacagggagagagaa

SEQ ID NO: 10592 - DNA, 435 bp, Oryza sativa
cccgcccattagcctcaccccttagcacctcctgttgggtgccggtttctaaattcagcatcacgtggagttgataaccgacaactaaaggctttttttttaagtagtgtgtgcgcagttacagagttaatccgtgaccgtgatcatctccacttcgatcgaccctttcgtcgcggccatgaaatcgccatcaaaactgcggcatccgatcgggaaaaggacatccccgtacacgagcccgactcgtaccagttcaccacaccacactaccccgccccacgctataaatacaagcgctcctcgtcctcctcgacctcgatcgatcgtatcccaccaccaccaccagagctagcgcagcaaccgtgagctcagttcagttttcatttggtcgtcgttcgagtcgtcagctagcttcgattcaaagaaggcaaacaa

SEQ ID NO: 10593 - DNA, 1501 bp, Oryza sativa
gccggaagcgagatgctcgccttcggcgccgctccggccgccgccgccgccactgccggtggcgccgcggcagctggggagaaggaggaggaggagaaggttgaggagaaggagaaggagggggaggacgacatcgtcttcagcctcttcgacgacgaatgagctatcgaccttcgtcttcagccctgcatctacgtgccatagtctacatgtcgtcagtctaagtttgtacaagtagtagtagtatatatactagtagtaaaatgcacatgcttcgttacgggtaaaatgaatggttgaatgctgtaaagtacacagttaacatcataataatgtttcaagatagatatattatttattgggttaattataatttgggtggatagaaaatccttacgtattttttttattaggtatagatatatattgatcttcaatcctacgatatatttatagcccatatcgcttttcaagtttgcagtgtgtacaagtctctcggaaatgctaatgagcgattgctcgcctggcgccgagggtagcgatcaattagaaccccctccccctccccctcctcttcccttcctccaccttgtttccttttttggcaccgcattactttcctattttaataaatttatacacctaaagtttgtacacctcaagtttacacatctaaagtagacccaaagtttataagtcataagtttatatatccgattcaaatttgaatttgatattgtttatatatagtatttctataaatctaaagtttatacacctaaagtttatagactaaagtttataagtcaaaagtttatatacccatttcaaatttgaatttgaattatatctgattcaaatttgaatttgaattcaaatattttctatatatagtatttctatacatctaaagtttatacacctaaagtttatacacccaaagtttataagacaaaagtttacatacccgattcaaatttaaatttgaattacatctgattcaaatttgaatttgaattacatctgattcaaatttgaatttgaattcaaatattttctatatatagtatttctatacatctaaagtttatacacctaaactttatagacctaaagtttataagtcaaaactttacatacccgattcaaatatgaatttgaattatatctgattcaaatttgaatttgaattcaaatattttctatacatctaaagtttatacacctaaagtttatagacccaaagtttataagtcaaaagtttatatacccgattcaaatttaaatttgaattcaaattttttatatatagtatttctatatataaatttttctaacttttgttttttttaaaaatttttgtggtgtactgtagtagtaagagaagaaggggaggaggaaggggagaagaggaaggaggtattgcctatatgagggagggggcgaatctgatcgctgggcgatcgcccattagcccctcccccctcccccccaagtctct

SEQ ID NO: 10594 - DNA, 539 bp, Oryza sativa
ttaaagtgaacactggtactaaaatttgatcagtcgatgctaggttttaggcttgtgaaaagaattgtaaaattagctttatgcaaaagaacctgaagccattccttgaaataccctctatcatatgcattgttgttgtggtggcttgctgagtacggttggtactcacccttgctatttatatatcttttaggagagtgttgaagagaagcccttgtcggtacacttgcgtatcccacaagatgatcggagagcggtcttgttctaggtctcgttccccagtcgactgcctgtggcatgttaaccgggcccttatattattttgtcttccgctgttgttctctaatagttgttggcctacttggccctaatgtaagtatttaactcttttagcctaaattcattcgtgatatgttgtgatccaactatgtatgtgtgtaccaactactgatccagggattggtacggataaacacagaagatttccgatttccaaaatcgggggtctacacccccacgccacttgacacagggcgaga

SEQ ID NO: 10595 - DNA, 709 bp, Oryza sativa
  unsure (1)..(709): unsure at all n locations
tctgttaactccagtgtagctttgctgacctcaaagcagcacagctgtgccgcagtagttagatgttgtcttatttgtcatacatagtacttatcttcagaaattgtgcctgatctggcttgtaatcaaggacgggtcaaatagtttgacatcatcatgccctgctgtctgctagaacatgtgatgatatcagatgaaacgnatatactcctacggataagagttgacagagtcagcaatgcatgctgcatagtcagatttgtggatttttgctgtgataaaaatatatgacaggacagagtagttctgcacttgttgaccacttgactggctgatgctattggcctctgttatattttcagtctcttcagaatatttttcttgcttaatctgctcaataggaaagtacttttcttcagcatgtatgacttaacacattaggccgattatggccggcccatacactttttttcattggtgggcctctgggtcacagctgatttaagctgggccgtagatgggcttactctatgaaagagctttgaggcagagcatttaataagcttgccgtggacccgtggtacgtacgtacaaagtgagctaacggggccatcatgcatgaatgcaatcaccttagcactgtgctaagatatgggcgtcgccccatatatagcaagttgaatgtcctaatcttaagccatgacacaat

SEQ ID NO: 10596 - DNA, 357 bp, Oryza sativa
cctgggttaagcgttccaccgtgagcatagtaccagaacttcgatcgatccggccaattagcggtggccggttcgatacccctctcaagcaagctagcctccatctcctcccacttcggcttcgcgacgctatatccgcctgaccccaagtggtgatggtacttcttcttggcagcattttctttgtttctggccatcatcgcttgcccttgttgccctgtcttgtaagcaacgaactcgtcccaatgatcccttagctttgggaatacgtcgaagttcggtgttagtcccttcaggatgtatttcttgtagagatctcccttgaagctctggaactgttctgccattttcttcaga

SEQ ID NO: 10597 - DNA, 1501 bp, Oryza sativa
aactcgttcggccgtcactggtcaccggagctggaggagaaggagttaaggttgtcggagcaaaaatcgcaaatgaaatcagtaaagcttaaaatcttaaagtcagctactacttaacatgaagtaggacaaccttgggtcgacacgtggccctccataaaaaggagagcgagatccgcatgaactgattgagagcttctagcccttggccacgatggctcagctcggggacaatccctgcgatatcctaggggtcactattgatgaaaaacacgaggcctgggagatttgcttaactccagtgcaggtccaaaactcgccttcgggtatgctagcatgccagttgatttgatcctgcaatcaacaagaaataaaggcaaagaaaccgtggttaaatccataaatgatagccgattgactagataccgatgacatatcatttatcttcgatccgatgtcatatgtaaatcgatcggcagttataaatagataataaagaactaaatctactcgatcggctgtagatattaacaatatatattccttgtgtcgatatatacttaaatcaagtgattgggatagatcggtcgccataccgagacagtataaatcacttagatcgaaatatatattaacaacaagactatatatgttcatagcatagccgatcagatagatctagcatgtatcggctaatactctgatacaactctatgttaagatattaaaacaagcagaatacaccaaacaaaagcttaatatacttagatgcaataagatcttgacatatagggcagatttaacatgtcaataaaacatatagagcaaatgtagttaaatcagataagatcggctgaaaccccgatactaccctaatcggcaagcaagaggcaggctagagattgagattctaatcacgactcataagatcaaacaactgatgcagctataagtatgagaagaaagacaatgtctagacaatcaagccattggaaatttcatagagtgatggatatcgtatataatctaaatcaacatcaatatttaacctaatcggcagccctctattgatagatattagccgattgtaggttagataacgatattgccagagattatataagatatatgataactcgacgaattacatagacaagattagagtatcataatgatggaagcactaatcccgagaacgcaagccatcataacaaattttacctcttgctgaagatcaaaaccgatgcagctcaacccgaaagcaagaactcgtcgaaataaactaaagcaaaaagggtggcgatgcgccgaaattgtattgaacgtgtgtgttaattgattacatgggattcggggtctatatatacccgaatattacaaataatgtccataacggacacgactcttatctccaacaaactctaagataccataagtctttacggcagacttttgcccaaacatatctctaaggaagttacataaaatatcctaattaata

SEQ ID NO: 10598 - DNA, 1501 bp, Oryza sativa
cagactctaaaatctacttttaattttattatgtttattccgaattttagttagttttaaatttctatatggactctatactctacttctaatattccttatttttaattctaaatttctattatttcctaattgtatttctatatggactctatactctacttctaatagtccttattttaattctgaatctcagttatttcctacttgtatttctatatggactctagtctccttttctaatattctttactttttaattctgaatttcaactatttctaaattgtattttgatatggactctagtctcttcttctaatattccttattttttaattccgaatttcagctatttctaaattgtatttctatacggactctgctttttctttttttcgattaatgtgagaatttctaggccgtatttctatatggactctgttttttttctttttctccgattaatgtgagaatttctaggccatgagagcgaacatggaggctcatttttctattcctttaataatataatagatagacagattagacggtccgtgatatgcaagattctaggtttttttgtgtgagatgatatttagacagtcccttaatcaaaatttgacaaagagtcgaacataggaccactggttgtcttggtcgaaatcacataccgaggacacataccaagggcctgtttaaatcacacctaatgtttttacaacatttcacatcaaacgtttgaacacctgcataaatttataaatatagacttaaaaaataactaattgcataaattatgaataatttgcgagatgaatctttttttggagaattacacagtacaacttagacactcacaatgcgcgcatactcacccatatgaacgcacgcacgcaaatcctacccctatgagcatattcaaagactggccggcaaatcctggaaaattctctctcggtagagacgaatctttcaagactaactgctccatgatttaacaatatggtgctacagtaaatattttctaatgacagattaattaggcttaataaattcgtctcgcgatttaccgagatattctgtaattagtttttttattagtaccgaacaccctatataatatccgatatgacacgctaaaactttagaccctgatctaaacaccccctgacatatctctgtcactacgggcgaaaagtccagttagatgtccaagatcagtacgtaagtgaggactgaagacctaacaccatcgacacatcaattagttctgattgattttaccaacgaaatgacttgaaagtatgccgcgccttccgtctcctctgtggtgtgtgcgacttgtgagagacatccagcgccagtggtaaagttcggccattattatatcaaaagacccgcccatatatgaaggcggcatttgcgtttgtgatgcttgcctgaatctctaccttacgcccatgcatgcaaccatgttaaagagatcggtgcttccgagta

SEQ ID NO: 10599 - DNA, 1501 bp, Oryza sativa
ctgcatctgtgatcgctaccaacaaatcaatgtaatctatacctagtactagtcaatctcctttgtttgaacagctcaaatcttcaaaccatgtattaaagtcgaaatccatttgcaccattattttctattcaaaatatgcagcgaaacgagtctaatattgattatattatcgtatgatatttgaattttccgtgcctaaacgtcgtaaagacacgcttcacatctattttgtaaaattgggctgcaaattagtgcccaatgatttattattttttctatgaacaaacaaatgatagaattgagatatcaagtaggcgaattatgtcaatattgtagggttcatgtgcgaagcaacaagactcgactcggcgaaatgacaaaaatgagcccaatattgtatgtacattgacatcatttattacttatacttttggtccacatgtcattgagccttatatgggcccaagaaaatattatttgcataagagaatgatgccaaataattttagtattatttaattcgatgaatttttgcgtacaacgacaatataaaagcataacaattattagtgctttctaaagcttaatttgtaaaagtataccaatctagtaagcattcaaaacgtagagctcctgcaccaagatagaagattgtcacttgacgagtgaatttttggacgacgacaatacaaaagcataatactccttcagttctaaaatataaaaacatttagcactcagaatttgtcccaaaatataacaacttctctactagcattctctttccaaccaatcacaaccatgcaccattcacttttcctacctacctttactactcatccaatgacaaccctacaccattcacttctacctactataaaacttattatattctgggatagaggtagtaattattagtgctttctaaagcttaaatggaaaagtataccacatcaatctactaagcatcaaaaacataacatgcaatcataaaaattactaacatcaacaatttatcacattctaaaattcaatatacacacatgccagcaaaatcatcgtccccacaccattttcacaatattctaacccaaatccatccatcatttctaccacatctaacatataatcattcctatattttgcaacaaaacgcgggtgtcatcagttaatattgattgtggctaacacataagttgtattttcaaagactgcgtcaatgtccgaaactacttaatttgtgatgggaggacgaaccttgcacagccactattttgtcccggccactctgctccaagctttgtgggctcgtgggccacagaacctatcgcgattggaactacagttggcacctatccgtagcgggattcccggtggcgcaacgtgtggtctccgccgcgcccaaatccaacccaaaattctcgcccccgcgcccgcgtcgcaccaccacatcacaggacagacaaacagatcaccgatcgatcacgcgttcaccgcc

SEQ ID NO: 10600 - DNA, 1501 bp, Oryza sativa
aattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatattatgcatgcatatacatataatataatataatatatatatatatatatatacatatatatatatatgtatgcgtatatatgtattgaaacatatatatgcatggtttatatatatatatatatatatatataaaccatgcagcaacagggccatgcaaaaaaaaaaggtcatctcgatctttagtcccggattggtactcccggtttggaaactgggactaaagggggttacaaaccgggactacaaagggtttcttcaccagtgcaacctggcgggaaaaagaaaaggttagtgtccattctcaacttcatcgcataaatcaccatcggggtctctccctctgggcttaataaaatcaaactctctgtccctaataaaataaaatcctagaatctcacaaaactattaagaaaagaaacaaaaaaacaaattacccttaattaatgtaaaatttgtattgctcgatgagtaggtgaggggtattgaagtaataaaatttctcgatttgcggattgatggtaggtaagaaggtactcccttcatcccattttaagtgcaaccataagttttcgcgcccaattttgatcgtccgtcatatttgaaaaaaatttataattagtatttttgttgttatgagatgataaaatataaatagtattttattcgtgacttatgtttttaatttttttcagaaaaaatttaaataagacggatagtcaaagttgggcacggaaaaccatgactgcacttaaaatgggacggagggagtaggagttggtttattttagaataaattttaaatcataggagttagtttattttggtacggagggagtatttgattaaagttaaaccgccaccacaccagacagacacacatgtaagtccaatcggcggttcaacgtgtcgacccaaaaatatactagtgaatcagagttcagagagggtgggcccacactgatcacaattctgcaaacggtagtactagcacagaagattgtgtgctgggaaatgaaatgatccgagaaaaaaattgcgaatcgccagcctgcggaagcgcggttatatagaaaaaggtccaaatttcaaacgaatttgatccaatttaacacatcagcagccaaa

SEQ ID NO: 10601 - DNA, 1501 bp, Oryza sativa
  unsure (1)..(1501): unsure at all n locations
tgtcagtcacgttcaaatgctcttttttttggacttgtcgatacacaccctgcttttggtcgatcgatggtcacgtcggagagagaggagacatgaattaggatattgctatgcacgcttgtgaggaggttaccaacacttcatgcttgctggtgtaatggtggtcaccggtgagttaactaagacattttcgacgaaatttttaagtcgtatgatagaagagaaaagtcttgttaaacggctgttaaaagaaattagaccaaaatcttacacatttttaatcttagcatttgattcacgattcatgcttcaatgaacccagctcatcctctagctgaggcgagctccgacaatcaatgacagagcgacaagttatggtttaaagttctgggttaggataaaggtgagacgaggagggaaggaagattgtcgggcttagaaggatggcctaggagacaatgacatgacatgccggtgggtggcgaggcgctanaggtgtgtgtgtgcgcggccagggggaggggctaggatagtgtgggtggcagggccaaagcaatgcttctagtttgaacgcggtgttttgtgatggtgatccagcagaagggaaccgttaaagacgaagaagaatgcgggacgggggcacctcgccacagttagcttagggagggggtaggtggtggagaagggaggaggcggccagcttcgtcagctttgttgagtgttgatgcctttcggccggtggtggcgcagcggagatggcaagacaattttttggtcgtttgactcatgccctctagtgtgatgtagtgactacgactaggaggtaggagaagagtaaaggttattgttgagagtaaagcaccaatctaaaagcaatataatggtatgaaaattttttctgagatatacgtttccaattgaattacttatcagtaagacccatataactagttgtaagtctgttagtgtcatactgtcatcgacatataatattccctgcatcatcttataatataagatctagaactgaatgtgacattgtattatgtaatgctttattcgatcctatgtatatgtagggattagggattgtttgttactttgtacgtctcctaatataagggattttgacattttacttgtactgtttgaccattcgtctaattcaaaaaattttgaaattattattatttttaacttattttattatccaaaatactttaagcataacttttcgttttttatatttgcacaatttttttttgaaaaagacgagtagtcaaatagcctaagctacagagagggttttttttttgtgcgccccaatttccatgtacacgtagcagtttctcccaaaaggttccatagaaggcccaagcgtcggcccccacaccatggcatcggataagattgccattcctttacttcggtaaacaaacaaaaagaatagttcaataataataaaaaatagaaaatgctcagcagaagaaacgaacggaca

SEQ ID NO: 10602 - DNA, 1501 bp, Oryza sativa
tcgtcgaggatacgccacaggcggtacttgatggagcggttggcccagcgtgccatggcctggcgcaacgtccgggtggtgaactcgagggctgccgtctttcgctggatcagccacgtctcgccgtcggagttgaagatgccctggccgaggaggtcgtggaacgatgcctgccacatggggcccttggggtagttgtcgaagcgcgcgcgcaggatgtgctcaaggttccgcgggttgcacgtcaccgtcaccagcccctgccgccgcgccaggaatggcagaggcaggatgcacgtctggtacgtcgcggcgtcacccgtggcgcgcaggttgtcggcgatccagtcgtgcacccgcgcccggttcagcacgacgctgggtaggctgccgacgagcggccacatccgtggcccggacagccgccgcgacagcgcccagaaccacaccatgtacgccgaagccaatgccacggcagccgcggccatggcgtaggggtgcagctgcaacacgccgccatcggtcgccatggccctgcgtgggtgcgttttaagctcgcaaccacacaccttgctaagtggagatataattaagagggggcgggtttagcactatgtgatttagaaatggtgcggtgcgcctggtgagttgagaaatgtgtttggcgccatcgtgtatatatatgtgcacttcacacgagccgtgtggcgttgcttcccttgtcggcccaagtttaagtctctcaagtttttgaattcaacaaggggaaataaaattcattgctcttgttcatacttcttgccttcttggccattcttcctaacaagaaatttagcgacgttgttctgttgttcactccagtagataaacaaattgtgtttggtgctctcttctctttttttttttttggcaaacattgcaacagaaagcgaggagcgtcctcggtattggactatcgcggactggtttcggcgcagaaaattcagtgcgtgtatcatcttgatataagtctctgtttttcctttcgtcttgctgttggtgcaaactagggagaaggttgcccatacttttaccaatcattttcgtcaagtgtttccctagaagcagcgcaggcagcgcaccaatgttgtttcgtataaccggccagcgaaagtagtaggtgagaaatatgggtctcctctcttaccaatattcatccaacctactagtaacatacaacaaagagagaaatttcggataggaataagttcgtctgaggtcccttaacttgtcaacgaatccgattttcatccttcaaccggaaaaccagatacaacaggtccctcaactattaaaaccggtgcagataaggtccctcggcggtttagatggcggttttggctgacgtggcgcctacgtggcaaattcgactcggtcttcatatgacatggcacttacgtggcaatttgatccgaaaaaataataaaccctgtgggacccacatgtctgtttcacatacaaa

SEQ ID NO: 10603 - DNA, 806 bp, Oryza sativa
gcgaattcgagctcggtacccatataccgttgatatctacagccgatcgagtagatttagctctttcttacttcttaatgactgccgatcgatgcatatatgacatcggctcaaagataaatgatatatcatcggcacttagctgatcggctattgtttatggatttaatcacggtttctttgtctttgtttcttgttgattggaggatcaaatcaactggcacgctcacacacccaaagcaagttttggacctgcactggagttaaacagatctcctaagcctcgcgtttttacatcaacaataggcaattgagttaaagtttcaattgtagattatgcacaaaggtcgtataaaacattacaaggagcgtcaaattgaggtgcatgtcccttttgtatctacctaatattctatgggttcatttgcctcttcaatggcattttcaatgtcattgatggacctatggaaaaatcattattaggaaaaaattgaaaatatatgtttttatcagatttgtaagaaaatactggtttgggataaaagtgcaaaagtataccatctggttatcgcgaacaaacagtagcggtctcgcaggatggtgggcaaacacgtagagcgttctcgtcgggtgctacggtgagattacacgccctgccggtgcaagcggtctcagagggcggggcatgagtgcaccaattatctcgcttctcaatgctgcaataccgattaaaattaaaaatagttaatcgttcaatgatggttagccgctattggtacaaccgttgctcatatccaaccgagaga

SEQ ID NO: 10604 - DNA, 633 bp, Oryza sativa
attattctcgtcgctccctccgcattgcacgcaccctctaggacctctatgagatgcatgtacacaccttccgttgcattgcaagcatatatgcatctatgccaagccatcacgtatcgcatgtgtagggattagagcataattaattacaccggccgaacccatgcacgcatgctacctaccactgttgatgacataatttgctaatggtgccatccaggatatcactatagagagataatagagatacatgcccatgagcatcttcggatcatcattgacaccaccaatcaatcaaaccgttttgttaactgctggcagcgatagctagcattgatagagtgtgccatcgatcgaccttggccgcgcgtatataagcactcgccgcattcccatgagataactccacacacaaaactgttgcactccactgcgctataaatagctacgtgctgcattcgcgcgcgtgtgcatgcatggcagcaattggtaacatgaatttgttcgacttgttcttcgtcttgcagcttctcctgtcaggagtatgcgtgctcgtcatctgctaccgatatcagcggcttaaatccatgaaaaaatgtagcctatgggttgtccagtggccgatcgtcggcg

SEQ ID NO: 10605 - DNA, 1501 bp, Oryza sativa
cctccctcccgatgaatcgccgccatactctcctcccctctatataaaccccacccgcgggactacgtcatcatcctgccactctacaaagagcttaattagctagctagtctcttcgatctgcttctctctttggtttccatggcttcttctcgggttgtcgtcgcggtggcgctgctcgtggcggcggtgctcgccgcgttcggtgcgctggcgccggcgtgcgagggcgcgagggtgatgcgcgagggcgccgccgtcgtcggcaagatgtcgagctaccagccgccggtgaggcataagcctcccgtcccgccgtcggggccgtcgcacaggcacaacaagagggcgacagtcccgaggaagaggaagcacttcccgccgtcgggcccgtcgtaccacgatccgcacagctgagctccggcgatcgtcgtgcgcggccatggaaaagacggccggccagtcagcatctctctctgcagtagcttcattaattaattgatttaattagttaggaattataataataatagcaggagagattatctagcttaattggtatttccttcttttgattagtttggtaggttaatttgaggtgtaatgcaggtattgttaattagcatttcgtatagaaatgcgcatgatacatgcatgccatttagtttattttttagatgtttctctacgaattattcattttcttaaataaaagtactttgcttattaattagttattaattgggttaaatctctactatcttaaaaatggagtcgttcttcttccattctctcatcctacatagcacatactaattacacatggaggtgagaaaaacattataggtgctgattttaactgtttcggcacctatagtgttgatctctatatatattttagtagtagtagtgacgttacacggaatactggtaatattataaaaatctcatttacgatttaattatttgccctcgtaatattgaaacactaattcatacgctaattcatgtatctttggagacgatttctgccgaccgttgctactcttaattaaaatgggttttctaattgcatctgaacaaaattcactcagcctcaagattaatttctttagtgaaatgttcacttaaataagggtttattttattttcatcactagcaaaaataatagatgaaacaaattatataacaatccgtgacaaatcttttaaaatgttagaggattaatttttatggaaactgaactaattcttatgaaaatcatataacccaaatatttctttcccaactagcaaaatacccaagctctgctacagataaaatatattatattataatatgtaatagacaaaataaaaatatcaaatatattattatcacttatatgcatgtttgaatatatggtattcacgtgttttaactaaatatttaaactattccataatattagaaaatatcaatggtaaatttgtaaaaagttataaacagtgctggcgtgac

SEQ ID NO: 10606 - DNA, 1501 bp, Oryza sativa
ggggcgtgaggaaggaggagaggcggaggtgcgcggcggagacggggcgcgaggaaggagaggcgacggtgcgcggcggcgtcggggaggcggagcttgatctcgacctccatcacggggggcagggaggagaggggaggctagggtttggggttgcaattgggattggtagggaggccgatgcggtgggacttggagggcgcggcgccgggcggtgggtggaggaggaggttggagttggagggcggcggggtcgtggtcggagtggatgaggcggtgggggtgctggccgccgccgcggtggcggtggcaacgcagaggtggtcttcgagctcgtcacgatcgaaggtggtcttcgcgcgccgccgctccagccgccgtctccccacttcgcccgctgccccagtgcacatcgtgaaaaagagagagaggataacgggaagaagatgagggatgggaggatgacatgtggggcccacgtgggtcccaccattttttttattattattttgtatgtgaaacagacatgtgggtcccacagggtttattattttttcggatcaaattgccacgtaagtgccatgtcatatgaagaccgagtcgaatttgccacgtaggcgccacgtcagccaaaaccgccatctaaaccgccgagggaccttatctgcaccggttttaatagttgagggacctgttgtatctggttttccggttgaaggatgaaaatcggattcgttgacaagttaagggacctcagacgaacttattcctatccgaaatttctctctttgttgtatgttactagtaggttggatgaatattggtaagagaggagacccatatttctcacctactactttcgctggccggttatacgaaacaacattggtgcgctgcctgcgctgcttctagggaaacacttgacgaaaatgattggtaaaagtatgggcaaccttctccctagtttgcaccaacagcaagacgaaaggaaaaacagagacttatatcaagatgatacacgcactgaattttctgcgccgaaaccagtccgcgatagtccaataccgaggacgctcctcgctttctgttgcaatgtttgccaaaaaaaaaaaaagagaagagagcaccaaacacaatttgtttatctactggagtgaacaacagaacaacgtcgctaaatttcttgttaggaagaatggccaagaaggcaagaagtatgaacaagagcaatgaattttatttccccttgttgaattcaaaaacttgagagacttaaacttgggccgacaagggaagcaacgccacacggctcgtgtgaagtgcacatatatatacacgatggcgccaaacacatttctcaactcaccaggcgcaccgcaccatttctaaatcacatagtgctaaacccgccccctcttaattatatctccacttagcaaggtgtgtggttgcgagcttaaaacgcacccacgcagggccatggcgaccgatggcggcgtgt

SEQ ID NO: 10607 - DNA, 1501 bp, Oryza sativa
gttaccccgaaggtgtgacctcttaaaggtacaatctatctatagtatgtttaattgctatgatgaatctctgttggttgcaggtacaagcaattgtatctttggactggtaccagcagcgaggttttgtgggattcggttcatgtggattttctgcgtcgtaccctctctggtgtcactattatgtgatgccaaggcagggtgtgacattcttccaagagttgttgctccaattgccattgatgcggccattgcaatcatcctccttcctcatcggcaactcggccgatgacacctccacgttgctgcttcgtacgatggcgctcatggtggtagcgtcgtcaacacgccattactgtgctctcctgcccgtgggcctcctcggacctccggggaggctggcgtcgagaagcgttgagcggttgacgacggcggactcgatttggaatcccggatctcctccatgacacgcttgtgggaagagaggaaagagagattgagaggggtgaggaggaagatgaaatgaagagaaagtcgttgacacatgggtcccaccaattgactcggcgagtcatagtcaatctgccatgtcagcggaagtcgaagaaattggtttgcaacgaatttcaaatatagaggcgacttacaaagggccacggagggacaattaggacaaaacatcctgaatttttgaagtagctaaatatttagtttcttccgaatatccgttgcaatgcacggaagctttttcaggtactaatatatgtctaagacaaactaaaaataaggttgcttagacggatggaataaactataaagttatatatatacatgtatttagcgtgtgaagcataatattgttatagctcgttgtttcttcttacttaaattttacacattttcgttgatagttccgtttcccattttcggctcttttcggtccgtttttcacgattgttgtttttctttaaaatcaatcaaagaggattactacgagtcgcctactactactacactagtagtaacattgtttatgttttcttctcccatatccaagatggcaatggcaagtccaaagcggcagtgggacacgatgataattttgtgtaatcactccccctccgattaattaacccctcccagatctaatctcctcccgcacatcctaacccaggacataatattccactcccccccccccccccgggccgcgattaaacaaggtggctacagacgttgaccagagaagcgagatttgggaagctgcggctcgacattggtcgcgccatgcagatggagatggagatggagcggtagctgccatcgattcgggtcgcatattcgcatcgtcttcttctttgtttggttggtctgcgtggtggatcggtcttggtggttgaggtggaggccgacatggagcgcgttgttggcgacttcaacctcctcctccaacgcggcggcgccgccggtgaacgtccgtgtaggcgccacgccgatgcgc

SEQ ID NO: 10608 - DNA, 938 bp, Oryza sativa
tcccctctcctcaatccatctccccctcctgtgcttcttcaccttctccacgcgccgccgtcgtcgtgccgccgcgtcgccgcttcgagccgccgcgccgccgccctcgtgctgtcgtgccgccgcattcgtgccgccgcgccgccgccgttgtttaatgtgaacgctggtattaaaatttgatcggtctatgctaggtcttaggcttgtgaaaagaattacaaaacttgctttacgcaaaagaaccatagccatcctttgaattcccctgtcatgtgcattattgctgtggtggcttgctgagtacggttggtactcacccttgcaatatacaaatttaatcagaggtcggagatgaagcttcggaggatccctacgcttactactaggagggtgatgaagacgatggcgcccagtaggtcttagttacggtcgttgcctgtggcaatggcgtgccgctgccttaactccgctgccttaccttcttctgtttttggaatgtattccggaccgctcggtccgatgatttaagactatgcctgcgggcttatgatgtaatgattcgtactagacactcgtgtatgtgcacttgatatttcagctaagaattcgtgtgtaccagactacttgatccagggaaatggtactgtttacacgattgattcctgttataaaaatgggggtccacagagctggtatcagagccatacgactgtaggaaagaccaaaaggcgccccaccccttttctaagctggccaagggagaaattcccatttagtaatactttcaaaaataaaaacactatgtttacaaaactcggaacgattttcatcttactcttagctattttcttcacaaaacaagttttactcttagctgactttgggtttttcttaaaattagatggcagatcaggattcacccgccacctgggaga

SEQ ID NO: 10609 - DNA, 265 bp, Oryza sativa
acccccttcacgcccttcgaggagctgctcgaggggtcctgcgacccggacccgaccccgcctccgcccctacctccgctgcagccgcaggccacgccaatggacgccgacgaggtcgtggaggagaaggatagtggcatcctcagccaggatttcttctggtagggttcccgatccggctccgagctgtgctttcgtgtgcttgagggggtggagtgcggttggattaaccctatttcttcatctatttgcttgctgttctgca

SEQ ID NO: 10610 - DNA, 1501 bp, Oryza sativa
cgtggtaccgcgcgtacggcttcgtcttccactccttgtcgatcccgccgatgtagatggtggacgcgttcccctccacacgaatgtcccctctcgcctcgcaccgctccgaccgcttgctcgtcatgcggcaggtcggcttcctcttgccgccgccgccgccggctgcggcggtgaccacgacggcaggggtggcgctgacctcaggctcagcgccgccaccgccagagctctcctcctcctcgtcctcctcttgctctgcaaattcaagaacgcactcgttgagcacaaatcacacacaatccggagagctagcgagggcgaggacgaacctcccgccgccatggtcgccggctcgtcggtctccatcctgatgctggagttcatctgctcctgtagctggtcgtcgggcttaactgcacatcacccaaccaaatttcacactcccaactcacaaatcaagaggaggaggaggaagaagagcgccgcgccgccacggcggaggcggagcgtaccgaagggggtggagcagtatctggccttgacgatgctgaggacgcagagggagagcagcatggcggcgatgatgacgccgttgctcacccgccgcggctcctgccggctccgcatcgactgcttcatctcgccgccggcgggcccagctcaaactccggccaccgccttgccctagatctggaccaacccgcaaccgcgtcctcctacttttcttccccctctccttccaagcaaacaagggaagggagaagaagaggaggaagagatggatagctagcgagcgaggcgaagctggctgagaagggaagactcgagactcgagagatgctttgacacttatgcctctgatagtctcatgccgagctggatctgaagcaaattgccgattaaactatggcttaattaggcatcacttgtccagattattatgcaattaacggcgaggttagtactccattcataatactcctaaagagatttctgatcctaagacgatactttatttcccatttatcacacatactcgttctcgttctgtactataaaaaaaataatataatattagatatgatattttctagtacactatctagattcgttgtattagaaaatatagtttgtttttcgtgggaggaaatatcaactttgtacttcatctataccgtggtaggaaattggtagtacgattcaataatatttaccccataaaaaatcaatctgtaccgaatgtgacacattctaatactacgaatttggggtggtgtttggatccagggacttaactttagtccctgtatttaaacactaatttagagtattaaatatagactacttacaaaactaattacataaatgaaagctaattcgcgatacaatttttttaagcctaattaatccataattagagaatgtttactgtagcatcacataggctaatcatgtattaattaggctcaaaagattcgtctcgcgaattagtctaaga

SEQ ID NO: 10611 - DNA, 1501 bp, Oryza sativa
atgatgtagggttgtgattggttggaaagagaatgctagtgaaaaagttgttatattttgagacaaattctgatggttaaaaattgttatattttgggacggagggagtatttccttcatgctatttccatttttcctttttcgcgcaaacatcatcacacatgcacacacatcggtttacacacgctcaatagaataactttaataacagaattattgatccccttgattttatagaaaaacatgtatccataactcagtggagtcgtatatctaggagaatgattctctaacctcatacaaagtctgagaaatctcattcaccctttttgctctctcctcgctcccaatagaggtctttttttttttgggggggggggtgttgtctagatatacccataactccctttatcgcacatatacgagatgtatctctcgttccaagaatatattttctataattgatgatctcccattcttgtatatactatcagagcacagttatgtcaattaatatgcatagcccatgcatatattaagcaagatctgtatgcatcccatgaataatacaacccatatgtgtacctcataatacctccaacacagctattatcacaaaagacatgccaatgtgatggcttattaaacccaataattttgtgatggcatgttaacaattaagattccatccatccatccatccatccatccatcaaaatcaatgagtcggttcgttggtagatggtgatctaatgacaagccccatactaccgaccacctctgcgtcctcatatgcctaacaactgatgatgcttcgaattggttatggctaaagatgaccaatggcatagcatggaccgttctttttgcatcctatggattctggagacgatgacactcacaataccaaataccaaatgcaggttaaccatattaaactacgcttattgcgacgtgcaaacaactctggttgcatcagcagttttgcccctactgcttggaacacatatggttcttgcagggttaagaattataatacaaaggaatatactgcttttaaagattgttgaaatttatgtttgaacctgataaacatttgtcattttcatagagatttctacatttgaaacacaagaaaaaaaaagccttgtgctttcatgcttccagcacacgaagaacatcattcagattactcccttgatttcaccacttttgtaatgcttttgctatctatgcgtacatgacaaacacaaccttgcaaatcaaagcagacaaaagcaacgatcagaagctgcaaagcagctagtgatagggagctggatggctgccttttattattctctagaatcaattctattagtagtactgttcttattaaaagaaaaaagaggctccagccacacgatttttaggaccagctagctagcatcaagaattaaattacaatgatctagggatggcatcagtcagatactgatatcagtgctgaaacagctcccaa

SEQ ID NO: 10612 - DNA, 1295 bp, Oryza sativa
ggggttccaaagaacaagcagacggacggtctagccgacacgcgcgctgcaagcaagtacaatggctaactttaatctaacaaaaacccaagaaccctgaaggggtaactagctatatataggggtggaaggacgacctaggggtgcctagggtcgtgctccaccaacttggggcgcaccccacatgggccccacctgggccggggtcccaaatgaagttacaagcccataggcccattataggtgatgcaataccttgttcctgtgattctggccacacgagatagaattcagagaagaggctggatccattagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcacaaagcatctgcaatcacattatcttaccctttctcttgtttgataacataaggaaaagattcaataaattcaacccatttagcatgtctacgattcaaattattttgagaacgaagatatttaagcgattcatgatcggagtgaataacaaattctttaggccacaaataatgacgccacgtctctaaagaacgtacaagagcatacaattccttatcgtacgtggaataattcaaaacaggaccatgcaacttctcgctaaaatatgcaacaggcttaccattttgcatcaacacacctccaatgccaactccagtagcatcacattctaactcaaaagtcttaccaaagtttggaagttgtagcaatggtgcgtgtgtaagcttgtccttcaaagtgtcaaacgacttctcctgtgtctttccccaatggaagaccacccctttcttcgtcaactcattcaatggtgcagcaaaggtactgaaatctgtgacgaaacggcgatagaatcctgcaagaccaagaaaactcctgacctgtgtgatagtttggggaaccggccaactctttacggcttcaattttcatctcatccacctcaattccctatggagtaacaacatatccaagaaatgaaactcgttccatgcaaaagatgcacttttcaaggttagcaaacaaacgtgcatcacgtagagcattaaaaacagcacgtaaatgatccatgtgttcatccaaagacttgctgtaaatcaatatgtcatcaaagtaaactaccac

SEQ ID NO: 10613 - DNA, 1501 bp, Oryza sativa
ttttgggttccgtaattaatggagggttaatgggatatgctattgtcgtcgctgtactgtactcggtccaatgatgttgtacatctactgttccaaccgcatacgactactctaccagcgtgcgtttggtgattggcgtgtggacggaaggaagtcagccgttgggcccctgctagtgtgtcacaaaaacgtttgttgcgtgctccctcctctggtcgcggtagcgacctgcaattgttgcatcctctcaggggcagtcccaagccatagtattcataagtagtgtctatggtgccatgtcaataagacatcataatagaaactacactccacaacccatagtttcttaaagtgggtcattaataaatacatcatctatcttttctatcaatcatatttattctttatctattatgacggcactattttctcccaatgtaaaacttgataatgtctagtgcataggttctcgtgttgaagctgtttcttacatgagacccagtttcttcttctctccactctctcttaattaatataatgtcacataagttaaaagttctagtaaataataatatagttaatgacatagacaacatcctagatgtagggttaggagtcttcggacagtagcaaccctgttttgactccttttttggctgcccatccacagtcgccaccagaaaattcactgtgcccaaatcaatggaagcgcctactagatccatccatcttcgtgacagctccgagctttctcctggttatttttctcccaaaaatacattcagaacacgatctcaaatttaaactaatggagtgctactgcatttcttaattataagtcgcagcaccactcattaatcatttccatcacaggtaaatcgtggtgagctggtggttgctactgtactactagtactacctgtcgcagctttgtagaagccgttttcgctgaagcttcttcttcttccctgggcaaaataattttaagcaggcggaataatattgggataaacagggtggacaaaagcgtgcgatccctttctttaaccaaaccacgacgaaagcaggttaggtcgcggcaggtggtggtggtaggaagaagaagaaagagaggggaaaaaaaacaaaaatttcacatgcatcatgcatgaagtagtacatgtagtactgagtactgtaataatgttcagtttactggaccgtctcaacgggaagaccaaattaacgcttataaaataccctttttttgggcactgatcatggccactacgtttggtggctcaacaaccaggtcaccgtgcgatcgatcgattgctaatttattttttgaaaaggaagggaggaaaaaagaccgggtgtttggtggcgccaccaaccctgctctcgtgagccgataaatattgctcgccggagctctcggttgacgacccaaccaatcgactcgcaccaccaccagcagctcaagcagcaacagctcaaacggaggaagatctcatcgcca

SEQ ID NO: 10614 - DNA, 1501 bp, Oryza sativa
tacctctcatcgaaagatcgggccacaaaccctagcgggttcgcatcaggaaacatctaattagcataatacttattttccttccctatttctatgaatgcacgcttgattttagcgcacaaaccgcgactaagggtatcgaaattattcctaatttcagcaagctctacccctagctccgcattgcgatccctaagctctatgttctccttgcagagtttcttcacttgtgcagcgagcttatggatcgagggctccggtgatttcacctcgtcttcttggaattggctgggagccctcacaattggagggggcgtcacgtgacgcttcaccttcataggtggagggcttcgggattccgctgccccctccttctccgatgccgtcaaaggccggagtcgacccttaccatacccaccgccgggagttcgcactccctgaatgcggaattgctcctccttcggagtggatggagtagcggtgggtgtggtgtacatctggagcacctcatcccctgtcttagtgaacagggtgcccacatagcgctcggtgggaggcggcgcggccttcccgtcatcttggaaaaggcgacgtgccttcaaaagactgagctctcctgtagtcggccgtcgtgcaggcgaatcccctcgaatttttgtcgttgtgacatagcgagggtagagggatcgcgctgccgaacgggggggccgaacggggccgacaggggttcagccgaactagggagctcgccgacgggctccagattcgcaggggagcgcggcactattgcgaggagctacgccgacagtgcgttcaccccttccatcgtgtattctttgaccggaatgatgaaccctgagttcctctcaacactcaaggctgttgttggcccgatctttcggtgagttgtgataactacgatttaggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagaataaagcaatctgatattgcaaataggaatttaatacaaatgataagtggggttccaaagaacaagcagacggacggtctagccgacacgtgcgctgcaagcaagtagcaatggctaaactttaatctaacaaaacccaagaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcacctttctttttatgattgcggccaaacgagatagatttccgagatgaggctggatccgttggaaggaggacttcgagagctttccgtcaagtactcacgggcccaaaacggagcacgtatgtaga

SEQ ID NO: 10615 - DNA, 1501 bp, Oryza sativa
acgggggtcgctggggagtccatgccttgttttataagggggtgattatgatccaggaaaggtgcgctatggtggattgtgttgtgcaaggggtattgtcacagctccttttcgaggtaccgtggtggtattgagggacatggtgatatgatgtggggctgtgtcttgtgggtacagtggtacacctctgatcagagtaaaactattcgaatagccgtgcccgcggttatgggcgggttgagcaatgtttttcgtgattagtctcacacctctcacaataattatagatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttatttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaagatctaggaggagaagacgtttggcttataccccagttgagctgcctgtgggagtggagccggagcttcgctagattttattttccgctgcagttttcttcatggtgaggactaagtgcatcttaagtaagtatttatcgttttagttaatttgatgaatttgtatattaaattgtcagtttgtgtacctcggctgattcctggacgaggattttatgcacaaataagttcggaaattactagtgaattttcgggcgtgacagtagtactcagtcttgctctcttttccctcgcaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgtatttgtaatcttttatatttttgtaaggcgtgggtctgtatgtcaacaattgttgtttgtgtaccctggctggtcctggacagggatttaatgcacattcagcttagaaattcgggttcgagaatttctgggtgtgacaccatgtcacactgagatataaagtgagtgaggagtcataacattatctatcttgccaaccatcaagtatctgtgatgggcaataaagttactttgacgatggtatacaaggacatctgtggaggcacatcatgtaacttccaaatgacatgactcactctgatcccaatagaatatccaacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccacaa

SEQ ID NO: 10616 - DNA, 776 bp, Oryza sativa
gaacgcctgccgggagggaagacaaagtcgtcgatgccggaaacgaaacccatcgccctagtcggcgaagaacttgacgcttcccatacctggcgtgccaactgttgaaacaagatttcgacaatactaaaagggggtggctatcaggctggaaaagtggatgggtttaaaggcaaggaattttatacaggttcaggctttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactagg

SEQ ID NO: 10617 - DNA, 1501 bp, Oryza sativa
cggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactggtacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagccgtagctgctgcacaatagcctgaacactgctaatggcctggcagtgagactgttgcgcgatcatcctgagctgttggcagcactgctgctgcatgacttggcagtttctcagttgaaacacgggtgattggaagaaggggatttccactgtgctgcactgctgccttacgaactcaccgcatgggctaagcatctgttgctgcagcatgagatgcggctgcagctgatattgcctgtaaacatgagtaacagcatcaaactgcgtagaggcgctgcatgcagcaatagcaaggagagcaaagaagaaaatgatcttcattgtggtgggtttctagttcttatgcttttgctgtaatgtttgagttgtgagaatgatgaagtgggtttacattgtgcttgtctatttatagatgcgatggatgggttttctttgaattccttatcggttgctctagagtgtttgtttttgttggatattctattgggatcagagtgagtcatgtcatttggaagttacatgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcggg

SEQ ID NO: 10618 - DNA, 1501 bp, Oryza sativa
gttcattaacggcggtgtggcggcaatcggggcggcggttggcgcggaggcgtggcgttgcggggccgtggcggcggcggcgtggcgtgacggtggcggcattgcgcgcgcggtggcgaaggcggcggcggcgtggcgacggcggcggcggcgtggcgttggcatgcggcagcggcgttgcgcggcgcgaaggcgtcgtcgtggcgcgtcgtcgtcgtggcgcggcgtctcgtggcgggcgccccgacggagagagatcgagatcagagaagatcgagatgcatgaagggagatctggcggcggcggctctcaccccagagatgcggcggcagcggaggaggcggaggcggcggcgaggacgacgagctcgagacgacggcgagatacagcggcgtcggcgcggggatttgccctaggcagtggcggcgaaggagagaggccgagagagatcgatcggccgaaaacgtctaagtgttggtgaagaagacgagggcgcaccgggaatatatatacccccggatctttactcccggttgttgagaacaaccgggactaaagatatctttagtcccggttattgagaacaaccgggactaaagaaaagatctttactcccggttgttgagaacaaccgggagtaaatatcttttcccgctatttcgaaattctttttaaacccggttagggttaagaaccgggactaaagattatagcactgcatatgattttcccttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaattatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatgtgaaattgccacctgtgtgatttaaaacttttaaaaattgtaagtatcaaatataactagcatatacatgatttaaacttgttgaaacctctaataatcgtgcgtaattaacatatgccata

SEQ ID NO: 10619 - DNA, 1501 bp, Oryza sativa
ccaccaccacctgccgcgacctaacctgctttcgtcgtggtttggttaaagaaagggatcgcacgcttttgtccaccctgtttatcccaatattattccgcctgcttaaaattattttgcccagggaagaagaagaagcttcagcgaaaacggcttctacaaagctgcgacaggtagtactagtagtacagtagcaaccaccagctcaccacgatttacctgtgatggaaatgattaatgagtggtgctgcgacttataattaagaaatgcagtagcactccattagtttaaatttgagatcgtgttctgaatgtatttttgggagaaaaataaccaggagaaagctcggagctgtcacgaagatggatggatctagtaggcgcttccattgatttgggcacagtgaattttctggtggcgactgtggatgggcagccaaaaaaggagtcaaaacagggttgctactgtccgaagactcctaaccctacatctaggatgttgtctatgtcattaactatattattatttactagaacttttaacttatgtgacattatattaattaagagagagtggagagaagaagaaactgggtctcatgtaagaaacagcttcaacacgagaacctatgcactagacattatcaagttttacattgggagaaaatagtgccgtcataatagataaagaataaatatgattgatagaaaagatagatgatgtatttattaatgacccactttaagaaactatgggttgtggagtgtagtttctattatgatgtcttattgacatggcaccatagacactacttatgaatactatggcttgggactgcccctgagaggatgcaacaattgcaggtcgctaccgcgaccagaggagggagcacgcaacaaacgtttttgtgacacactagcaggggcccaacggctgacttccttccgtccacacgccaatcaccaaacgcacgctggtagagtagtcgtatgcggttggaacagtagatgtacaacatcattggaccgagtacagtacagcgacgacaatagcatatcccattaaccctccattaattacggaacccaaaatcgtagtcgaatcgatcgattttgcacctcgaacatcatgatggtcgtgttgtgagcttatagtactcatttccgtcccaaaatataattatttttaacatagtaataagtcaaatatttttaattttgattattaatagcaaaaaagaatcaatcatacaaaattgatgttattaggtttattattaaacaaactatcataatatgtaactctttttatttaaaatattttatttttatatagatatttgttgatcaaagtagtatgtcggcgaccgtgtaattttggaacggagggaatacttcattctcccttcaccaaactcaatatatacacctagtaggcccactgacagggacacacaccaaccctccagttatcgttgaaacgaccagaaaaagctatgga

SEQ ID NO: 10620 - DNA, 1501 bp, Oryza sativa
gccgatcaaactaaatcaaagtgccacgtcagcgaaaccgctctctaaaaccatttagggattcaaattacactggttttaataaattgaaaggtcgagatatccaatattgcggttcagagatatggatcagattggagctataactgaggataggttgggtttgagcgaacttattttttagggtgtttggtttggctgtttgggccttgagaacaattgcgatgggatgatttctaaaaagcaacatttcctttagatctcggttagcttcatgaaaaaatggtggaccaatccaacttaatagtacttccttttctcttattgacatgccggtcacacccttcaaactcttagagcatgtacaatggtctttattagtggtctctctattgccatgcaagtaaatttgatgatatggaagaaagagaaaagaatatggttgttatgcatgacaacggctcagagtcgactcatagcatttattagagcaaattttgttgcatgatggtgaaagaaaggaaaggagagtaataaaaagtattttgatacattaatgattagagaccatattgtctctaactgttgtagaatgctagtctctaaataacgtagagctcatatctaactctatctttgtacatgcccttaagagaaagagcatttcgatccttgtgctaaatacatagatgagaccatcctataaataaaacgatggattctcacttgattccaagccaaacacacgcttgttttagattgatttatttggagacggggagaatagactcgatccaccagcgcggaacgcaccaacgggccatccgatcccgatcacgcggctcacaccgcacgcgccgacgcgcggaggcgcagccgacgcggatcccaaatatcccaccaacatgaccatgagtccatgacacccatccatccgcggtccatccgtcgtcacgccgcgccgctcacaacccccggcgcgagcgcgacgcgagcggcgtgatggagagcacgccgattcggtgacgcagccacaccgccatgcccatgcccatgccgcgcccacgggcaaaccgccaaccacgcaagcgcgtgtactactaccgaagaaaagaagcaaccgcacgaggaaaacaccgaaggggacggccgcgtgcgtgtgatcgatgagcggtgagccacacagtggccgcgcaccgatcgatcgatcagctgggccggccgctgcgctggggacgacgtacgcacttgtcctcatccatccctgcatctgcatgctatctgcgtgaccgcgacacagtggatgacatggcaccaccactgacactccagctgatgccggcctaagctagctgtcggcccagaaagcgtgcccatccctcgtgtatatagagcttggcagcaatgcctctcctggtaacacttctccctgtgtactgcactgcacactctaggcggctgaagcgaacgacaccggcgtcaagagtatcaagcacggcca

SEQ ID NO: 10621 - DNA, 1486 bp, Oryza sativa
cacagccttcctgaccttaccttaataaatgtggtatttgatttaacaaattaatccaccgaaaaaagtcaccgctataaatttttagtgcctgggatcaagagggtcacacatggatcggatcaatacacggtggctgccaagtgtaccttcaaggggcacaacaatccacaccgaatcagctgcaagggtttttttatagtatagatagaagcaacttccatcgatccaatacttaacttattttatccaagtttgcatggcctagtgaagttataagtttggaatggagtatacatgtgatcgtacctgccctgctgtcgcacctccatggcaaacaacaaacagtactatctgatgctgtctacaaaaatcatagaaattaaatgggctgcatataactcttcttcccctgcaagaagcatttgagtgaagccattaaggaatataaccaaaaaaaattctgagaaccattgtacaaaagctcaatgaaatgaaattaaggagtacctgccgatgtaccagatgtgaagaacagattgccaaactgaatccataatattcctgaaaaaattaggcatacagagtacatatatatatcacaagaagatcgatatttaataaaactcaaaacatatgctctgctaacctgaaaccagagagattgaagatcctgacctccctgcaatcatcaaaataaccatacaagtacggttagtttacagattaaaccaagttttttttcttaaaaaacaagcggtcattaagaagttcagtactacttgacttaagtagaagttcagaacttcaggttcaggacaaatgaagtttagacctgcgagttcagccgttcatggaaggttcacgaatcacaccatacttttgctgcataagaagtgtggtacctcagttgcattcacagatcagaatacaattccattgtcttcaatccagtgaccaccattgccctgaaaatctgaaaaagaaatgtttagccttgaaagccatcattcaaagcatgttgtcacactgtgaccgttttagcattcaaagggcatattatcttctagtgatccttgtggacagtaggactgcttttaatctatagcaggctgcttctgatctataacaacggaatcaaattaaagcatcgcaagccctgtacttggtgcctatacactatacaattgttccacatatatcttattatgtcacaagcttctaccttttgtgctgaaaaacaaacccccttgtaatgttcttgtaatggtggattctctgtgcctttgaacctgcaatataaagaatacttcatatgaaaactcaacatgaagtaataatcttagttctgaagagaagggaaatgctgaaatcacataatgcaagcaaagtttaaggtgatattgctgccaatgatgctgacctcgtccaatcagagagcgcgggcggctgatggtgctgccgatggttgaactcaccaatcaga

SEQ ID NO: 10622 - DNA, 1501 bp, Oryza sativa
cctaatcaagttcaaggaagtgatattgaacttagtagttgatgactgaatagtggtaaatatgatttgagtaaatgatttacggaacaatttatcgagtgagatgagtaatgttgttctacataataaaatgcaaaatgaccaaatattagcaaaatcataactcacagacaacaaactgcaggatatctatactgcaaatccagattgcaaataaaatttgccttattctgatgcaaaacaccaacacaattcagcaaaaagcatactaattcctgaaattgtcagtgcactgcttttttgatagatacatacatgcatctctatgccaaatccctttcgattgcagaagctaataatgctttgtttcatgatactttttttactgaatttaagccacttcctttcgaataaacagtacagtataaaattacctgtgcccgcaaggcgtggtgctcggctcgaagcagatctccaaacatatctgcaaaaaaggaaaaaaaaatccaacagacaaattactctccaagaacgtcaaatcaactatgcgagagcaaaatatcagtcgaaataaaataaagcagcaaatccctcttacagcacaagacagctcctcccggaggcgatccatacagggcagctcgctggttgccgctgctttctcggaacaggcctccttctccccaacgacgacggtcttcttttcttcctccttcacctccttcttgccatctgcagatcccccaaattaacaacggatcgagaattcgagataccccaccaagaaacactcaagaaatggatcgatcagcaaagcaagcgagaagcaatcgccaacctgccgtggtatccggcttcttctcgtcgtcgtcgagcagaaaaaccaccggcgggatcgatcccggcggctgcctccacgacctccgcttcctggagcaacgcaacgttttctccggaaccaagaaaaggtacaagaaaccaaccaaggggaaggtgaggaaggcagaggcgggatcgggttacctacctagtgttagatccggcgctcccgccgccgccggcggaggaggaggtggtggaggcccgcctcctgcggcgggactcgcggacgggggtgtcctcgacgacgagcgccgcgtggaggagcgactcctcgtcccacccggcctgcgcggccgccgaccggaaacgcgggctgaggaagctgctggcgtccttggccgccgccgccgccgcacgccgcggcgccgacctagggttcgggctctccgccgcctccctcgccgccgccgccatccctcgcgtggagacgagatgccgttgggtggggaaaggaaagggggaggagcaacggtcggaaatttcgaaatggagaggaatcaaagcgggggcgtttataaggaaggcgtgattggcggattgcttccacgagacgataaggcctgttttttgggcccgcaatactggcccatcaaaagtaatgggccgggccaggattgtt

SEQ ID NO: 10623 - DNA, 1501 bp, Oryza sativa
cgcatccgcagcgccgacctcttgccgatgatcctccagcaggtgatctctgcttgcacagagtcagaaactcataattcgattcaagagattcccaagaattgaactttgtcatggttaattcgcaaaaatgctcatcaagataggctcctacgacgagacctgcagcaaggaacgccatgtacacactaatctgcatcaagcaaaaaaaaacgaaaaggagaagatcggatttgtatcaaagctgagaaatcgaagaaggagaaggagacgtgtagctgttcgtggttgtcgcgcgagaaggagacctcgcgggaggcggcggtggcggcggccttagtgtcgctgtaccggcgtcgtggccgtgcgcggagtagacggcggagtcggcaacgacgctgtcgtcgttgctggcgaaggaggtgttgtgttaggcaccacgacgatggcgcggctcgcgtcggtcaccacgctctgcagctccagccgcctgccgccaccggcgacgggtctgtgcgccgacgaggagatgtcgcggtagtgcgggcgggtggaccgcctcgacatgtagtagtccctcgccgtccgccgaaacagcgcggggcggggaggagtgggccaggcacctgatggcgacgacggcggagggcggcggggtggaggagtcggagtgaggaggagccggaaggaggcgatgcgggccggcggttggcgtccgagggaaggaggcagccacacggcggcgccagacctggcacgacgatgggccgggccgaggcaagggcggtggccgcagtggtcgtcgtcgcgctccacccgccgctcgtcgccgctccacccgccgcctgccacctctcagctccgtcgccacccatctgcgccgcccgccgccgctcgctattctcaggggagagagagaggggggagagagggaagaggaagtagagagaggatagagagaggggatagagagaatgggtagtgaggatgataggtggtgtccacgtgggccccatcatttattattattgtgtgtgaaactgatatttgggtcctatagattttattatatttcggatcaaattgccacgtaaacgccacgtcagataaagaccgagccaaattagccacgtatgtgccacctcagctaaaactgggtcaaatacagccaaaggaacttatttaaacggtttcaagttggggacctatcgtacccggttttgtgatcaagggacgaaaatcagactgggtgataaatagagggatgcaaagtgaacttattcccacaaactcctatgcccgagaagctaaacaatcctggcccggcccattacttttgatgggccagtattgcgggcccaaaaaacaggccttatcgtctcgtggaagcaatccgccaatcacgccttccttataaacgcccccgctttgattcctctccatttcgaaatttccgaccgttgctcctccccctttcctttccccacccaacggcatctcg

SEQ ID NO: 10624 - DNA, 1501 bp, Oryza sativa
atcggccgaccgacgaaagatggtttctccaccagtgtaatggacggagagtacgtatatacgtacccgaggagacatcatgcacatgtcttttttaagtttgatctaacctgtcacctacagagagggaggtagaggcagaaattatttgttcttttttaaatttgatctaatggttaaaaataataggcctaccatgggccttcggttttgtacaccgaaaaccccatgtgttttacattaccattctctgaatccgtagatagtacacacatggcacagttgaatatcacaggctgacatcgttacacaggttaatttataaattaataatacaaggtagccaaaacaggatccaaatagaccgagcatgatcatgtacgttacaaagtaccaaaacaaatagatgagatagaggaagcgaagcagcggtggtctaatatactccacaggcatcgactggtgaacctaggtctgactccaccgtcttcgacatctcttcatcagcatagtgcatgtatggtcaactccaattcctatctaaaagatttagttaagcaagggtgagtaacaaccgtactcagcaagccgccactacatatgcctttagtgcacacaggggttaaaggatggcttggtttctttgcataaagctagttttcataattcatttcacaaacctatgacctagcagttttaactgaaaaacaacgttaagttgaagttgtcattaatccgcgagggttcatccatcttccccaagcctcgcttggtccggtttaccctcccattcagttttccacattcccaacatcataatgaccttcccgcccatcgggcaaggtcacacctcaattcctaatctaagcaagattacaatctatgaggctagccaagagtagtacaagtcccggcgctcaatatccatgagcacgactattcgaatatttaattaatatgcgatcaatacaagaaaaccatacaaaatcctccaaataaagtaacaatcatcctagacccgtagtgccattggatggatctcaattttaggagaatcacggaagttgaacggagccaatcggagttcgcaagatatgaatttctgaagttcatatggatttatatataccgaggaaaaaggatacccaaaatttggaagaggcttcctttaattttgggagaaatattctcaagggtatcctctggacgggaggaggtataatggacttatcctaggatgggcttgtcaaaaagatcaaggaactccaagaaagcaaacagtgcttgtcccaaaagatcaagaaactcgaagaaattgagttttggaatggggacaattcatgtgcccatcacaccatggtgagatcagtagagagaagaaaaaaagagatagaacattgagcttttcgtcatctgtttatctgttcttgtgtgtccgttactcagttcattttgccatcaataatgcagagaaattctggtttgtattggaacacagcca

SEQ ID NO: 10625 - DNA, 1501 bp, Oryza sativa
aaaatctttttgacaaacaaaaaagaattgtcaccacccctacccgtgctcctacccacctctggccgatctagggttagggttttgggagggagagggagagaaaggggagatgaggggaagcacggccgccgccgatgctggtggtgggggggagccaccgtcccgccccccactccctccctccggccagatctgggaggggagccgtgccaggtgccgttgcccccacgtgcgcgtcgccgaccccgcgtgttgccgtggccgttcccatgcctcgccgacgcggaccctgcgcttcgccatcaccggatcccgccgcccctgccgtcgaatgcccacggccactaagggagagggagaggagagatgagggctgctgagggagaggagagctgagggagaagagaggagatgagacttagaaaaaaaatttagcgatgtgtcgcctatttatatgccacgtcaattttcgcaggcggaccacataagaggtccgccttcgaaaatagatttttgcatgcggacaaccatctcaccccgcggttgtcactttagcaagcagtcatttagctccgagaggcctacctgcctgaaaaaaaatgccattatcaagaaaaatggtttttctagtagagcttactggcgaccggtgccaccagcttcttcaccctggccttctccgccccaacagccgccttggctagcagttgtgtgtgcgggttagtcgttttgattgcctgtaccctcaggctatcataaatcatagttttgacatcggcaaaggtattcataagctcaattgctggagtggaacccacctagttaagataagttcaacgagcttctactatagttcctatggcagcggcacgccttctcgctgtgggctcggtgttgtgtctggccgaagcggtcatgaaaagattgcgagaggggaagagtcatgtttttctatctgatgagagtgctttggtgtgatgacataggaaattaagtgacgtacacgttacgacgtgccttaaggaatcagactcgacaggtgacgtacaaataagaacggcgggaacatattcaatatttttaataagtagagatagagatgtatatagtagattagcagatttgatattgcgattcaaatcaaatggtaatatttttccatgggcacgtttgttgagtcaaatgattttcctatatgattttatttttctgcaatagaccaattgtattttcactatcccaataaatagtacctgcaaaaaaaaagtgcaaagcttacgatctctgtagacaaaagtaaacggttcaaaagtaaacggtttgattccaaaactaaaggctttccgtgacaacgatctgtagatcgttgcctatgtggcttactgtcaaaccttgctttaatttgttgttaaaaaaatataggagactaggagagagattatgaatgtaatattcagttgcacttggcacttgcgtatatataatcgatattaattca

SEQ ID NO: 10626 - DNA, 1501 bp, Oryza sativa
ttaggcagtagtttttcacgtttgtctccccccccccccccctcctcccgctaacgcgcccgcggcaacctcctgtggaagacaacatgttaacaaaaaattatcgtgaaagtacaaatattggaatttcgattggaatttaacagagcttgtttttccacctccagcgagctcatgccccctctcacaaaaccatgtgagtgctagcatagcaatctgcgctccaccatggcttcttcctaagcaaggtggcttcttctagaacctgggtgacaaaaaatgttttctgatcgtcgattaatttttatagttattttcactgataaacaatagcaactcccgggatagagctggacgattgctcggtcagccagggagccaactccaccactgaaaaagaaaagaaaaagaaaaaaaagactaacttgtatatataccgttggatggtgattagacggtgaagttaaaatccactagaaaaaccttaaaatagatcaggtaagtgacttatatagtgattggacctatattgcactcgaaatcgaattattagtcaaatttggttgatgcaaagctacagtaggcatccacaaaacacatggaaaataattaaagctaaagaatcttccaaatgattaaaatacggcaaaaaccaaggctatatttagttccgcaaaaattttccagcatgtcacattaaatgtttagacacatgcatagagtattaaatatagacaaaaagaaaaactaattacacagattgcgtgtaattgcgagacgaatcttttaagcctaattgctccatgatttgctaatgtggtgctacagtaaatatttgctaagatagattagttaggcttaataaattcgtctcgcagtttatatgtagaatctgtaatttgttttgttattagtatacgtttaatactccgatgtgacacgctaaaacttttcgccctgatctaaacacagcccaatcataggtggacggtcgtgtagggtgtggatggtaggacagagagatccatgtcgtcctcgattgtgctcccgaggaagggctgatccgtacagtagtagtagtaggtcccctcttctcccacgacgacgcacttgcaacacttggatggcaaccggctaacagcaagaccacaatctagtagcgtgcagcggtctctggccgaccagacgctattttagcctcactttgtaacggcttggggttggggctggtcaaggttaggtcctgtttgggaagcttgccccagctatagcttttctcaaaaaccgcttcggctagaagttgccccaaacagtccacagtttctgagaatctgtagttatagattctgaaaccagaagctggagaagctgggtctcagagcttttccagattctcagaagctggctaccagacagctgcttgtcagaatctaaagctcttctaaacaggcccactccaaaattttttaccctgtcacatcgaacgtttgaatatttacat

SEQ ID NO: 10627 - DNA, 1501 bp, Oryza sativa
tattacatatttataaacaaaattctattattttcttagataaaagattggacaattaattaatacaagctaaatagggaataaagttacaattcataatttttacctacttaaaagattcgtagtatttctacagtcccacccctctatatctattaccctttcgtcccaaaaaaaactcaacttctacagtttaaattttatccaaaaaaaactaacttctaccatcctacctactctcagcacataaaacgagaagttttatctcttaaatatcattgcctacctatcaccattattactttttccaataatgagggctattttgggcatttttactccccactaattttacattgggatgctaggattggccttttttttttgggattgagggagtattataaaaaattagaggtgtttctaccgttccacctctctatttctactattataaaaataaaaaatgtttttgttgggtgcttggtacgttgtccgtctttcatacgtattcgccatccatctttcacgctagccctatcatatatatcacatatatgggtcggcagataggattggattaggggagacctaatggagtagctctcgggaggcccatcaaccgtgcaatactaatatgtgtctgaaagttcaagtgccattaattaggttttggtgattaatgacaaatccaattatgtgatactgatgtttttataagcatttctttgcctagtctcatgtggatatgaaagtagagtgtgtgagaggtgattcccgaacttcttatgagttgagatagaaatattcattgatggtggacctaaatcacaatgatgaaatgcatggagatcaagctatatgtatcactctttctcttcatgtacatattgatacgttcatatataatatttccatgtgaataacaatatacatgtgagactaatgttttgtttgagtcttttctcttgtttagtctctttacattcagaacatgaagatgatgaaggtatacatttattttagtgcttatatttgataaatgcattctattcttgtatagggtaagctcctaatgtttcattcttttatgcatactcttgcttcatacaaacattttgtatgcatacatttaggaggagcaaatcatatattttagttatgcatgtaatcgatccaagttattcactttcatttaattgggatctttacatttgagcatatatttgagtatatgacacttgtggtattgattaatactcatcatttattcatatttttttatacatgtgatgggttggtcaacatgtggaggttgccaaccggatcattgggactaataattttatttagttgaatgaaagaaataggtcccaaggattgcaaatatgttgatgctcaagtgatataattacacctaacaataccaagaatgacaaagtgaagatattgaagatgtgggatacgaagtggctaccatggcaagacggtgaaggccatg

SEQ ID NO: 10628 - DNA, 1501 bp, Oryza sativa
  unsure (1)..(1501): unsure at all n locations
agtgtgtagataattttgtgtggtattagtaaggataaattacacattcagatatagattttgtataagatgatattgttgagatatcgttttaagtgcagggttgaaagactgtattagaccttaagacatgtttttattaaaaaattttactgaacgaaacttttgagnccnaacattcaataagccattaaattttggacaactacttcaatgtattaattaagtcttagagctgattcgaaaatttgtcacttatttagcactatcaaaattagagatggatcatccgaaaaacttaantggggttattcgctccctcttttaattttagagagctccacctgtcatacacacatgtatcttggagtccatgctgcaactgtctacaaatctgtagtccgcagcttttctctgtcctcttttatctccgtgaaatatgtttatagctggcttatagtctggtggtgtacctgctcttattgtgctggtaagctagtaaactaacttttgatgacacggtgaaaattgcagccgaccgtaggcgttactattgatcttgctctaataacccaatgtaataagggggtggggcttatagcccctctctcccaaacaccccctaacacaaccggctgggactcctcacaatttgttcggacgctgtattagagcaagtctaatattaccgtccactactaactccattcatctgtagtcaatctaatagccattttatacagtagttgcttactatattatttatatatggtcccacctgtcatacatacagtgtgtcttagagtccgtgctgcagctggctacagatctatagtccgctgctcttctctcttattatttatctcgttaaaatatgtttatagttcgctaatagactgctattataactgctcttacgttccaaccgttacaggtatcatcaatgcgcattgtgttttttctcacctgcccaagatcgcatcctgcaaagagcaagagcaactgcccaactggcaagagctcagtgtagccagtagtactaccaggtgctcctggaaaaaatgttgaatttgggttcattaattagcgaacagactagccagacaacctgctgccctgctctcaagtttctatatgggcagttaatggcctttcaaaaagcgtactacctctatttcaaaataagtatagtagtaagaattcatatccaacgtttaaccgtccatcttatttaaaaaacttataaaaaatttaaaaattaatcacacataaaatactagtcatatcttataataataataataataataataataataataataataataataataaataattttaaataagagtacacttggttagtttttctcccccggcgccagcttgagtgacaggcacagcggcactgttacaatattgccgcgacagtgccaactcagactgtgtttacgtcaaaattaaaaatttaattaaaaaaactagaatattaggaaat

SEQ ID NO: 10629 - DNA, 1501 bp, Oryza sativa
gtccgaccccgcccgccccgtcctccgtccggcgcgctctcggagctcgctggcttcgtccgcgtggtgcgggaggtgccgttcccgaagcccgtgccgcggaggggaggggccccacgcggcaaggcgtgggagagcttcgcggcggcggggaaggagcctccgccgaagcacgtgccgcggtggctcccgcgctttcccgacaagccggagccggagcccgaaccaaaggcggcgtacgacgaggcgacggcgaggtgggaggcgcgcgttcgccacgaggaggaggcgaatgcagaagaagcggtggtattgaagccgagcgttgatggcggcggggagcgcaggggagtagtaccggagaagagggggaaagtgagcttccgcgtgcgggcggagaggaagaagcggcgggtgggattggaccagcagtgaggcggtggcttcgaacggttcgcggagaatcgagaaaaatccgcggcaatagtgcgggcggcgagcaaccaccgctcggccgtggccgtggagaatggagatggacgacacgccgcggcgttgcccggtgacccctgtccagtcgaggggttgaagaagacttgacgagttttgggctctgcctgggccacacgtggcgcctataggctactagcccacgagccacctgccgtcgtggctgaactggccgaaaaggtcaagtgtgtgggtgattgtacaagttataattgagttgccacagtttatcacaaattttggctttagtttgttcacgcggtgaatttgtggcgtagagctggtggtttcaaatttcacagtactctgcttgatatactaaaagatcaatttcttgttttttgaggacgtctgagatcaaatccacatgtatccctgaagactccctcggcgattcattcgatcatccctcctgagtcctgccttggattcgtgatttctcgtgggttcctcaccgtgagattcatcattttcatcttcagatcttgacttgtggagacgatgaactgggtaaccgagattcccatccattaaacaagaagaatcccttgttgaaattaaagcaggaactgagacaaagatgcaaggaggaaaggcaacagttcagagtgctttttgacatcaacgggatacagagaaaaactacattgttaacatcaactggtgtaatagttatgatatattacatcgaattgctacacatgcttataaacagaacatacagtcgaagaaactattaattctttggacagtaaataacaggcaaatctgaatataactgaggggattatacatgacatcagagaaactatgaactattgactatgagatgaatgcataagattagctaaatagacatcctaaaatgctgaagttagtactttacaggagacagctatgccaaaagccatttttatagtcaccaacactgttgctctgcaaagaatttcccctccatggagtcattggctcaactactgtgtgagaacca

SEQ ID NO: 10630 - DNA, 1501 bp, Oryza sativa
gtgatgctgctccatatgtacgtgtacgcttcacgatcctgtgttcgcttgcggtgatttggtttgaggctaattgccaacgaacgcaggctctggctaactactaacctaggaacatggaatgatgcttgctggactagagatagtactagcatatatatacaggtactggtggttgcggatgttgtctgttggcgtccacacagaacattacaagagatgagggtagtagcttagctaggtgtttgatgagacgatgatcagagctgtggcatctacagttagtaagtgctatttatgtgcacacaagtacactgttccggggagtatggagaaattgagccttcgataattggtgtcacaagctccgatcagaagtgataatttgttcgatggcatcagctccctcgctttaagcatacgattctatctccaaaactgaaacctaagtatgcgattctcttggatggggaagaagtttacttgcttaaaggggggataattaaagtgggaaccggaacaaagacaaacgaaacgtgggctcctcgaatctacatgcaaggaagagagaatcttatgctgaccaaagtaccaaaccatctctctctccctggctagctgtagtagagtagtaccgagtaccgtcacttgaaccacctaacacctaccgccgtttactgtcgcaggcatcggattccagcaggattactttggctatgcatacacaatttcatgtcttatcatcagctattcaccgtgggaattttattccaggttcccaattttggcttacacaccgatcgggccaaacgtgtgcactgatcctcacagcgatggactcgcaaattgcaaccgtgccgtcaccgtcgtcacagtttagacagcggctccatcgaccacaagataatccatccacttacgcaggcacctttctctgacgaccaacacaaattgcgtctcgtctgcatatctgtcgcggcagcgactgccatagtgccatcactcgcgggcgtcacgactccacactttacaaaaccagcacagttatcgcggttattacgtgcgataaacttctcagcttttaaaatcacgatatatctcatggtaaccgtgtagttacagtgatagttgttaaactgtgaggtggtggtaaccccaacccaaaacgatttagagaaaccgacgactcacgccgatgcatgccatgcctgcatgaacggcggcggcgatcgatcgggccggggaggaattgaaggctaagggagaaaaaaaaaaggagtattggaggggtggggcggcggtcacaaccaagttggcgcaaatattcctcccgggcgaggccaaggcaaagccacgcgacatctccccgcgtctctctcgccggccgccggccggccccaccgcatcgccccggctagctagcttagctatggctctcgatctcaccaccaccctttcgctctccgccccccggctgctacttgcctgccgccggaatatt

SEQ ID NO: 10631 - DNA, 1501 bp, Oryza sativa
taatgcctcatttggcgacatctttaggtttgcttggaaactgttgttgtaggagaattcggtgtagggcaaacatctctcccagtctttgctaaaatccaatgcacaagctctcagcatgtcctccaagacctggtttgttctctctgtctggccatctgtttgtgggtgataagctgtgctaaacgcaaggtaacttcctagggcttcatgtactttctcccagaaatgcgaggtaaactgtgtgcctcgatcagatataatcctcttaggtataccatgaagacacactatcctggtcatgtataactcgactagcttggcactgctataatttgtcttaacgggaatgaatctcgctgtcttggtgagtcggtctacgatcacccagatggaatcatatcctgttgcggtcttgggctgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaagggggaacacaaggacggtttgtggctatttgcataaaggcggttgtaaaacattttattgagcaaaacagtaaaactgttgagtaattaaagtaatattaaatctccactgatcaacgctacaccacgttgaacaggcccaaccaacccacctgtactacagtgcattgggtcgatttattaggtgtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgctatgggtgcgactcgcaaaaccatgcatccacagcccaccattcagtcgcattttagttggataattacgaccataaaaca

SEQ ID NO: 10632 - DNA, 878 bp, Oryza sativa
attttgtgatgtgatgtattatgatctgtgatgcatttcttttcaatatgtgatgtatttctttccagatctatgatgcactttgatttggggatgatttgggaatatgatcggggatatttagggagcaaatcgattttaaaaaaaaattaaccgggattgctcctaccatctttagtcccggttggtaacaccaaccggggctaaagatggatttttagtcctggttatttcacccgggactaaagatacccatctttagtcccggattcgtagtctcggttgtataaccgggactacaggggtccccaaccggaagtaaagcctctttctccaccagtggatccctactcaaccaccttccttcctaacttctccaccaacgttgggtggctgggaggagatggagttgagggaggagggaggggggagggggtgcgcgaggggtggcgctgccatcatggtccatgtaccctaagatcggcgaccgacatggccacatgaggttggaggggctggatccggaagttgcagatccttgacctccagtgcgtcggacgaggagcggcttgccttggcctcctctccgccgttgtggtgttgccttgatttatttattttaaagcggagtaagtatcaatatagtggtgccaattatatgaattataaaatgtgtactagctcgatactaaaataagttaatctagtattgaatgcttcacatcttagtattatgaatctgttcaaatttatagtattaggatgtgttatatccgatactaaattaacttattatggaacggaggaggtataaggtacttaacaaatattcagtagctagtgacatactcatgctactactatacacatattatagg

SEQ ID NO: 10633 - DNA, 1501 bp, Oryza sativa
  unsure (1)..(1501): unsure at all n locations
cgagggaggagctgccaccggcggcggcggcggcgtcaccgagctcgggcgtcaccggatgccgaccacgctaccgtgctcggctcatcaccagcccacggagcgccacatccatccgcatgtcgtcgtcgtcgccgtcaccacatccatcgcatccatctctctctctctagccaccattgtccttgtcactgcagcgggacaacgccactcgtcggccaccgcccgcactcgtctcgctctccggaaacgcaatctccatgtcgtcggtgagggcggcgccgcctcacctcgctctccgcctcaccgacaaacggacaccgcggaaactcatcaccaacaaccttccagtcaatgctgtttgaggggagattcagagaatcggaagcagttcaatcccaaaagcaatttcattgttcctaaatcctaatcccttcgcttgtcgccgatgagcgcggcgacggagaaggggcggctggacggcgaggaggattcaccgcgcgcggaggcgttcctggagatcctcgccgggtccagtcgggggatgcggaagcggaggtcgcggagcaggtgctcaggtcccgcgtctgctactcccgtcccaagtccgccgtccgcttcttcgtctggtcggggcggtcggtgaatcacaccggctacgcctggaacctcctcgtcgacatcctcggcaaggccggcatggagtagcccatgtgggacgccgtcctccgtccgcaccatgaacaaggagggcagcggcctcgtcaccgtcgccaccttcgcctccatcttctcctcctaatgcgccagcggcaaccacaganaagccgtcgaggccttcaatgtcatgggaaagtacggcgtggagctgaacgcagtcgccctcaactcccttctctctgtcatgtgccgcgggaacgaccgcgcgcagacggcacagaacctgttcgagcacacctgccgctcttaccacccgtgggcctcctcctctgccgtctcgcttcgccgacctcctccccaccagccggcctgccacgcccagcccctcccctgccaaccgtcggccgcggcccgtcgcaccagcctgccgagcccgctgcgccggcctgccgcgcccagcctgccgattgccgcctgtggagagggaaggagagagagaggaagagagatggaggggtggggaagaagaggctgacgcgtggggcccatgtgggtcccacgctgagtcagctgccacgtcggacaaaaccgggttcgaaaccgccgagggatttgcactggttttataggttgagggacgcgttgtatccggttttgtggttcaaggatgattttgtacctccatgacaagttgagggaccttcggtgtactttttccattacagtttgggttgaacatgttgggccttgccgcttacggcccaattttatgtgtccaatcataacccgatttcgttgtcaatctgtgccttcacggcttctcagacttctctcctctatc

SEQ ID NO: 10634 - DNA, 1501 bp, Oryza sativa
  unsure (1)..(1501): unsure at all n locations
ctgtgccgtctgcgcgcggtcgttcccgcggcacatgacagagagaagggagttgagggcgactgcgttcagctccacgccgtactttcccatgacattgaaggcctcgacggcttntctgtggttgccgctggcgcattaggaggagaagatggaggcgaaggtggcgacggtgacgaggccgctgccctccttgttcatggtgcggacggaggacggcgtcccacatgggctactccatgccggccttgccgaggatgtcgacgaggaggttccaggcgtagccggtgtgattcaccgaccgccccgaccagacgaagaagcggacggcggacttgggacgggagtagcagacgcgggacctgagcacctgctccgcgacctccgcttccgcatcccccgactggacccggcgaggatctccaggaacgcctccgcgcgcggtgaatcctcctcgccgtccagccgccccttctccgtcgccgcgctcatcggcgacaagcgaagggattaggatttaggaacaatgaaattgcttttgggattgaactgcttccgattctctgaatctcccctcaaacagcattgactggaaggttgttggtgatgagtttccgcggtgtccgtttgtcggtgaggcggagagcgaggtgaggcggcgccgccctcaccgacgacatggagattgcgtttccggagagcgagacgagtgcgggcggtggccgacgagtggcgttgtcccgctgcagtgacaaggacaatggtggctagagagagagagatggatgcgatggatgtggtgacggcgacgacgacgacatgcggatggatgtggcgctccgtgggctggtgatgagccgagcacggtagcgtggtcggcatccggtgacgcccgagctcggtgacgccgccgccgccgccggtggcagctcctccctcgccagccgccacccgcgcccatcttctctctgccaattgcccgtggagagaggacagagagagaaagaggtgaagaggagaggggaagaagatgcagacatgtgggacccacgtgggtcccacgctgagtcaactgccacggcagataaaatcgaagtcaaaaccgtcgagagacttagtttgcactggtttttgtaagttgagggacacgttgtatctggttttgtggttaaggacgattttgtaactcgatgacaagttgagggaccttcggtgtactttttccaattgcaatttagcagggcaataggccctctggagtctggacgcaaacgtgcaaactgttgctagttccatttggatttacaaaacacggtttcattcttgcatgaaaatactacctccattttttaatagatgacgccgttgattttttcttacatgtttgaccattcgttttattcaaaaaatttacgtaattataatttattttgttatgagttgttttatcacttatagtattttaagtgtgatttatatcttatacatttgcataaatttt

SEQ ID NO: 10635 - DNA, 415 bp, Oryza sativa
aacattggattctgctgtccacgacgatttatgtcttgtggcaaatgcaacatgcgattggcatgatgtaaaaaaaatgcattcacttggagcatgtatgatggatgcagatacatctaaataaatgaaagatgaatcctttcttgcaaagttaacgcatccacgtcatcaacaaaacttcaaccattcgatattttcatgagccaataagaaccatcagattccccaaatggataaagaacataaacatccttcatgaaacttataccaaaactagatccttccatacccttagaatcgattcttttatatttaccccctcctccctccccatctaccaaagcacgacccctcctctcctttgcgtgctgcgccacaccaccgcctccactccaaaccccctcgtcatcccagc

SEQ ID NO: 10636 - DNA, 1501 bp, Oryza sativa
cattcagagggtgtttagatcaggagtgtaaagttttggcgtgtcacatcgaatattatatagggtgtcgtatggggtgttcggacactgataaaaaaactaattacagaatccgtaagtaaaccgtgagatgaatttattaagcctaattaatccatcattagcaaatatttactgtagccacattatcaaatcatggagcaattaggattaaaagatttgtctcataaattagtcgtaatttggtaattagttattttttagcctatatttaatacttcatacagtgttcaaacgttcgatatgacaggatgaaaaatttgaggggatccaaacaggggctgagaataaaactcaggtttctaagtaccagctctgaaacaaagaacagaagcaggaactcagtctgagtctctgagatagagataggcagatagctaatacttgtacataataggagcaacaattaacgagagaacgggtgggcagctgttccaatcccatctcaataagcccgtgaaccaacaacggcgggcaatctgtttgacatatgtaggtcggccagtttgtttgtacctgtcacatgcagcgtaactacagggccactgcatcttcaaacggcacaacacaacaaacttcgccggagtacatacataatcgattcggctgtcgccaccacatccatatgcaaggctagaacaacattgctccctaaaggaagcggcagtggggaagtatttttatgagttcatctcgtgttgtttcttacgtaccatttaaatagttactctctctgtctataaatataaggagttttagttgattatggcgcattttaatatttcaaatctagacagtaaatatgtccagatttatagtactagaatacgtctcatccactcaaaattccttatattttgggacagatggagtataaagaataaataagatatattgtactagaattaataacataaaatacatcactctataatagtttatctatacagatctattctattagaaatacatcactctatctattctattagaatgcgtcatatctatatgaaatcccttatactatgggatagagagagtatttacttaatacagaaatcgtgattgttattaagcgagaaggtagaaacatcgacagtagcacttggcagtgggtgacacgagcaggtggtgagtggcgccaaatgaagccagcgcatgcagctgtactagtgaagtgatcgatccaccgccatcttttattttctttttctctagcttgttgtacttggtactccacaccactagctagtaatgtggccgctctctcctcaccgacggcatctccagcagcacgggcattccggcgccatgggtcggcggctgttgctgctcttcctaatgctggcacaggcacccaattccaatggggattccaagataaagaacgtggtggtgttggcgctggagaaccggtcgttcgaccacatgctggggtgga

SEQ ID NO: 10637 - DNA, 244 bp, Oryza sativa
agcgtaatctataaatagggatcaaatgaaaggtggagataattcaggtgttacataaatacaatagttctcttgttaattaaatgtaggagctggtgaatgggattacaaatttccggcagattttgccggattttattgggatctgggtgggtgtccggtacttttgtacttacgtttaatgttgcggtgttcctcttcattgggcacgggcacatccaaggttacatcagtatgtgaaaga

SEQ ID NO: 10638 - DNA, 1501 bp, Oryza sativa; identical to SEQ ID NO: 2735

SEQ ID NO: 10639 - DNA, 1501 bp, Oryza sativa
catctttttatttcaactactcccacattcctttatatatattgtaaaattaactggggcactatggtgtccaggcaccaagatttaaattgagtacatatattcaatttaaatgagtatgaatttttttaaaaaaatgtttagatatgatggttgtaaggtggttttcagtcggttcatctgtaaccgtgatcaccatctaatagggcgctgccatgtgcaaagggaaagctgggggacggtaagtctggttcggctcccaccgcctctagccatcgacttcatccagtgaatgacaggtaggcctctatggtgactgaggttggtttggccctactttagatcggtttcaactgtcatgtgagccctccaatctttttactcacgtatgattgaccggaggttcattttatggcatgacatatgtatttttattcataaatgacctgcataaatatatttatcaaaactagtgaaaatggttagcaataaactcctaccatcaagttttgatataatattttatattctttatacaggagttgacggtaaagtttacacttaatgaccgtcaacaataagcgataccgtggcagtttcgcgtagccgcgtgctaacctcggtataccggtattgcactcctaccccgcgataccgatggaatatttcttccaaacaaatttcaaccggtatatttctttcaaaaaaaaatcaatatcagtattcatgcaatttttgttcaaagcactactttcgctacagtacaatctctaaggaacagcccctacatcaagtgccactgtactattgtcgtatactatttctttcttttccaccgttgacgttttagaacggagggagtatgtatatatcgtctgtacattagatttgctattttggtactttcagtgtcctttttctgagtactagctgaataattttgtgttcgctattggagggtacactaagttgaaaaaagaatttaaaatagttttgtaagatgatttaaaatataagtatttatatgattattaacaaaactaaggcagagtgaaaaaaatatcttttagtggttaaattttaaattgtttatatatccctttcaagcatcggatgaaaatgtacagaacgatttttgtgcactggactgagtgtcccataaatacttatattgtggcataaatttttgaatactcaaaatattttgaaacaaaagaagtatatggaaagtgtgtaccattaatccaatctttcatatgactgtcaacgccgtaaatatatctgtaatattactctcagtacagttaattagcatatggccctgaaatttttcggccgaacccggcaattttatatttatatatacccttgccttgagcttaggcatcatgtagcctcgccgctcaagcatcgctaactcagttatagctgtctaacaaagcaaattagctttcgctgagctttgtgttgcttttggtctcctagataggtttgtgaagca

SEQ ID NO: 10640 - DNA, 1501 bp, Oryza sativa; identical to SEQ ID NO: 2729

SEQ ID NO: 10641 - DNA, 1501 bp, Oryza sativa; identical to SEQ ID NO: 2733

SEQ ID NO: 10642 - DNA, 1501 bp, Oryza sativa
ggtggtttgatcgaatcatttactttatttctttctgccatttaatctttctaatttttttatttttaggagtattttatagacatacgtgatatatatatcaatgtatagttagtgtacttgcttcaatgtacatgatattaggcgtggagaaaaaaaatccgaagaccgagaaccgaaccgaagaggcggtttgtccggtcatcggttgattgttattttcctgtagttcggtgtttggctttttcttcagtgaaccgacgagaccgaagaatccgatgagtgttcagccaatccaaaatgctcgaggcccactaacaaacgtgcgcatcaagcccaacttttactgtggcccaaaaaatacatgacagctaacagatccaacaaattctattccctctctccaaatcaagcacaggccctcgggcagagctgggtaggccgtgtgtacttgcgggaagtcgaccgcagtgtacggcataggttttctcggtaaaaactgaacaccgaaaaaaaccaaaccgatattttttggtttattttgctcggttgatattttttctagaacttcctttggtttgcattttacaaaaactgaatgccgacacaaacaaaaattgactgagctttctgcacgccggactgggacatattatttggatctgcttacatggctgctttatcctcatcaagtttggatcatgctcctcttttcttggtgggctgtgaacagagggaactaaatacctcttttcgttttgaagcttactggcttaaattccctgagtttttggaagtagcctctgaatcttggaatagaccaattagaggatcaaatccctttgcaaagctcaacttgaaactaaaaagactagcaagagatctgaagagatggagcaaatctcggattggacatcagattgcagtatgcaatcgcaaatgaggttattttccaacttgacgtggcccaagaagagagagctcttacagacgaagagcttctgctgaaatctactctaaaatctagagttttaggccttgcaacactagtgaagataagaataagacaaagagccagactaacttggttaaaatgtggtgatgttaattcaaaattcttccatttgaaagcaaactcaagaaaaaggaaaaacttcattccagctctaaacactccctcgggtatagctgtaaccacagaacaaaaggaggctgaacttgagagatatttctcccagagattagggcagtatgtcccatgctccttaactcttaattggtcagaattaagtctcccttcccttgatctgtcggaactggaggaagatttcacagaagaagaattaaaagaagcaatatcaaaccttcccccaaaaaaacacctggccctgatggctatatagggcttttttcaagaaagcttgggtggtgattaaatcagatttgctacaggccattaaccatttcagctctctgaactcagatagattggaagacctaa

SEQ ID NO: 10643 - DNA, 1342 bp, Oryza sativa
ccaagtttagctcgttttatctttttccgctgcatttgtaatcttttctatttttgtaagacgtggatctgtatgtcaacaattgtcgtttgtgtaccctggctggtcctggatagggatttaatgcacattcagtttagaaattctggttcgtgaatttctgggcgtgacagtggatctggtgacggctcaacgactaagagaagaggtggcggcggctcgaggaaagaaggagcagcagcgaggcagatcagatgaaggcttggtgcgtgcgacaaggagaaggagcaatggtggtggctcagtgacaaggagcagcagtggtgaggtggatcaaatggaggcttgttgcgcaggcgatgagaaggaggagtggcagggcggatccggtgatgaggaggcccgggcggtggattcgatagagtcgaggcgtgcaagctctggaactagtagcggcgggtcggcgaggatgttggctgcagcggcacaacctcccatccacaagctatatgcatcggcagcgacggcattatccggcatacagtaagggcaaggagacgacgatggcaatgacattgcttctcctcaatttgaacaaggaggacgattggcgatgatgccgctccttctcgctccgaacgaggaggacggctggtgcttctcttcttcgatccaaacgagagaactacgggcgacgggcggcagaacggttgaaggtagcgggatccaccagcaggcgtgcgtgcgacgagtgatgaaggtgaaaatttttgttggaattagaactttttactcatgtaatagttatgagattatcactatcaaacacttgtcgatattgattatattgaaacaaaaaccattgagaagtatgatcaaatgagcaagggcgtaaatggtttttttttctttgagttaacactgtcggagatcggtactcctacaacagggaagagaagaccccctttcgagattcggccaggggtgagtagggatcaatttcagattgtgtgagcactcaaacaaagaaaacaagcaaatatacaggttcaggccgctcggaagcataataccctactcctgtgtgctagcattatgtaagatcgagaagtcgacttgggggggggggctgaataggcgattaaaattaaaacacacctaatcaaaacttacctaagttgctaggcttggtgagggataaacttaattaagcaactaataagttatgttttgcaatcctagggtgctatggactcaaatatgtctctatgaaagtaaattgcaactaagtgatgttttgcaatcctaaggtgatatgggctcaaatatgtctatatgaaag

SEQ ID NO: 10644 - DNA, 1501 bp, Oryza sativa
tcattccgatcatatcaataccccatggtttaatgataggattcatagccgacgccggtgcttgctgaattgctccaaatttctagcagtcttgacaccctttgtaatatctgaaataatcttccagcattgtcggccaaaaataccctgaacgccaaagtaaccacttcatcttatgaggcgattgatgagtaccataaatcccttcatgaacttcgccgattgcaaccttagcctgatcggcactcaaacacttaagcaacaccccatcaatcgtccgataatagagctcatcatccaataaagtatacttcaacgccttatatcttaatttccgagaagccgattgagatggattctgtaaatattgatgcacatcagacctccaattatcggctgttattgctgcgacctcgaccttaacatctttgatcatcggcttataccccgatgccccctaggccaaatcattagcttcaatattttgttctcgagatacatgcttcaaagataaccaaccgaaattccttcatcaattcttggcacttctcattataaaccattaatgtatcattcttgcactcatattctcctgccaattgacttattgctagcaaagaatcccccatgatttcaatagcatcggcttcaacctccttgagtaactgtaaccctttgagcactgcttcatactcagcttgattattggttgcatacggtttgatagtataagcaaactcaaaattcgcaggggaaataataaccaagccgatgccacaaccatgagtgcacacttacccatcaaagaataaagtccacggtacgatctcaaccgagccgattgaatcatcacgatgctctacaataaaatcggctatagcttgtcctttatcgcccgactcataccgaagatcaaactcagttaaagaaaatatccactttccaacccttcttttcaaaatcggggccgatagcatgtatttgacaacatcggccttgcatatgacagtgcattcattagactatagataatgccttaaccttgtacatgaaaaatataagcacaagcataacttctccacaggggaatacctagtttctgcatccaagagccgacgacttagataaaacacaactctctctttcccttcaagctcctgaatcaaaccgagccgattgacttctcaccggccgacagatataaccgaaaaggtacccccttctggggaggaatcaaaactggaggagagctaagatattccttaatatcgtccaacgctttttgttgctctaccccccaagtaaactgttgatcggcattcaatctcaacaatggtgtaaaaggctctaatcttccagacaaattagaaataaaccttctaacaaaatttatcttgccgatcatctcctgtagttctatcttgttcttcggaggctgaatcttcttgattgcattaacactcctttgagttacctcgattcccctatcgtgaacaagaaa

SEQ ID NO: 10645 - DNA, 1501 bp, Oryza sativa
atagccgatttaaggaaggtttttgagagaaccaggaaatatggcctaaagatgaacccgacaaagtgtgctttcggcatatcggctggccagtttttgggatttcttgttcacgataggggaatcgaggtaactcaaaggagtgttaatgcaatcaagaagattcagcctccgaagaacaagatagaactacaggagatgatcggcaagataaattttgttagaaggtttatttctaatttgtctggaagattagagccttttacaccattgttgagattgaatgccgatcaacagtttacttggggggtagagcaacaaaaagcgttggacgatattaaggaatatcttagctctcctccagttttgattcctccccagaagggggtaccttttcggttatatctgtcggccggtgagaagtcaatcggctcggtttgattcaggagcttgaagggaaagagagagttgtgttttatctaagtcgtcggctcttggatgcagaaactaggtattcccctgtggagaagttatgcttgtgcttatatttttcatgtacaaggttaaggcattatctatagtctaatgaatgcactgtcatatgcaaggccgatgttgtcaaatacatgctatcggccccgattttgaaaagaagggttggaaagtggatattttctttaactgagtttgatcttcggtatgagtcgggcgataaaggacaagctatagccgattttattgtagagcatcgtgatgattcaatcggctcggttgagatcgtaccgtggactttattctttgatgggtaagtgtgcactcatggttgtggcatcggcttggttattatttcccctgcgaattttgagtttgcttatactatcaaaccgtatgcaaccaataatcaagctgagtatgaagcagtgctcaaagggttacagttactcaaggaggttgaagccgatgctattgaaatcatgggggattctttgctagcaataagtcaattggcaggagaatatgagtgcaagaatgatacattaatggtttataatgagaagtgccaagaattgatgaaggaatttcggttggttatctttgaagcatgtatctcgagaacaaaatattgaagctaatgatttggcctagggggcatcggggtataagccgatgatcaaagatgttaaggtcgaggtcgcagcaataacagccgataattggaggtctgatgtgcatcaatatttacagaatccatctcaatcggcttctcggaaattaagatataaggcgttgaagtatactttattggatgatgagctctattatcggacgattgatggggtgttgcttaagtgtttgagtgccgatcaggctaaggttgcaatcggcgaagttcatgaagggatttatggtactcatcaatcgcctcataagatgaagtggttactttggcgttcagggtatttttggccgacaatgctggaagattatttcagatattaca

SEQ ID NO: 10646 - DNA, 1501 bp, Oryza sativa
tcttttttctgtttttttttcagccgcccctagcctcctcctcctcctgtttagccgcctcctccaacaccctagccgccgctgccgctagccgtcacccttcgccgtcgtcgtcttggtcgtcgctgtcatcttatccggtgagctttcctctctcccatgtcatttaccggtgtagtttatccctagggatttaatctaatctaatctaatctaatctgttgtttggccctagcgtcgtcatcgtatccgtgtgttgtcgccggatcgtcatcgtcgaccctccctctcctgtccctttggtttggtgagatttctattcgtgtcccctcgggttaggtttagatccctcggtcgtgtcaccgccgctgttgctctaaccctagcgcagctgttgccgtgtcgcttgccggctgtcctgtgcaccgccgctgtgctagctgccttgttgccgctgcgtcgctatttagtcgctgtacgtcgccgtcgcgctgctgctgtaggtgtgccaccgcaaccgctgttgtgccgctaccgtgtgtcaatccaagccatccgatcttggtcgactcggtcgagattaatctcagccgtccaaaagcgatataaatccgttctctcttttcaatggcatattattcctttttaatatatgtcatctaccaaatatgatctaatctatttccggttttaatcttttgtctcagctataagtcatttataaattgtttaatcaatttggaatagtcttttctttaataggtttaaatggaattaaatcctgtaaaattcatatctaattcatacgaactcggaatgaggtcgttcaagtctcataattcatctaaattcaagctctacctatttatgaactttaattgtactgtttatttgggtttttattagtgttttttcttgttttgcgttctaggtttagttttccgttatttcggaggatcgttcgttcgttggagaagttcctgaagacgaattgaagatgcttgtttgcaaggcaagtcacacagatcccaaacaagcctttgagcatgttgaacccgtttaaagctaatgttttatttcaacttatgcattattttagaatgtcatcgggtggtgagcctttcccaattaattcatggccgaagatgactttattttcctatgggttataatttgactagcatggaccttatatattggattggttcagctagatgttatttatagttgcttagccatgcttagaaacaatagctcattaatgggatgaatcatactacattattatttatggttatatttaatggtagctcacgatattcagtcatgttatgataattaattggtaattaaaatatgattaatggtgggttgtgagcacatggttttgaaggtcgcgctcatgacaattaagaaccggttcgcgagctattgttgtgagacattaaccgtaccaaccacaagccagcgtgggcaacggctttatcttttgtatagcatg

SEQ ID NO: 10647 - DNA, 617 bp, Oryza sativa
tgcaattgggcggcgagggggggcatgaaatttgcagccggccccctgccgccctccgcgagggcgattttgcactgtgcgggggcccgcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 10648 - DNA, 1501 bp, Oryza sativa
tcagcctcggcgcacattctcctctcctattcctcccgagttgaagcctgaaagggtagcctcataccctaaaaaaagagaatgttcccgtgagtccaagactgacgccttttgttgattccgggcccttagatgcatgatcagatgcgtgatggttgagattgtccccaacgtgcaggtcaagcacagctccaaccctcttcgctgcttcgtcattgccatcaacaagcttcgttgtgttgtccaccatcgttctctttgctgttgtgcatccaacgtgcggggccccgatcgggttccgaggacccgctagggtgagggtgggggcgggagatttcgccctaaactcccgaactcctggtcagggccgggggtggggcgaagaatgcggggacagggccgggggcattctacctccaccaggccccgactcatcccgttgccatcctattcacgtgtcgctatcgtcctcaccgctcaccccattgccatcctattcacgcgtcgctgatcgtcctcaccgctcagtctcttacatgcaaatgaggtggatgctgcaatcgggaacttagtcgagtcgctagatgtggagaaggaagatcgtgagattaggaattcgtggattggggcatgggaatatgttgtaatggttcttttttgaacccccaaatcccaaattgggatcgatgtgtggataccataggtgatgcttaccaaccttcagtttggaggtagtctttaaaaaagtttcgaggtggatagcacaatgtcgtctcgtctacatgcactctttgcaatccatatggtgaacaatgccgtcgtttaactgaagtttcaaaccattgacacgacagttgaaagtaacttcaataatttccaccattagcaaccagcaccgccgaagatgtactattcgccgctaattgccttccaagaagccattgttaacgtgatgagctctacgttttggcaaacttcagaaaccaaaacagtgaagcgttggtagttatccactacggatccgctttggatgagcttatcctgtacttcgaaaggccatatatatagccacatcacagatttccccaatgtacatatcacggaaaacattcagtatttctgatcactggaccatccagaccagttagttttgcgtgccatttcaagactagtatgacgaacctaagtctgcaggccagcaagcacccactgcagcaaaactggttcaccacgtttgtcccttccaatgagaattttttttatttataattttttttattaaaagttttacaaaaataattttccattttgaaaattgacggaaatagtcgcctaccgccctctgggaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggc

SEQ ID NO: 10649 - DNA, 1501 bp, Oryza sativa
taatatatacgattcatcctggcggacctaatagaaattttacctcatgattcgaaccctccaaaatttcattattgtgttttgatatgttttatgtatgtaaactttgtgtgattaaatttgaaactacaataatggagtagtcttgaaaacaaagatattattgtattgtagttacctttttctaaaacaattcacgtgtgatagtacgaggtttcatatcaatatagtgagaaaaaaagaccaaagcactggtagggtataatcaagaaaaacaaaagtaccaaactatgttgcacatgcacctacaacacaagcacccactgctaatgaaaatccattcatgcctttgggtggagggggatatggtgaaagataagaatagatctgatctcccaccagcatggttttcttgtgatggctatggtgtcgtcctaagagaacaatccatttggagaagagtttgatagaaacgaaccttcaaacaacgcctccacgaaggttgtgacactgtcgtcacctcttttggaaaattaggatgtggttttcgaccaaagaattccaccatgaagagaacgagagacgcagatgatgccgtcgtcgctcaccattaggaaactaggatgtgatttttcacctgaaggattccactagagaaagaatgagagataccacgaaagcccccacccccgggagggggtgggagggggggactacgccgcccaaaagcatcgggactgccgctcctcaaaaagactgggttttcgcttgaaatcgtcggcccactattatgattacgtccctaccattaatagcaggcatcaccatccaagcaccttcagcgcgaggccgccgcacttgcctttatttgtcgattttagcaaatttctagcaaacactttcttatagaaataatctagcaaatatatatcagatttaattaggtatatttggctattaattatatttggctattatttgttttatatgggtaggttgtagtatattgggacggagggagtagctaagaagactcaaccctttggatgatcttgttacatatgttgtaggaggtcttttcttttgcaccattgaaacccttaggatgcgttagaatctaaaggttttggaaccttttctcactaacacggaaaacaggtgacacattagcgcatgattaattaaatattagctatagaaacttaaaaattttaatataattttttaaaaacaactttcctatataatttttatattaaaaatacatcgtttagtaatttagtaaaagtgtgcttatgaaagactggtgagtggaagatggaaagagagattactaaacccagccttagtaacttcatcatcattgcaaccaaaaacaagccatatttgaacaggcatacttcataccatgaaaccaaacttcaatgggttttgtgcatgttgcaacttctccaaagcgttgtgcacaggggcagagacagcgtgggggcggggggtcttg

SEQ ID NO: 10650 - DNA, 1501 bp, Oryza sativa
tttgggcggcgtagtccccccctcccaccccctcccgggggtgggggctttcgtggtatctctcattctttctctagtggaatccttcaggtgaaaaatcacatcctagtttcctaatggtgagcgacgacggcatcatctgcgtctctcgttctcttcatggtggaattctttggtcgaaaaccacatcctaattttccaaaagaggtgacgacagtgtcacaaccttcgtggaggcgttgtttgaaggttcgtttctatcaaactcttctccaaatggattgttctcttaggacgacaccatagccatcacaagaaaaccatgctggtgggagatcagatctattcttatctttcaccatatccccctccacccaaaggcatgaatggattttcattagcagtgggtgcttgtgttgtaggtgcatgtgcaacatagtttggtacttttgtttttcttgattataccctaccagtgctttggtctttttttctcactatattgatatgaaacctcgtactatcacacgtgaattgttttagaaaaaggtaactacaatacaataatatctttgttttcaagactactccattattgtagtttcaaatttaatcacacaaagtttacatacataaaacatatcaaaacacaataatgaaattttggagggttcgaatcatgaggtaaaatttctattaggtccgccaggatgaatcgtatatattataagtaagagatacgatagaaatatgttagatcaatatatgaaaggcacgttagtaacattgtaccaatcttgtttcgaacacatttgaaatatagcataggaaatatttcgttctggtcaaatcctgtagttgtagttcttaaacacaagttacgtcatgagtacagccatatcaaccacccatatcaataaatccaactaatactataaatgccataaaaatgcaattaaatatgcataagatgaatctatatctcaattactcaatactagaatcagactagcattaaatgaccatattaaccatatcaaatctggtggatacaaattcaataaatagagtaatatcacgagcaaatcctcaataaatgatatcaaagctctaacacatttatacatttaaaaccctcgtatctcaattactcaaaattgcaatcgaatttaataggcgcattcacacaggtagaaaatcatctgtccacatttgcatcatcacacttcgaaatcacaaaacccccaacccaacccacaaccaccccatctcactgacctgcgggccccatgagccagacagagccacttacagctgggccccaccatcccctcccctcccgcttgagcctatcctacccagtgctacagccgacggaagccggcactctcttcggctatttaatccccactcctcgcccgcttcgagctccaccgccaccgccaccttcttctcgccgccggccagccaccgccgccgccgcattccgcgcctagcgtgt

SEQ ID NO: 10651 - DNA, 461 bp, Oryza sativa
ggttaccaatttgtagtccgctactactcttcgatatatcttcttttttatcttctcgatatgtgtttatagatggcttatagtccactattgtgtaccgtacctgctcttagagcaagtttaatatatagtccactactagctccaaatcatttatagtcaatgtaatagccaattcatacaatagttacttactatactattaatatctggttccacctgtcttacactcattgcgtcttggagtccgtgctgcagctggctacagatccgtagcccgctacttttctctctcttcctttatctttttaaaatatatttataggtagtttatagcctgctattgtacctgctgtaattagcaagatttactataggagtaatttgcatgcatgggattagcacgtcgcacactccgaggcggaatgggggtaggcggcagatcgatcgatcacacaaca

SEQ ID NO: 10652 - DNA, 1501 bp, Oryza sativa
gtgcattctaaatttcagatattcacataactaattcatactctttatatatactgtcaattgctggaaatatgggaaacattagcagggaatgacttgatgtatgttgtttacaaatttaaatttgccaaacaacaaatgttatttgtttacaactgcaaggaatgacttgccaaagtgcaagcaggggtaacaaaagaatctgccagctgccgcagctagcaattgtgtcatttttgaaagttttgatcacacttcatctatttatagcgattttttttaccttccacgagttatatataatttgcagagcacaactgcacttcagtgatacaatgactttttaagatggcagtgaaactgtggaaataaaggtttgttgttgaacgcacctgatcatgtgctcttcctttttgtccttaattagcagcttgatggtccatccttaatacgttcatgtgggctatcccattttcagtttaacagacacctgtactcattcggttggttctatacacatgtttgaaaaaaaataggacatatttttgccctgaaatgtctaccatagggaggtgatgccaagatgtccatttctttcacgcgggagtgctagatgatttcccaactagcccctatcacattttattgcccctttattaagcctctagctataacactgtacacacaccagcttaattatctagccacagggacagggagaagaactctatgttgagcttattgtgccatctgttccatcttccatcatcaatcattaataagcatggctaggaagtgctctagctgtggaaaaaatgtgcacaaatccaggatttgcagtggccaaagagttctagagcatagcagcagcagcagcaaattattcctgcacataatcgattttcgcaagggaagtgaatactgctggttcctagcaaaatcacaagttgttatggacctacggtgcataagcggcatggagatctttggaggggtatataattgatttttcttaatgtaatagctactgttaatttcgacaaattacattggtccaatgtcagttgagcgcggcaaggccgcgccgttgtttctagtcaaatattctcaagccggcaggtttgcccgcttctgattgggccacttggcacttttaacatttgagataaatcaaggatttaccagtggtaaaaaaaaaagatagaaacttgcatgggctgtgcaatgcacactttctcatgcacacacatgcacagtaatatctagaagatactccaataacaacaacaactaaataacttttgaaaaacatactcgaaaaaacgtttggtaatgattaaagaaacactctattcagattccagagccttccgatctactactctcttgcaaatcaaaagcaaagtagacgagggatatgttgttgtataacttaatgctgtggatggtcatatatattcaaccactcatgtagtttatgtgaatggttaacaataatacc

SEQ ID NO: 10653 - DNA, 1191 bp, Oryza sativa
catgcatgcgcaataaagtaggagatcaatctttgacttaaacaggaaactcggatactttttttttcttttctcaaaccaatctacaaactctaccgggatgaccgcaacaaaactaaccgatgagacaaccagatgcatacccaaaccaagatgaaactagggctaagaccagatcttgacacgacagtagaccaaaactcaataaagcaaaattgaatgaaaattgcaaggttcaaaactaatgtttggtgaaggaaaaagtgatgcagcaatttgtagataatgggtagggaaaataaatctataaaactaaaatcctcaccaggcaaccgatgctctgataccaactgatgacgctctctctcgtggcccgatgttctggtgaggggataactctcactttgatcgagtgcgacgtttgcgacgtggctaccaaccagaacaagtccaggacgccgtgcaatcgctacaccacaaaagatgtcgcgcgcggttgatgatccctacaatgcaaacgagagaacactgcaagaacaagataagatgcaatctaaatattgcgaataggtaattaagcacaaagaaatagttgcgattgaagtggtagatctaatcgacccggcaaataacacaccaactattggggcctctgaatctatagtcgccaactaatcgagcgaggactagagacaaggtgaatggcagttggcaaaattcaactaaacaaaacccaattgtttttgagaatgtacaaagctatttatagaggaaaataaagctagggttaagtgctaattcgtggaggtggagggagacacttccgagatgggtctagtctattacaaggcccaaggcccaagttcggtttcagcaatagcactatcttattttggcgattcccgttgactcgagatgaatttgaacatgagaccggatgcgtttgtaagatagcgagataagctttccacgaagtccaagatcacccaaatcggagttggcataaaggcgttaggtctgtttgaactcagtgctatctccggaggccgaactggacttggacttggaattatcattggaacgtgtgaagttatgtgcgtatccgacgaagtgatgtcctcatcagcctctatcctcttgctcccgccgtctccaaggaagctctcagtgtcatgccatcctttgcaagat

SEQ ID NO: 10654 - DNA, 518 bp, Oryza sativa
tataggtgctgcatgtatttgttcccctgcaactcatatctattgatcatagcatcccaactttcatcaaattcttgttcattcaacgaggtctcaatacatgacttcaaatcaaattcaaacccctctttctggttcaatagcacaccaaggtttgagctagcattcctgtgcaagtgccacatacagcgcctatgaacggtatttggtagtatttttgcaattgcagtctccattgctttgtcctgatcagtcatgatgcattgtggcacttttccatccattactctcaagaaggtttcgaacacccattcaaaagtctgaactttttcatcttttaagaatacacacccaaacaacacagtttggccatggttgcttacaccaatgattggagcaaaaggaaggttatacctattggtgcagtatgttgtgtcgaagacgatacaatcaccaaattttttgtaggcttctttggaggctccatccacccaaaataagctaccaactgaaccatc

SEQ ID NO: 10655 - DNA, 1501 bp, Oryza sativa
gtgtctcagtctcactaccgacggatggtgagaccagccaaatcgttttttccacttggacccaggctaaaacctgccaagttataaccgggactcatgccctggtagtacttgcagttgcagaatcactatcaggtgggtgtccaattggatccttaaccagtggacgtttagtgttaaatttgaatcttccaaatgtgaaaatctagttaactcctgttaaaattctatggaatctatttaaaactcttacatccaaaccgaatttaaagatttgacgcttatatgcgaattacaaaatatctatagcaaagaatgcatcttcttcaaatgtacggcgtgccactatactgtgtaccgatatcacatatctatgatcgaagttgcaaacacttgaactgagagtgctctctccgtctaaaaaaaaatctataattgaatttaacatagtattccttcggggcccctttgatttgcaggaaaaatataggaattttggaggatttcaattctgtaggaaaattttatatgaagccctttgaaacctttgaaattcctatggaatggactatcctatagagattttggagaaaatttagtaagagcttcaacctcttgtaactttcctttgagtatatctctctcatcctgttcgtgcgtttttcctgcggttcaatcaaacggtcatttctctattttttcccgcgttttgctatcatctgttttacacttacattcctattaaaatcctacgtttttcctgttcctacgttttatcaatcatgcgattcaaaggggccctcagtctcgtaatataacaacaatcgaagggagtactccctccgtctaaaaaaagccattcctaacatctgatgtggagttagtggagatggagaatgactaaaatgaccttaatcattgaaaaaaaagtagtaaaagtcatgtgtaggtaaaggatattaaaatgataaaacttatcgttttacgtgttgagtataggtaggatggtagaagttattttttggtgggacaaaatttaaattgtaggagttgagtttttttttttttttttttttttacggagggagcataccgtgtcatatactactgcatcctcctatccatcaacccaaccaacggttctctcaatcaatctcaccatccgacggtcgcaacgagccaatcggagaagagaaaatcaaaataatcaatcaataaaacagaaaaaaagtaaaaaaaaaaaaagaagaagaagaagaaagtagcaagccggagtcgagagcctctcaacccatcggccatcgcccaccaccgccattcgccaccacctcgcctccgattcagatctccctcccccccttccattccacgcccatcggattccctcccgattccgctccattcctccccgcctccgcccccatctccgccgacctcgtcgtcgtcggcgtcctcatccaggcagtctcggcggcgattcgatcgccgccacggtcgccga

SEQ ID NO: 10656 - DNA, 1501 bp, Oryza sativa
tctcaccattaagataccgcgatattgtcagacattatctgcgttctatttattgtcacatagtacaaccctataaatagttgcgtaagcgtcttgatctagactcatatttctcacatccctaaagctacaacttacccccataaataattgaagaaaaacaataataaaaaagagagagtaagcaattcatgaaaaaaacacaacaataattaatttctaataaatctacactcatgtcatatactactacagaataatctactgctgcgcctcgaggtccctctccctgccgtcgtccaccactgtccccgtcggcctcggcgccggtgccggcaccggcgatgtcaatgcccgcgacgcgctgctcttcggcaacttctcaacgcgcgccgcaccggccggcctaacaaccaccttggcgcggcagacggggcacgtcgagtgctccctgagccacacatcgacgcagccccggtggaagacatgcatgcatctgggcagccgccgcgccgccttcccgtcggccatcacggggaggcacaccgcgcactcccgttcctctttctcctcctctgctgcccccaccgcgccgccgccgccctcctccctttgcttgtacgcgaacaccggcagcgccgcgatggcgtcgtcatccagcccagccgaccgcttcttggctgacccaaccgcctcatccgcggcgccgtcgtcccgccgtggtcgcgccgacctccacacgaggtaccaccggatgatgcagaggatgagcaggatggcgaggagggagccgaagctgatcccgaggacgacgacgtacgacgcggtggtgcagcacgcgcgcgccacggtggcagaagcatcgcgacgcgtcgttgtggccgaggcgtgcaggtagcctggcgagctggccgacgacgaaagcgcgaagcatgcctggtcagccgggaggcagcccgtgacgctcccgctcccaccgtcgcggcgggtgccattgctgccagaaggggcagcggcgaccgaggatgacgatgacgatggcatggcgagaggtgggggtcaatgggctgtggggtgcatggggtggtgggagcttgctttaaagagggggagggggagtgggggattgcatggttggtttgcatggtgcggggagtgtggagtgaggaaagtgcgggggtgtggagttgaccgccgcggcgaacgcatttgacaataataggttggtggtggcaatgccatgtttggttcaagcaaagttccacactttttctttcattttattttccctttttgcttatagattaataatcatggaatcaacaaaattacttccatatataattattgtggtgttacatgaattttatatggtgatattgtcgagggaagatcctcaatagcggggaatcgtgagaccccccatttgtgagttcggccgggggcggaggctcgtctctcggaaatcacttgctcgtccctaagattaccggcaagcttg

SEQ ID NO: 10657 - DNA, 1028 bp, Oryza sativa
atccccttgagctataaaaggaggaccctgcccactgagacagggggataacgcccagaaaacctgaactccagaagagaggaagtgagcgcgctttctagagtgaagaaacctttgtaaaactcatccataatcccaaacacaggagtagggtgttacgctccatagcggcccgaacctgtataatccaactgcgtgcaagcttgccggtaatcttagggacgagcaagtgatttccgagagacgagcctccgcccccggccgaactcacaaatggggggtctcacgattccccgctattgaggatcttccctcgacaatatcaccatataaaattcatgtaacaccacaataattatatatggaagtaattttgttgattccatgattattaatctataagcaaaaagggaaaataaaatgaaagaaaaagtgtggaactttgcttgaaccaaacatggcattgccaccaccaacctattattgtcaaatgcgttcgccgcggcggtcaactccacacccccgcactttcctcactccacactccccgcaccatgcaaaccaaccatgcaatcccccactccccctccccctctttaaagcaagctcccaccaccccatgcaccccacagcccattgacccccacctctcgccatgccatcgtcatcgtcatcctcggtcgccgctgccccttctggcagcaatggcacccgccgcgacggtgggagcgggagcgtcacgggctgcctcccggctgaccaggcatgcttcgcgctttcgtcgtcggccagctcgccaggctacctgcacgcctcggccacaacgacgcgtcgcgatgcttctgccaccgtggcgcgcgcgtgctgcaccaccgcgtcgtacgtcgtcgtcctcgggatcagcttcggctccctcctcgccatcctgctcatcctctgcatcatccggtggtacctcgtgtggaggtcggcgcgaccacggcgggacgacggcgccgcggatgaggcggttgggtcagccaagaagc

SEQ ID NO: 10658 - DNA, 1501 bp, Oryza sativa
tagttggttaaataaattagaggagaaccacgggaacacacaaatggtcggatgaagatattggagctcttgttgacttttcttcaatagcaagatcatccatttcatattaatttcaaagataataacataatttaataatctattacaaatgcttttctatttttttcaataggatcaaaatcctttaaaagttttcggaaatgccttatatttgaatatatacgaagtcaagttactccctccattccaaattgatcatcagatacatgggtgcattaagacaaaaaatataataactcacttatactatatttattatggcaacaaactcgatgtatgcatattccccactattttttagccaatagcaaatcaaaacactttgtgcatggatgcatgcatcaatgttcatttacttcaatgtataaataataaataaatttaatgaatgaacacaaatacgatgatcatttgaaatattctcaaaaagattatatgatcaatttgaaatggagggaggaatatagaagatttttattttatagtattattgatagagactgataagaaatgttgtaaaagtacccgtgtatgaaataaaagccagcggacgaagtgaacgatgttaactgggtaggtttcttttgacggaaccagttcactcgatgacacatgtactcacatttacggctaatttttttttactagtacgtacgtgacgtacgcacggttagttctgactttattaatttaaatatatactccatccgtcctaaaataagtgcagttttgcactattcacgttcaacgtttgatcgttcgtcttatttaaaaaatttttatgattagtatttttattgctattagataataaaacatgaatagtactttatgtgtgactaaatttttttatttttttataaatttttcaaataagacgaacggtcaaatgttgaacacggatatccacagctgcacttattttgggacggaggtagtatcaacctactttttcggagatgactcatagtggtcagtgtgtatgtggtacgcgcttactccagtacgcgcttgtactgtgcttcttgaataaaaaaccggcgggcccctctgtggtcgggtggctgatgattagcggccggccatgaatgattccactgattcggtccctttctgcaacaccgcacaccccatttctttacgatatcctcgctgccgcgcgcgccccctggtggctgctgctggtgcactgcagcactggcacgcccagacagccaccgccaccgcgcgcgtcgtccccccctcgccgcgtgtcgcccgctcctcccgccgtggccccgcccgcgcgcccatcccgtacgtacacccgcgccgcgcgcgcgccggaccaccaccaccaccaccacaccgttgccgccgaggccgacgtacgtacgcgacgcggtgggcaaagtttgctgcggctgcacgtcgactcgcgatcgcgcgcggggcacca

SEQ ID NO: 10659 - DNA, 735 bp, Oryza sativa
tgttgcacatatgatatttgatcagggatcctttagaaatagcaacacataacataaagagtcttataaaagaatcacacattcattaaccaataattagtttatctattttaaggagcaaagtcggataaatatgtaaacatagtgtgtgatataatcatctctatgattgcctctagggcatatcactaacatctgtgactacggacatgtatgggatagggttctaactcttaaatttactctaggagcgaagtctggagtgaaaatatagctagagtctatatataggtttttagcaatgatgaatgcattgtaatttgcaaagcagcagcacccatgcatcatatcgaaaacaaaaggaacagaaaagaaaacaacaataacagtatccatcacatccaaaacaaaaggaacagaaaataaacaaacaccgaaaactcaacagaaaaagctgtatgttactgccgtagctttatgacgataaagaatcacgcttacgtgagtgtgcagaggacgacgtcgtggttgcagtggtgatcagtgaagcaaagaagaatatggaaacgcagtagcccgccgcgacagcgacccaccaaccgacggctgccgagacgagacgaactagcgctaagcctataaaatcgcatcaacccacacgagctacctatccatcgtcctagctatctcacgtagtctccctctcccggtcttcgcgacgacgctagctttaca

SEQ ID NO: 10660 - DNA, 1501 bp, Oryza sativa
aagaggagcactatgaccgtgcccatggccatgccggctgcgacgttctccggaacgttggagctgtacgtgctcttcatgacgcaacctgcatttgtcggaccgaatgttcagagacatggcgacatgtacacaaagttaactgaagggaagactgaatgtttactgttctgctgcgcgaaggccactgcgaagctgctcaggaatgtgacaagaagatggacaaaattaccgatcttgtcacacattctcaagacgaccgacgacctcaccggtgtcatcgtcgtcacctcccaaccggatcggaatcacaagcccatatcgtccccgtcactgccccaccgcttgccgccgtctccgcaccatctagacacaggcagagaaatccacctaggagaaagacgagagggaaagaagaggcgaggggacaaagaggagacgacaacctgtcaagcgagaaggagagatctttcttttagacaacggcagcgatttcgtggcggcgttgtggtggccggtggagtggaagaggaagaagcggcgccagcaagagaaaccgacgagaaatccgcgcggggaagacgagacggggcgcgggctcgagccgaggtcgtcgtgacttgtgtcgcatcaggtgctgctgcgtgcacgccacctcttctctcgtttccttcttcactaagccacagacccggccactccgatggcggcgtgcggcttgatccctagtcaaacagtacaagcaaaaacttaaactcccttatattctgtagcagtagctatctacaaataattaaacctctctattgcaacggggttagtatcaagtatcacaagtatgtttgtcacccatgagtcatgactagtgtcatgttgtgttaccattaagcccattttgaactatggattttaccgaaagctgtaaaattccaagggaaatgtatgtatgcaataatgcaagtgcgagtatgcaacacacctgcggagtgtacttcatatgcttcagttttggaagggtcccaaaaaagcattccttgttgggtcatggacgcagccttattccctccagagaactttgacattgatcctagtatcctacggcccaaaaagccacatgaccaaactgcccctccccccagcacgatgaccgtcaccgacccccttaactaactccccagtgtacctccacgccgtgggagctgagctgatctgatgatcccttctcacttccaagtactacacgaatgtaacaacttgatgtgacctcagttcttctcccatctcctcttctccccacctcgcgcgcgccgccctgcccagatgtttctccactccctcttgatgcaaaacatggccaagaacacaacaacgcagcagcagcagacgacgaggtacgcagttaggcgcaccttgcatgtggcatgatgatgattgcttcggttctacgtgtttggctgacgtgatggttccatgcgcaggtcgtcgaaagaggcgggcggcg

SEQ ID NO: 10661 - DNA, 1501 bp, Oryza sativa
tcacttgcgccggcggcggcggttgcgacgagggaggacagatgcggcgcccgtcgttggtgttgccgccgacccgccgtgtcccctcccttcttctccctccccttctggcagcggcggcgagggacctgcagtggcggcagccttctccgctcgtctctctcctatccgtctcctacagtcgtcgtcctccggccaccgccgtcctctgccagcacctcctccggccccctccactctgcccatccgctccactcttccctcctacccaaatctacggcgccgctccgtggtcggcagctcaattcctcgccggatctgacagtttgaccggtggagaaggaagaagcgggcggcccgcgaggatggaggaagcggattggcagaagttggccgttgagatctccgtcaaacctgtccccttcaagcatccgggtccgacatcctctgcgcatggtctgtgacagcttggtataatgaagaattagaaaggattcagttctctccttcctgttctattctttcagcaatggttcaggtcaacaaaaaaattttggtcgagcaacaaaggttcagttcttatccttccagttctccttttgtcttgaatgttcttgaagaagctataagtggaacagatacattgagatcgctcccagttggatcatcagcagcaggaaaggttccgccactaccagtgttatgatcttgtttataatgggatggctaccacatatatttttctatttataggttgacaagaaatgtgctcttttttttatggtgtaacaataagtgaagaacaagctcggtcaggcattgtagtcagagtcacctcagccgcacaaagtaaatttaagatatgaggttgattattccttcggttgctctggaattgaagcttttatgttctgcatctcttttgaattttggaatattatttataattctctcaattgccaaatatttctctacagctacttttcttcgaacaagaaattgatggaggttatggactagctccgcaggtacttttgagtttcatggttgatgtgttctgtggttttgtaatcatttgccatggattaccacatgccaatcttttatgttttttatgaatgaatagtggaaagactggaggagtctcaaaataactttaagggaaattgaatttgtcatcaccatcacaagtctaattttcaatagaaacttaaagatgtagatgtgctaaagcaaatgcgaccattagcctgtcacctccaaagcaactaatcctgacctcctgtcatcaactgacaaccctcctccctgtaacaatcatgaaaagagctgtgcctgtgcaaagctcgaattccagctgaacttggcaaacttgagctttttgaactataagaaattttatcgtgtctaagaattacattgtatgctttatttttattctgtgcaattgttgaccaaattttgcatatagaaatcttgccaacaacaatcttcatggtcc

SEQ ID NO: 10662 - DNA, 1501 bp, Oryza sativa
tttgaaaatactatcaactttttcttacatgctaaatatttatagccgcctagccggctgagtaatgcttttccataacattgtaggccatacttaggctgagtagatgcaattcttctttctcccacactagttttactagctagggtgggtaaaaaaaaaaaaccaaactgaaaagattggaaccgagatagagcaattcagttactaatacggtctcaacatgtcactaaccgaattttattcaaaattttgtcgatttgatcatcaccctcagctaaccaaattgattgaaataacttaacaacacaatagaccaccaaggtttcgttcagaaagaggatgtgctgggattgattttttaaagaaacttctatgttaagaagtttagcaattcgagaagattgttaatagaaagtgatgaagtagttgtttcacatagttgtttagaacgcactctaagcccaacagaggaaatcctactttcttacccatcccaatcaaccccacttctccactcacctagacaccacacggagcgccacctcttggcattgcctgacgagcgatcccgcgctgcctactccgcctctacctgacaaccaagccatgtgtcacctcctggaagttgcgccaccgcttctccgcatctgcctgaggaccgagctagcgttgcattctactgcgatgccgaagaacccgagcccgagtcagcgccactatcctccaacccggcctacactcgaacgtcatccaaagcttgaggcatgcccgccagctgcatctcctctagaggctcttccttcactcagcctctccaacgacgatgacgacaccggccaacattggaggatatgcgatttttgtgtgcctaatttgttttgatctaaaatttataagggaattgtgtaattcttttgaattttctaaaactttggtcaggatagagactgaaatgtttggtctttattatttttcaagatcactcggtctttatgaccggaatgtcaaaaataaaataaagattgatctaattgaatgtcaacccctactatatatatcttactttggcgcatgaatgtatagggcttgttcactttatcgcgttttggcattaccaaattttgatagcgttgaatgtgtttggttggatacctttccaaacattgatgacgtttttgttagaggaatttttgggaactaccaaattttggtagaatgacattgataagctcatgcttagtttgttgcagtaccaccaaattttgatagcattgaaaatagcgataaagtgaataggcctgtagacgagatcagaggcccaatttgaggcatattctctcaacaaaattgagccatgcttgggagttgggaacctctcaaaatgcacctagaattaacctctcactctccaacagaatgccacactgaccacaaaatatagagctaaaaataacctacgcaaactacaccctcaaggcctcaactgcctcgacaaatg

SEQ ID NO: 10663 - DNA, 1501 bp, Oryza sativa
ttttcaagaatctgaaatctagcgaataccattaattctttgaaggacggagattacatggagaagaaacagcgaatgtgattatggacgcgacattgaggtatatacttttcttcatgacttcatttcaatggatttttcttgctccccatccgccatgtacatcggaagagaagaagaatgctaatttcaagatcaaaacactgagatcgatcaataggctcggttgttgaatgagtccgacttttgcagcctaaattgctcgtagaatttcgcgatgaactcctcggcctgcatgtcgatcggattcgggctgcatccaccgtcctccgtctccagagaattcttttcttcttcctcgtcttcttttccatggccattgacaagctcctgcaggtcctgggcggacgagtagctgctggtcatgctcgtgccatcgctcctgtccggcgacggcggcgggtagtactccaggtggccgtggaggcggagcgggcgcatgccgtcgacgaggttcttccacgacgcgacgtcgctggacgacctctccacgtcagccgccgcgccgccgccggccgcctcggccttcttctgatagcccatggtggcggcggcggcggcggccctcttcttgatgctggcgctgccgttgaaggacatgaacatcgcccggaagaggccgaacgcgccccgcttcttgtcttgctgccggcttccgttggaggaggcgctcctggcgatggcgatgccgtccgtctcctcctccttcatcgtcctgtcgtcgccgtcggttctgtccatggaagcagcggtgatcatcacaacatgatttgtctctgcagctccattgatgtgctccttctcctccgtgctcacactagggatgatgatcacattgtcgccattggtgatactgtctaccttggggttggaggtgatagatagaacttgttctacctccatgggaggaggtagaacaaggtaggggagggctcgaggccttcgagggctaaggttctcctccaaagcgaagaggatcgccaagaacgggagttttatagacaacatttgtcgaggcagttgaggccttgagggtgtagtttgcgtaggttatttttagctctatattttgtggtcagtgtggcattctgttggagagtgagaggttaattctaggtgcattttgagaggttcccaactcccaagcatggctcaattttgttgagagaatatgcctcaaattgggcctctgatctcgtctacaggcctattcactttatcgctattttcaatgctatcaaaatttggtggtactgcaacaaactaagcatgagcttatcaatgtcattctaccaaaatttggtagttcccaaaaattcctctaacaaaaacgtcatcaatgtttggaaaggtatccaaccaaacacattcaacgctatcaaaatttggtaatgccaaaacgcgataaagtgaacaagccctatacattcatgcgccaaag

SEQ ID NO: 10664 - DNA, 1501 bp, Oryza sativa
acgaaattgtagcttctctacttctggaagaggctaaaagccaaaatggaggttacaaatgtatctatcagctgtgatcgggcccacatccatacatttctttaaagaaaaagaagaaagagaaaaaactctgtagctagtttttttttttattttttgaacttttaaattttaaaaataaacccttataaaacttgttttcaagatctgaacattttcgtcacgttagccaaactgacttggcaaaacaacattgtcacgatggtttggctgacgtggcagcattatttagtcacgccggtctggctggtatgacaatgttatttgaccactccgccctcgatgacgtagcagaataaaattgtcatgcccattatgtgcgacgtgccagtgttgttttgccacgcaagacagacgggtgttgctaaaagtttcagattctggaaaaaaagttttggcaaggttaatttttaaaattaaaaaataaaagttcaaaaaaaaattgtagctagtatggaaggtgctgagaaagcaactgaatgcaattttccaaaatggaatagttatggatttggcggatacaatgaaaataagttgaaagtgaacatttgtatttgttttcttgatccatcctttaaccgtatatggtgatgtaaacagctagtcttaagaaaactgaaaaatatatggtgatgactgatgaataccaaatgctaatcgtgtacggtcgtttaagcatgtgcactaaatatacaaaaaggaaatgtatctgttcaacatcttggattagactaagcattcatggatcttcagcccaactgtagtattgattactatttgatatgaacaattccagacctcgtgttggacaagttcaccctgttactttggccggctaattgccagtttgccaattgccaccacttgctcagtcagttgtgttactcagctgtgctaacgtaatttccatgctattggcaaacctaatttgctgcaagatatggaagtgtcaataaaaatatattacttttaatagtaacgaaaatataataagagttatgatataggatacttcatatatctaaaaatatactaaattctaacgatgtatttggatatatttatctaaatactagtcagaagttactatattttgagatgtggatatataggtgtcatgaaaaatgattgaaggagaaccttttcgtgatatactgggacccactgcctaaaaatatagaggaaaaaaaaacgaaaatgcatgtatctatggaaatttgagatcctatactagtcttaaaccagatataaaaatatcattcctcacctactcctcccaactctatataaaccctggatcatcctaactttctcctcagctctacaccaagagcgcttataaacataaaaaacatctcaaacacaacccaaaatagggccaaaattctagaatattatttttgttttgaaaggaatttaagtttgtgtggtgtgtcatcca

SEQ ID NO: 10665 - DNA, 614 bp, Oryza sativa
aataattttgtatagattgtttacttatattttgggcaaagctagaaaggacgaagacaaaactgaggataagaaaccccctaaaatcaattccaaaaccaaatctaaaattcaaaaattttcaattgcagacaacgatactgatctgtgctgctatcgactaattctagttcgtgctctcttgagaaaaaaaaactttattttaggagggactcatgtgacactggtagtctataaatagcagaaccctcccaatatgtagcattggattaataacaaaagtaaactaaacatactatcaacccaacaatgattgagcgatataccattgaattattgatagcacatatcacatgattatttacgcgcgctatacttcttaattataactagatgataccccgcgcgttgctgcggaaattgctagataaaaatataagtttatagcaattagcatgctaaaaaaatttatgactaacgacttgaaaattttgaacatacaactccaatgcagtaaaattttatctcgcgaattgaataaaccatacgtaattatatttgtagtaaaatgaaaaaataaaattgattaaaaataataaataccaaaaaggcaa

SEQ ID NO: 10666 - DNA, 1501 bp, Oryza sativa
gggacgccaaccatggccaacctcgatcagatacattacctagtcggtggctcggcattctccatagatgcattagaaagtcctacactcctagttaggtgcaagacattgcgaattgcgattcagttcatgttgccgttgcgccacggccgattccgagcaaatgtaccgtccaaccatcgacgtacggagacgaaatcttagtcttaggttataaaataaattagagttttttttacagtccaatagattggggcggtactaaatcttagccatcgattggatcagatccaacagctatcatccgtcggtaccgccaggtacttgggagggtaccgcatcatgattgagaggtgagagggtaaggttgtcttttcgcattagcgattgttggagtcaatgcaagctagcgactggacctgttgccgccaccgttccagccccgtcctcatcgcccttccctcgtctccgcgcggcaccgagggctcgccccgcacggtcaggcaggccggaagaccagtaggcgaagccatgggggcggcctcgccgtctcctccctgcatcgtgatagggaggccgctggatataagctgaagcaagccgacgacgagtggagacgaagcagggaagatgaagctgcctaccctcccgcggccgtccattcgaggcttgccatctctaggggaggacctcttctttgcctgcgagctggacgccggggtgggtggcggagtctcgccgagtccaaccgtcgtcgtgctagatcacctcacttcctcaccgtcgtccagagtagcagcaccaaatcgagatctcctgaactcctcctcctccctcctccccgatggccagcactagtacagcggaggcggtgaccatgggagcggccaacagcagcggagacccctcgttctacgctggcaacggacttgggaggaatctcctaaccgactgacctccattgtttccctgccaacggcgctgcaacttcttcattaagcggacatatacacaactctgtattgatagtttgatttgccactagaaaaagtcacggcccggcgtgagcagcaacatcggcggagcaatcaagctgaccacctcaatgatgcgatattgccgtacaccttgccgatgtatgaaccttgaattgaaattttcccaaaatcaccgggtgaagttgaggccaactagagagtattcggtccctgctgcgctatgtggcagcagtatttgccctcggcaccagagggggcggcgtggaatcgaggatttggcggcgatgacggaggagacctgcgcacgacggctaggagattggcgttggcaggtgagaacgaggagattgcggcaacgtctgtacgcaaatgtgtcgcgggtcttctccgccccttttcagcccgtttccaatcgtgcccattgtaattcaacggcatgattttatttggtatctggtggtaccagtacctcaaggtactatatctgctggaccataacaaat

SEQ ID NO: 10667 - DNA, 1501 bp, Oryza sativa
  unsure (1)..(1501): unsure at all n locations
tattatcaactccgccccattggcctgtttcgtgcgctgtcgctttgcccgacaccgcccgcctgcgctactggagagggggggagagagagagagaggagatagagtcagtgttcacctagacgctagatgctagatggacggtaactctcaatctagagtgtataccatatattatgctaccagcatattttgttgctatatatgtaaattcactcaacaagtcaaaagttcaatagaacatttgagagcaagaaaagatgagatttaaggtttaccttgttttgcaataatgaatcttcaattagcttcaaatttaaatcatcttggccttggtaggccagaaaatttgaactcctacccaccaaatgttttgggtccatccatggtctaggtatcattgtttcggtctagacttggctcagcatggtctaattacttggactagacagtctttgaccatctagacaagaaaatagtgtttaggccctaaacaagacaaaaacctatgtacggtcttgcgtctagacggggtctagacggtccagaccatggtctaggcaaacgttggatagagtagagggaggagtaagtatgtcatgtgggcttccacaaattttttttattccctccttgctaactaggatgtcacgtnnnnnnnnnnnnnnnnnnnnnnnnnnnnnnnnnnnnnnnnnnnnnnnnnnnnnnnnntacacccgattttacaagaagagaaggcttggtgcggaaaagaaaagagggcggcctggccccttttcttcttatcatatcacaagggcgcggctccgtatggggctcgtactgcggagctagtctgggagtccttcggagtttacttaaattcaagagggacttaaaggatttctaacttaactgtcctgcttactcattggatgaattgacagagtctcttgccctttaccttggatatacacatgctcattcgctgtaaccactagccacccatatatactgccatgagacctatttgcatggctttgaccatttgagggtagacatttttgatattgggatagggatggcctacatactcatgtaaaattgagagacggtaggtaaacttattccaaatatctcacattacggcctcgttagctaggcctcaatctcggcccatccaagtgtatggctacacgtaaacgggccgtgattgaggcccatccaaatgtctctgggccatccgctcgcgaggacgcgaacaccacttgcacctcgcgaggcgccccgccatgcgcgagcgacatgccgcgccgcgcgcgcgacggggtggcgccgatcgagccaggcagccattcccaccgcgccacacgcgccacacgccccgcacggcgcacgcgcctcgccctcgcctcgcctccgcgcgcgcgccgcggctaagccagtggcaccgattcctcgatcggcttcgcgcccgcgcccacgcccaccggcgagcctcagccaagccatccgatcgcgg

SEQ ID NO: 10668 - DNA, 1501 bp, Oryza sativa
tgaaaacaggaggatcctgcctctctttatcaaaaaaataaaataaaataaagtgccatcaatcatactaccttgcataacacagtgagacaactgcacaatattgtaaatcaatttatagtaactactaactagtgtgcaaagctaagccgctttaatgattaggaaatgggtcgttggtcattccaaagagttgagaacatcagattatacaaatcatcacattatcttgcatcacgaccaactaaaaaaaaaacgaaccggtgctctaccattatttttcttttagacaaaataaatgctgcacatacagaaaaattcgggagggagaacacaaaacaatcaaactatagtaacagaaaaataactagttgctgtgcaaacctctaggaatgtgattttgagctgattcgatggcttaattaccacgcttacaagttcagacctgcattacagaaaaataacagggtaatcatcttagctcgctgaatgtatttagtgatacaaattctacccaatttcttcctagagctattttcgtaggcgaatttgagattaatagtattgtaaaatttataatcattacgcatatctcgaaatgctagagagctcgataagtcaaacgggaccttacttacctacctgtccggagacgcgaagcgagcagcgtatgtcctgggcttcgccttgtcgccgtagtaggtcatcccgacgttgaactcctgatttgtcgataaaattccgaggttaaaaccaaaatgttgagctcgcggcctcgcgcgactacaatgcctgaggaaaccgaacgcgcaaggggacattgggaggagacgagagacctcgggctccaagatgtcgtcgaaggaagggggaacgcggatggagaagccgctgccgtagtactgcgaccacgacttggtgttcgcgatgccgcccagcagaggggagcccttcttattttgggaaggctcccccggtggcgcctcctcgtcggcggcggcggcggtgccggacgaacggagaccgcaaccgcggcggaggcggaggcgatggcggtgtggatggcgaagtcgcggcgcgaggcgccgcatgccgaggcggggctccgccgccggggcggcgggttctggggatacggaggcgagggggcgaggcggaggagcacggcgggggccattgcgcggcgaggcggcggcgccactgccgagcggacggcgcggaagccgcggcgggagaggctggaagttcgccgtggtgagaggaacgcgcacgcacacggggtgaaccgattttttggtggataagcacggcacggtggtgggccctcctttccgcgtgcacggcccacggcccacggaccacggaccacctcccctgcagaatcaaagcccactattcactagttcacctttctgtagctgaagagtccgatccattcacttgttatctactcacccttggttcttcctctctctcttccaaatctccgaatccagtgctc

SEQ ID NO: 10669 - DNA, 1486 bp, Oryza sativa
tattcctagccaatcacaatagcccatcattcaatttgtccaattacctccattgcttaaccaatcacaacattccccattaaaatgtactccaataatcaaaactatagtttggatgggatgaatcctaatactagcatatgtcccatcgtatgctaagctgctatattgtgaggatgaagataactcctactccctccatcccaaaatataagtatttttggacctcgtcacagtcttcgagatgctactttgaccaaaaatatctataaaaataaaatgttttaaataaaaagagttgcatattataatagtttgattaatgataaatctagtaacatcaattttacatgattgatctttttattttattgctattaatagtcaaagttaaaaatggttgacttggcactatgctaaaaatacttatattttgggatggagaaagtacatttttaataaccgtgtcaacctaaaaaactcttatatatcatgaggcaaatgtaataataaagtagattcgtttaaaaatctaatgatggtatatactaactattatggtactacctcccccaacataattatatttatggcattcaaattttatgccagaaaaattatattctagtgaagtactacctccatccgtcctagaatataagcatttttaaagttggatgtggtaattaagaaaataggtagaagtgaatgatggagggttgtgattggttgagtagtggagataggtgggaaaaatgaatggtgaaggattgtgattggttggaaagagaatattggtcgataagttgttatattttgggacaaatatcgagagctaaaagttgttatattttaggacggagggagtaacaaattaattagataagatataggctgagtttgttaggaccggttgggaaccaggataacacggaaaacggagcagtccattagcacgtgattaattaagtaataacttttttttaaaaaaagtggatcatatgattgttttaatcaatttttgtatagaaacatttttaaaaaatataccatttagcagtttgaaagcggaacaattcagagagttgggaaaacttgctgccgaacacagctcttctagtttctcatctttccatccccatctcataatctttattttaatcaagtttacgtatggattgtatgcatgcagtaaacgtgcagctaatcttcaagaaatataattattccgagacgtagatagtaaataattagatttcccagtacagattgtcggtcaaagtttggcaacttaaagtcaaactaacgaagaagtacgcctatttccatgttctcgtgtcagctggtgagccattctctgttccaagtacaaaggacagctatttaacaactccctcgctctctcaatcggtgttgttttggacgaacgcgagctgacagaggggagagagagagagagagagagagagagagagagtcagagaga

SEQ ID NO: 10670 - DNA, 428 bp, Oryza sativa
actctctccgtccgaaaatataacaacttttagcactttgtgtttatcccaaaatataacaacttctccaccaacattcccttcctaaccaatcacaatcctactttcacttttcccaactactttcacttctcaaccaatcataacccatttctatttaattctacctactttcttaataaccgtgtccaactctaaaaaaacttcatgtattctgggacggagggagtaaagtctttacgccgttaaaaagaagtaactaaaaaataacctcgctaatataaattagggagaaaagcattgttgttttatcatattcctgtttgttttactccttgtttatccttagctgcggacctcatctatggataggtaacatggataggtaatgttttacatagatcgccgtacgtgtcagagtgtataga

SEQ ID NO: 10671 - DNA, 967 bp, Oryza sativa
gtttggtagaatttgtatgaatttagattttggagaaaaagggggaaaaattaaaaatttcctagaagtagtacagcatttgtaataatgatatctagtgataaatttgattttgtgaaaaaatgcaaagctaactccatattttggcacgactaaaaggagagtttgcttcgtaataaaggtttgatgcttgtggacactataattaattattatagttgtggatatcatatatggtatttctattgttcacaatgtatgatagtggttttcttctctctcttttttcaagtcaaagatcatggtcacagcacagttatcacgacctaacggtggtaaccacgatcttaccgtaagatttggaaatcttgatttcaaattacagagataaaattcacacattacaattatcgccctaatgtgaggtggtactaaccttcccacggaaggtataggaactctaagccacaccattaatcatgagcttagtatcgcatcaaaataataaaatatattatataacagttaaaaaaacctgactatgaaacaactcataactttgttagatcaaaattaaaatgatcaataggatgattttgttttactttataacacattaatattcagggttatttgccgttatacaatccatgtggctttacgcgggcaaaatgaggagggggaggtgactagccccctcccccttgcacacgcgggtgcaatatgcactattgcgtgggtgcagcgccactgcatccgtcaagccaggctaagttgggaagctcgattcctgcgtttctgctcggcccggctcggaggcaatcttcggctctttgcatcgcctcatcctgtatcacgggccagtgcaggaaaccaaacataccaaatctgcatggtctggtacgagccaagcctggtacaggcaaccaaacagacccatattagctgggctgcgtgaggtgaggca

SEQ ID NO: 10672 - DNA, 1501 bp, Oryza sativa
cggaacagtacactgtacagttcccttcctcaacggcggagcaggattatgcatgataggagaggggggccagtcaagaaacaataaaaacaaaacacacgtataatattaatcacaagcgatggcttgtatagaaaattgagatacggtgtcattatatattgaccatacttattacttaaaccattgcgttatcctctatgtacaagcaatcagatttcgtcaaaattgtcaggatcacctgaccccgacatgttcattgcttgtgctagctgttgaatgctgatgcttgcaagatggtctaaactctgaatttgttgatggtttttaactatcaatttgatatattatgtcacgttttgcaaaatatccacaagtactgactgggtttcggactttcggttaggtacttgacgagcaggcataggtatatttgttccattttagacccggtaagcttgttaagacgtattcctattccaccgagacaatccagttcgttgccatctctactttagaccacttagtaaaaccagatcatttagtatatagaggatatctatatgttagaaggatatccgtgtaggatcaccgttcattccgcatccaatggcagcactggttcctagcttctcttcagtcgttcggcctagctcagagccaaccagggggaaacgtacgccgctacaagaaaccccgtcgttttgccgcaggattctgggccaaattacgacggaggagagggtaggaaactatgaattgatgctgtcgttgaatgctgggtaaacaacgatccggcacagatatcccctttgatgtagaaatcctcttcatcagaagacctggttccgattgagtaaaaatgggctctcacggttaacctttgcatagaccatagaaacatagcccttgttaaagtgcccgttaaacctttgcacagaccatagaacgcaggcacgcagcccatgattcaaacaaaaaaagtagattaagtagagtaattaagtatatccttttgttctagtacatcggagacggtgttcagtttggtgactacaaattaattaaagtagagtaacgaaatatccactgaatgtgcgcctgtgcgagtgcgacgaatgtacctaacagtcaatgctgttcctctatagttcgtctgaaaccagcgaattaatccgactaggcaacattgaactagtgctatcaaagatcagcgcagctgccgtgcgtggttctctcattggctggatcgatgttgaaatcagaaccaacggttttgaccggtttcttaaacagttaaacccgtacataaaatcggcgccaattcagcttgttttgtggaactgtgtgtttagttatcggcaaatagcacacgccaaattgccaactagctagctatctcgacaaattagagcctcatccaaaacgataggttggcgatgcgtgtcgtccaaaactaccttagtacgttaccgtacctataaatatgcatgcaatgctc

SEQ ID NO: 10673 - DNA, 896 bp, Oryza sativa
tatgttttgtcatctaataacaacataaatactaattataaaaaaaaattaaaattagacggacaatcaaagttaaatacgaaaaattatggttatgcttgaaatgcgacggaggaagtacaagttataagaaacagacaaacgcttgatttaaactgtactttccatcttgttaagagcgtcccctgtcaacttctcatcctcccatttgaaaacagagaccagaccacatccgagcgccggtcattatcacgaaaaatttcaaattctaatttcaaatcacatcgaaaacaacaacaaacaacaaaccaacgggttgggaaaagtgcaataaaccaatcaaaagctggtgcgccaccgcaccggcacaccacctgcccttttttggggtatttttttcacctcgccccctacgcttctccgcttttcactttttacccctccccgaaaataaataaacacccctcctcgcagttattcccgcccaccacccgcaacctgtccacgcatttcaaattaccgagccccaccgccgtcactggtaggtgggcccgtgcaccgtgggccccgcgcgtcagcgccgcggaggctgacacgtgtagtacagtcgcctcctacctccctctgcgtcgcgttggcgtctcgctttaaaaactcgcaacgccgtggcctctcgcctcttttggagcaaggccatgtgaagcctctgaccttccgataccttcccctcttccgccgcgtctcgcctccgcctccgcgcgctctcgccgtcgagctcccccgccgcgccgcgtcgcgccgcgcagcgtcgccttgcgggggggaggtggggggagggaagcttcggtttccgtgcgggatgtcgtcgaggccgtcgtcgtcggcgtcgtcgaggc

SEQ ID NO: 10674 - DNA, 698 bp, Oryza sativa
actagccattagcaaatcaacaacaaaataataataataaaaaatctcgaggaactgtcgcttcccctctttagtctcggttggtacccctctttactcccggttggtaacaccaaccgggactaaagattgatctttagtcccggttatttaaaccgggactaaagatagcgatttttagtcccggattcgtagtcccggttggaaaaccgggactaaaggggggttatcaaccgagactaaaaacagtttctccaccagtggagaacatatttttcatcctccattactctctaggcaatgaatactggatatttcggcacggtattctcaaaagcaactttggtcagtagtctattagataaatatccaattttgttaaagtttttttaaaatcaattatacaaattgtttctatgtttttaaagtaaatactttaaaagttatttataatgagagttttaaaagtttaacattagttttgtttaaaacgataattatttttaagctgaaaggagctcagcacgcaaaacaaagctcgtattattacatgattatttaagtattaactttttttaaaaaatagattaatatgattttttaagataactttcatgtagaaagtttttgtataaataacatcatttaatagtttgaaaaacgtgcgcgtgaaaaatgggagaggtggattgggaaaa

SEQ ID NO: 10675 - DNA, 1501 bp, Oryza sativa
caagctcacggcgttaaggttgttctaaagtcggacaaatttagtcgtacttatagtatttttcataaggatattggcactttggcaggcaggcaggcatctcctcccgccgaatggacacatggtgcaaaactggattttgttttttgttttccatttctttgttatttctatttaattgatgggattagactcctttatataggacataaggaatggcgtcgtcttaaaatataactatctttaactatcaaataatatatagacaacatattatttgagttgtctatatattacttacaccatccgttccaaaaagattaaacttatagggatgaatctagatatgcatttgttcatattcgtcctagaagttggttttttctagatagaaattagttcagtttcgacaaaattccttcattttagaggaggccttaccttaatttcttactttcccttgtaaaatatccactgatggacacaaacactaaggattggtatgggtttcagtttagcgtacatgtgaattctctaacctaccttagcatggacatggaattttcatgtgaattctttgttccatataagcacatcttttgtaaatacgaagtagatcacgtgagtaattatgtacatcctttctagagaaatacttcatccatctcaaaatataactacttttaactctttaagcacttaaaatttgtctaaaaatataacaaattcttcatcaacattctcttcccaaccaattacaaccatccaccattcaaatttctcagcaccttcagttctcaaccaatcacaaccttgctctatttaattttactactttcttgataaccctattcaactctataactttttatattctgagatggaggtagtaattaagacttatcatttggacacttttgtttcactggaatacatggaccattttgtatttttgtatccttgtgccatagccatagcctaaaaagtctatcaagtcgactggagtaccagacaactttctggcaataatgagagctagacgacgatgacatctgttcttccagtcgtggatatctgaaaccacatattgtgggcaacttctgaaagcgaaacactgtctgaagttcactataatatatgaagttcattatatatagttcagagttgcaaaccattgtacaaacgattatataaagatatctaaaatacataaaacacagccgaaaaaattcttgtataccttttcatgttcttttatacactatcgtatacttgcacatgcaactgttctgtagaatgtaggatgcaggggcaccaaagagagagagaaagaaaggtgcagttttcagagatgcaaaaatatacaaaatcgggttgagataggcacctcgagtactttctctattagaccttttgttttgaactaatcatctaaattcttcatatattcttttgacagtttcgaattcattatcagttcttgctctttcaccagagagtc

SEQ ID NO: 10676 - DNA, 1501 bp, Oryza sativa
ttaacgttttggacaatgatacggtctccaaaatatatgtttgactttatttttctattataatatacacaataaataaatgcatgcttacttttctcataatactttgaaagacaaatctatatatattgttctagtttttttaaactaaatacttttaaagttattgataatcaaagttacaaaaatttgaccttaaccttgtccaaaacatcaagaattatgaaaccggagggagtatattttaaatgagtactccctccgtttcagattataagtcggtttgactttggtcaaggtcaaactattctaagtttgtagacaaatatagtaatatttacaatatcaaattagtttcattaaattaataattgaatatattttcataatacatttatcttccgttgaaaattttactgttttttctacaaacttaagtggtttaactttgaaaaaaagtcaaaaacaacgaaattgaataatcacaagcagaagcagatcagcaactaatcactgaccaatacacgcacactggcacacaacataccgcaaagaggaggagagacaggccgggagccaaaaggctctcccctcttcgctgcggtgcaccccccccccccccctcccgccctctcgggtcgcctccgcgatcaaatccaattcaacggcccaaaaaaaaaaccctcccaaccaaaaaaaaaaaaactccaaaccaaaaaaaaaaaaacacgaagcgagagacagccagccagcccaagccaagacgaacacgaagagaagagagaagcaaaccaaacggaagcaagaacccatctcccacctcccccaccagcagcagcagcagcaatccgcgcactccggcgcgcgcgggggagcagcagcagcagcagaagcggaattcctcgcggcggcggcggcgtcctccaatccgattccgccaatcccaattgctgcccccctcggcgaggtcagctccaattcttgctgtttttctcggattcgattcggtcgtggagtgggaggcggttggtcgccctcctcgccggagatccaggcggcgcgggcccggggcggagctcgccggggtcgggatcatgcccccattgcgctagggtttgggtgggtaatccaatttggctcccgcccgacgactcgccgccctggatgcttgattcgggccagccgcaccgctcccggggcgggtggttgcttccgcggcgattggtgtggttccggcggagatgagatcgcctccatggctggcgagctgggaattgggctacgggctcgcgctctgcaggaggcgacggaggccatagtggtttgatccgagctgggttggtgcggcgcgctgtcaccgattcgtggtttctgtgctctgaatccgatattggggttcgccggggtggtgattttatggacatggtgagggaggaggcgtggccgctcgctgcaccgcagcagcagcagcagcagccatcagctcctccaccgcagccgc

SEQ ID NO: 10677 - DNA, 1501 bp, Oryza sativa
catgagaagaaaagaacatttgttgtgaggaaaggtggccttcctgatgctggtacagtcaatgatggtctttatttgcttacaagttacaaccataataaactatctttgttataataaatgaaaaaaaaatggattgtgttggttatttcctggttgtagttgtttggaacccttgggacaagaaggctaaggctatgtcagactttggggatgacgaatataaacgcatggtctgtgtggaggcagctgctatagaaaagccgattactttgaagcctggtgaggagtggactggaaagttggaactgtctgctgtcccatctagctattacagtggtcagctggatcctgatcgtgttcttcaggattcaagtgtcccggaggactcaatcagctagtccttagtggatatttgtccaggtaacatttctactaaagtatcagacttggtcctgtctttgagttgtgaacatagattagtaaatttctgtgcaggcaagtaagcggcattcttctagtagtatggtcctatgtaaaaaatgtctacatagtattgcatgcagactagaagacgtatgatggtcctgcataaagttttcaacatagtttacatagaaaataggcatgtaccatgcatagcccatattatattgacgagaatcctttttttaatctaatcatctccgtactgttttcttgtggaagcctgccattatttatagaaattcttaggtgacgtgccagattgccagagtatgcattgtaattgtgatatctagaccagttcaagtgtccggctttggagtggtctgtggtcagtagcatatacataaacacccagaatttgacggcaagcagaccagttttttttgtgaggaggttatattaacaaggaaaaagctcttgtgcttgagctggtgggtactctctctatctgtactgtagagtgtgctttgagattcggaaatttaaaaccatgcctgactttttccttttaatgtgattttcatgcataattggtagtccagtacctgcaaatttttgaaattttagcgtttgtaatgtttgaaggagacagagaatatttggaaatgctaacagtgaagaaagctgttgcgctatcatcaagtgtctcctattggagttaaatctgcaatctagagatatatggggggcattttgcaccaatctcaaacagcaaggaatggtgcatgttcatgggttacctacccttcagtcttttccccttcagggtatcaaaatcaggggttagggcctaggggagactcgaggctaacttaaaatggcatctgcatactatctggggatgccaaatagtgcgcattattgttttatttgcttgcagttgtgaatgaagtgatgctgtaaactctgcacttttggccttttgggcatgtacatgtattttttcaccgcacatttcgctaaaattttgtttacttgctttgtactgaccttggcatgttcttttgttgta

SEQ ID NO: 10678 - DNA, 1501 bp, Oryza sativa
gccgatcacacgctgacgcgcacacaccggcgatttctcagccgcaatcgccatggccaccgccaccgccacctccctcgcctcctccgccgcgcaccgccgcctcccgccctcgcgctcagccgctagctccatcctgagagcccccaaccggggccgcctctgccccggctccccgtcggtgctccgcgcgtcgtcctcgtctccgtcgtctccccagcccaccgccggcggtgatgagggggaggaggaggaggaggggcggaggctgtcgaagcagtcgtcgtgggaggcgaaggactccgagggggatgactacctctaccgcctcgggaaggaggccgacaacatgaacatcgccgtcggcgcgcggagcggcatcgtcgacgacctcttcgtcggcaacttcctcggcaaagactgtacgcgctccagcacttggatgccccgttcgatccaaataccatcttataataaaatgtcctgaattgtttggttcctgaacatgagattctgtatactaacttcagcagtagacgatctttccttggttacagctctatatatatagttacttgtgaaatgtgtttgcagcggatattgtgttcgattaccggcagaaagcgaccaggacgtttgagtacctgcaaggagattattacatcgcacccctcttccttgtgagtgtaattttagttcatcttcagctgatctttttttttttactgcatcctcgtacttttatgctgttctaggtacctgattgacaaagatttgacactgcagattcgttgtggtgcaggataaagttggtaagcaatttaatgtaggaggaagcacattgttataatcaggtatctcactcttacagtttgaagagactacatctttcgtttcacctgcataaacagtggctactgaagtatcagtgtccttctgtataagaaactgaacaagttatacaaaggtgtaacagttgccgaataagcttaccaccatataccaacagtccctagaggcctagactgaatatatatatttttgggtcaaactatcaaataatggcatgcaatgttggcagcatgtgaaatatatgcaaatcttacatttacattaattgtgattatgctaaactcttccttaataatatcttgaacttttatatggtatatattcttgtggctatagtgtgcatgacaaatttattttattctttttctccaggcacacatactaaaaggactgcttgatgtttgcagcatgtcatattgtgaagaactaccttgcacatattcttactatcaagattccccttatacttggtagtgcacttctctttgtttctctctgtgtaattgggatatgaaataatacatggttgtagttcaatattattctttagttcgttttcaatatttttgaggaacattgcacaatgcaggaatctggggtggaaaaggccaagggaaaacattccagactgaacttatatttagagcaa

SEQ ID NO: 10679 - DNA, 1501 bp, Oryza sativa
tcggcccaaacttagaaagaaataaatcacttagtggtttcaaaatgatttcaaacaaaagatttgcaaaacaaccttgcctctcttccaagcttgcattaaccacctaagttcccgtgacttgctgagtacgaaagtactcacccttgctctatataaatatatatatatatagttcctctgccctgaagagaagataaagtgaagtgaagattagggtttcgtcctggttcccagccgtcgcctgtggtgttgggtgttagaccgttggttccgctgctgttgctgctgctgttggtgttaaggtaaataagtcctctatttattttaaggattgctatgattcatatttgtcaccgtgggtaccagcactatgtcctgggactggtaccgagatcgcggtttcgtaggaagcggttcgcgccgttttccctatgacatgctcctgtcaggtgccgttgtacggcggtattagattggggtgcgacacttaaggattataaaatcacagaaaaaggtaatggaaatttctggccgatcggcgttcgtttctgactttctgccggccgagttatatgaaaatggtaatcgaccaaaacgaaaatagaaataataaataatattgaaaatggaaatggttccatatttagcgtgattttgtgaaaattaaaattgttgtacttctaaatatgtctatatatttatatatttatagagtatgtctctacttgacctacaatttagattgattgatcattcaatcaaatacataacttgaatgcatgtctaaaatggagttaatttataatttatatagtataaatttgaattatttatatatattacatagttatgcaaagttaaatatacgtttttatggtttaatgtttctgtatttgctaccgttttccaatatgtaccgtcatgtttcattccgtatttttccaatttttcaatattttcgatattgttttcgtttccaattttactgtttttgattttattttcgagaaaaatatgattatggaaatggtttagactgttttccaatgttttaatccctatcatgcaaacatcctcggctaaccatcaaccatggcaaagaaactaacaccaatttttaatgcgaaaaattagggaatggaaataacagtgttgctaaaattaacaaccattaaaaacacagagacgcacttggcttcaggccttccatttttatcaatccagagaaaaacagagtctggcaggctcattcccatccacagagaaaaaaaaatagaacatcatttttatttttccagcgccttgcatgccgtgttcttctcgccgcgggaggagatcgtcaccccgcggcgtcgtcgtcggcgtcggcggcggcgcgcgggggtcggcacgagggtgctcgcccactctcgcgtcgatccggcgatggggctgctgagctcggcgagcaggtcgtgctgctgctgctcctgggtgcgcggcggctgcgccagctgct

SEQ ID NO: 10680 - DNA, 1501 bp, Oryza sativa
tccaaactacccctaaaagcttcaaattacaaaccaagtcaatatactgatttcattgaactgaactgaagaagtgttctgcggtttgcactctgaataaacgtttctcaaagtcacaacaaggcctgcatcagtgcatcatgacaactgagcgaaatgaactgggagcctgcaacagtggaatgactcgacatcgtacagacgaacgcattggcattataggctactgaggttgcggtgcagccgcagcctcgccgccggccgcccttgcttcgaccatatcgtcgacgagcctgcgcagatcgcggtacgaggacccgccttcggccacggccgcgtgagcctcggcggcgagctcctgcgctctgagcctcgccgcgtcccctgccccaccaggctccaagaacctcgccacggctcgcgccaccgccgccgccggcaccaccatcgcctcctagtgccgcaggttcgttggccagtcccacaccttttcgccaatcttaagacgcgggggaccagcctttcttgaataaactggtggaacaccagcggccacgtcaggcagcgtggacggcgggcggccagggcttccagcagcgagctcgagccgcagtgcgtcaggaacgccgccgtcgccgggtgagaaagtatcgccgtttgtgggacccaccctctgaccagcacccccctatcaccaacgcgctcctgccaccccgccggtggcgaccacccgtcggtcctgaccgcccacaggaacggttcgccggaggcttccagcccgagagccagctcctcgagctgctcctccgagacgggagcaaacgtgccgaagcatacgtacagcactgaccggctcggcttggagtccaaccaaccgatgcacgatgcctcaccggcgttagcttcggccggtggctgcggcaacgagagtggcccgaccaagtagacgcgctttgcgaggccgtcgcgcaagaatctctcacggtacggctgctccatgcccaagaacgcgttcacggcgagaccatggcacatcctttgcccctggggaatcttgttcgggtcgattccgtcgaggttcccttgccggatcaagaaatccggcaactcggacttggggaaccgtagctccgcccctggaaaccccgcgagagtcaactccgccgaatcggagtcgtcgttcgcggcggcggcggtgacgaagcgcatggcgagcccggagaataaaccgatgacgctgaacgaaacgcagggcacgccgagttcctcggcgaggccagcgttccagaagaagtgggcgtccgtgatgagggcgtcaggagattggcccgagatgagcgcctcctgcgccggccgtgtcagcgcctcgttggtggcagcgacgtcgatccgccacccatcggcgccggcagtggagaggttctcgacgccccgagggaggccggccacttccgggaacggataggtggcgatgctgaccacgctggtcgccgctgagcca

SEQ ID NO: 10681 - DNA, 1501 bp, Oryza sativa
cataattcaacaaggcaacttcactcaacaaatcatctaagcaggtaatagctcacctcgttttgtgtatcttctcaatcttctcaatccccttctcctcaaactcaccctaagtgaccaaacccgacagcatggacaaatgaaccctcagaaagccagaatcaggtgcactaattgatccattggttggggattagaacatcatcttattgctagtcagatattcggatgacaaagaaacaacttagtatttttaacatgtgctacaatttagttcccaggggcggaaattcagaaaggttgcaggaagagacaccagcacgacatataacagaatatatgtgatcaacgactcaacgaggaaattggtggttaaatgcagggctatgtgatcaacgaggaaattcgtggttaaatcgagggctatgtgatcaacgtttgatttctttccttctgaatgaataaattgtataacattcacttcctacataaattgagttttctgaaattaggccaacattacccacgaattccagtgttgtggacctgctagtaaactgcaagcttctataatcctagcgagcacacaaattcgaaagctttcgttggtgtcaagtgaactcatctacagcagaatacaaaatcaaacatgatagctcaaatcttatcaagatactcatcaacaactcaagttttatttcaagataacgcctgggtagctgatacaggtatgcagacgaaagatcacacctatattactcataatatataaaacctggtacagctcaagatgcccaggtgccggagcatgtgggatgctcagaagacgatgcggaactgcggcgcgccctcgccggcggccgggacgagctcccagcggcagggctcgaggtcgtcggacacggggcagtaccccgcgagcgtcacggcggcgccggactccgccgccgacccgaactcgaagacagtcgcgtccgccttccgctgccgccgcagcacctccaccgccccctgagtgcccccggccgccgagacttccgccacacccgcgccacccgttcccttcgccggctcgggcaagccgccgccgccccgccgccaccacgagaagagccccatctggattagggaaatattagggtttttggactttttggtgggcgaaaaaaaaatctgaaagaagaagagatcgtggagatatcactacccagtgggccccacatgtcagcctctccacaagtttttaactaaagctatatgggcttgtgagttgtgatgcgatgggcttctgggcagcccagtaggaagaagcggcccacggagattagtcgtcgtcgtcgtcgtctccctcgcatggcaaatgcagtggaaatctccagaaaaaggaaaaaaaggcgggaatcacatcgtctactacctccaaacggaatcacacctctcatcctctgctttccgcaaaagccatcaccaccaccaccaccgcctcttcttcctcctcctc

SEQ ID NO: 10682 - DNA, 1501 bp, Oryza sativa
gtagcatatatatgcattgccgttcgttcgttcattcctttcgttctcctgtagcaaaatcatgcagcaaacgtgttgattgagatcatcacgagtaattaattaatcgagaccaaatatcaagatgggttaagctccaactaacgacatcgttggtggtggatcacggagttcgtggcgtgtccctttagtacggggggaagagtagagagctggcccgtcacatgaaagtggtcatcaggacgccgtcggctgccgacgtgtgtggtaggctggctaagcgcctctgcataaatgccgacgcgtgcatcgtggtggtagctcgtacgccactggtccaaaagaccgaccaaaatcgtggctcgattctaccccttggtgggaggagggtgaagacgacgccgagtcgaaggcgcaacgcggcgtgcgggcggcggggccacgcgcacagggcggggaacatggcgccgcggcgtccggttccgcggggcgggggcgggggcgggggcgggcggacgaattgcttgcgttgcgccgtggtgtggggtgggggttggggttggggatgcccgatgccgtgcttggctgcttgtgcgtgtgccttatcagttatcactatgccgccggtctcccggtggagccagcccactgtccacctataatttcccggaaaaatatgtattgaaaatcacgtactaccactgttcttaattatagctatttttagtactaccttatttcaaataaaattatttcttcacctatcttctcgtctcaatcaatcacaactattctcttttatctactttctcttatcaatcaattctacaatcattctcatctacttctaattaaaaaatacttacatattttggattttctttttcgtgtacacactcgtttctatgaacacacgtttatacgtgcacccccagagaccggaccggtatatcgtaagattaacaaagtcaccatgagcaaaagttcttcgtatagttgagcttagacaatagtgcatgttatgtatacttctgtttggaacgtatcaatttcattgataggagttttcaagaagccgaagaagtgacttaattgatttgcgcaagttttgtttatctactgactttcatgtgatgctaactttgtagtcgttgatgatatacgccctacaatttaggatagagtgagtattttttttatgattatatgcttggtaaaacctcgatgtttaaattggtcttagtgttataatgcattatcataattttagtgtaaaatacgacttatagcgaaagagagaaataccaggagtgaggtgaatagtttaaggtataaaactgagccgaaaaattgtttagaatgttaagtgctccgatagtataagtttgagggagtaaaatggattcaattttcttcttgactcatatgctcatctctaaaatgtcttacatctgatagtaggaggattatttttatacttggctggggacaccaatatctc

SEQ ID NO: 10683 - DNA, 1501 bp, Oryza sativa
cctaaatcaaaatctattgagtttttgaaaaagttgtatataaaaattttttagagttgatcatttcaaacatttgtgtagttcaaagtttttccaaaacaccaaccattcaaactctacaaccatttgagtttcagccaaaatcttgacttgaccatttttagcctaaacttgcatatggtgggttaacccttttgagccaaagctctttgtgaatattggcttagaagtgtatctataaccctcctaaggctttacaaatgtcaaactccatggatttaaaatttgaatgtgatttgagctctcaactcaaatttactcaacctgaaggcctacaatgctcctttttatcttttcttttgataaaaaatgatttttatgaaattctttttggaaaagttactcacaagtataaagatcatatctgcaagggttcatctcatttggatttgatttgcaattattttgactctttctcattttgctcagcttgctggaattttcagaacaagcatggttttaggctgatttgtgatttttatatctcaacatgcattgcaaattggaaggagcttccagtatgacttttgatcccctatagttgaaacttacttgtaaatttttgtttgaattgtttcagctcttttggactctgtttgaatgctttttaaagcccttcttgagttgtgaaaaatttggaatttcagcttgctgacatcttgtgatttttgttttgtctatatgcttgagatattgtcacgtcccaaaacgactctaaaatacatcctctaaattatgcctagaataattaaaatccatgtgaaagcctccaacaattaaaatgtgcaaatctaaaagccaaataaggcttagaggatttttgtaaatttcctaaaagcctaaaatgcgtaaataaattttagtggaattttcagagcaaaaataataattattaagaaataaacaaagttaaaaaggttttataaaaagaaaaaccctaaaagtcccccttccctcccttgggccggcccggcccatctctcatcccccctctctctctcctctccccgcggcccactcggcccctccccgcgcgcgcgccgctgacgggcgggcccgcccgccaccctcgctgacgggtggggcgcacccatcatccccttcctcctgccgctcccaccgctcccgccgctccgcttgcgccaagcgccgccgccgccaaatccgccgcatcccgccgtccacgcgtgcaataaagtagggggaatcactccccgtgatcccctctccctttccccttttttcccctctctctctcgcgttcaaacgggcggatttgcccccgcaaatctcgccggcgccattgatggcggccggacctcccgcgccgatttccttcccctccggccgctctctcccctttcaaccctatttaaacctttcccgcgcctccctcgcccgtttccgccccttgccgcaccgtctcccaccggaatcgagc

SEQ ID NO: 10684 - DNA, 1501 bp, Oryza sativa
aatttaaatcatctcaaaatgagtcatatttgattttatatggattttacaatttctaggtatctctcttgtatattctcagattttctctccagggggtccacatagcagtgagagatcaatatgcaaaaagatctgagttttctaagaataaacccgcagtcctaggcccatatgtcattgggtaagaaagttacatattgacccttttagttttgattatttacaggatgacgtcctcgtcttcaacctccagcactgccatggacaggggaggcggctgtgagattgtcaagctcgccggcggtgattggtggctcgtttggggttgaggtcaaaagacaaaatgaagagaacgctctcctgattccattcctctacttttcttggttagggaacatcggagtagctggcggcgagtccgagcggcggctgtgcttaggctgctactgcatgttgagttggtgctcgattctaagtgaatgaaatgcatgaatgaaatcctatgggctcaacgatgctcaccgaagcttgaacgaggcgcgggaaagtctggacaacagcagcggtgaagaagatggtccggcgacggtgcagagctccgggaagacggcaacgactcgatccactcatcaaattgacatgcatgtgttttcatggggttattgaggtcacagggatgctactgatgcatggaatcggattgggactcaccggagaagatggattcggcaaatggcaacggtgacccgagttgaggaggatgacgccgatctccttcctcgatgcgccattctttgggatttttgaggggaaatggagaggaggactacgcgaagctggtggcgtggtagctcgctccggcttggcctaaatcgacggcaacggcgacgatgtcgttgcggcggcgctcggtgcacgcactgcaacacccgtgggcacggcggcgttcccgtcgctgcagcggacgaaacaaagtggagtcaaaagaggatttgctcggcatggagagagaagtatggaacgaaaaagagatgacggcgtgcgcggcttgacgacgacggcagccttcgtcttctccacggtcggtgacaaggatgagggtgacggagaggctgagggctctcctctcttggtctggtcggctctgggtgtgaagtggagatgggcgacgcgtctgggagaggttgaaggcgagcttggcgatgccacgccgagtccacgcgtcgagcaggtcgttctctcggttcccctctctctttcggctgtttttcttgaatgctggtcgggtagagcggtggaggagaagatggacagggcgtgggcaagccagggaggctgccaggtgggcccaggtcgtggcaaactaggctagggtaaaataggtgggtggaaacatgagtgaaaatggttttccaattattttcaggattatttctctcctccatctttgttaattcatatattaatttatagtgcagaagggctcatgtggatttta

SEQ ID NO: 10685 - DNA, 1501 bp, Oryza sativa
aacattagacacatccaaacccaaatagccatccccatttcccatcctttgtggtgcctctttgtgagggggatttgagaagggaagagagttggattgagagattgagaagttgagagctagtgagcttcactccatactttgagtactcgagttcatagcaagcaaatatattcgattgtgtttgttactcttggggactaaggtctcatagacggctaggcgtcgccggtgagcatccaaggttgtgttgagccacgaaaagtttgtgaaagcttcgattttgcctccgcaagggaagaaatcaagagtgaaaccgaggagtgtatttgtgtagcctcgtgaggaaagggttgaaatagacccggccttgtggcccctcaatagagatgttggatccgtggattcgaactttgggaaacaaatcaacgtgtcccctctcttggtttgctcgttcttgcgatctctcatatcgtgcttgagcttgtttttacctgatctacttgcatgcttgattaatattgttggtgaccctatatcttgtttagacaccttttttgtcaccttttgattcatatacattttagttgttcaagctacaagttcatagctagtgtttattccgttattcgctgaactttttggttgagaccggaacttccaatcccataccggaagtttgatttgaatcaaaaattctcatcactctaatatgctatgaagttgtgataattttttggaacgcctattcaccttctctctaggcaacatcaaggtcctttcaataaagatttaattgcaacgaacacaattatgtaatcggattgtagatcggataagtaatttttttagataatggaatataatatcccagcctttgctcaaaaagaactacagccaattattacaaagatctactccagaagagagtgtagttcaagacaagttgaacacaccaaacaagagaagagaggacccaaactaagaaaagaaaaacaaaatatggagctagaaggcctcgtccaggcctaggactgaagttcgccaatgcatagaccaatgacaatatccttgcacgaagaggtttctccaaaacagtgcccccaaggaggatgcgacgtggatcgccgccaccgctcgttcggaaccgaagcaaggctttcacccggagaatatggtagggaaaggaaaggggtatgctaaaacaacacctccaaggaggggaacgacaccaaaaggcgtcgccgttgtcagctggccaaatggctctgcaaggctttcgcccacgattcccagtccaaacccacaccaccaattcgcacaagaaggatcgtcgtcgatcaacaacattgtcccttcagcgatttggccaaggccaccacccacaattgttcccgccgtcaacggcacgcccgcacccggactcctccttccccgccgctagacccctttcccgcctccacataccgccgccgatgacgacgcaccatcagccggatga

SEQ ID NO: 10686 - DNA, 1501 bp, Oryza sativa
cgagcgggccgctcggcatgacgaggccgtacacgaacgcgccgaacacggagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgaggaggatgacgaggaggcgggtggtggcgacgatgatggcgacctggaggaggaagagggggagggagaagtcaagaggggaggcgccctgccagatgccgtaggcggtgaccatcatcggggagtagcagacgaccgcgccggcgccggtgccggccttgccacgcgacatctgggacgcggaggtggcgttcttgatgagcgggaccgcgccgcccgtgccccccgccgccgccgccgccccactcatgatcggggccatctcggcgcatcggcgcgtcgacgagagagagagagagagagagagtataagctggtggcgcgcggcggtggctgtgagcttctcgttttcgtccggctccccgtggcgcgtgcgatccgatccccacactgcctaattttgacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatatttcgctagtaataacaggcacgacaga

SEQ ID NO: 10687 - DNA, 1501 bp, Oryza sativa
aacaccactgctctcccaataactaaatcaaatgtgaacagtgcacacctcagctagccttgaaccatcaccggtgatgttctggctatcagccatgcctacacaggcaaaaatgcagacaaacacagctagcgccgcaagctgaccagtgccaatctccatgaaccaagagatcccaaatggcttcttgactaaatgaactttagagtccggcaagaatattgtgttctctatgactttactctagcagtcattctcgataatcaagttcccatagttgaaaatgggggaacagagttcgcatgcatcaggtgagataatcatttgcttcagattcctagaaatgaccaccacaagttgcttcaagaaagagatcaatggccgaatctccttctcagcaatcaagaaaccccaaattgttggcaagtagccagttcataatcttgctccacaaaaaagtgcagtttttaccagcgcttgcctaccaactacttgatgaaatgctcaaatgacaaaatggcaagcacagctagccttcagggctgcaaacgcaaatagaaaggggaaaagatgccatcaaagtcataaacgtgctaattaatcagattgactgtccaaagaaaaagatcaggaattacctagcgcttgccatctgatcgacgcagatatcgtccagagcggacatggagacgaagaccccagtagtatggagcgtaaatcaggaaggagatggcgatgctagcaagaatcagacacatgagtcctactgttgtatccatctcgcattgcaagcgagggtgagcggctgccgccacggccagggggaacgatgactaaacagagaggtggattggtagagcgacacagccgggacggtgatggagtggttgagtggagcacgactggaacggtgagatggagtggccgagggggtggggggccgggccgccggggtggagcggcggccgggacggtgatggagtgaagcacagtcaacacagcgtggtggagcggaggaccggcgcgtccgagatgatggagaggagcgcatgcaggcgagtggagccaagtgtgatcgagggaaaagagatggcatatgtaacgctccgcttttcgtgagacgttaaaaactaattcggtaaaatcctaattgcgaaaattttcgttctttgtgtgcgagtctaagtcgtgccaagatctcatttcaaatctcgttgttccctctcatcgaaatcaaaatcctccacctcaaattcctcttccgattcaagtctccaaatcaaattccgaaattcagtcgcatcctttgaatcctcgctaaacgctcgctcccaattccgaaaaataccaaactctatcttgagccttccttgattcctccctgaaccctcgagttcgaatatcgaatttgaatccaaatccaaactccaattctctccaaatcagccttctctgtgaaagtctattctacctccctctggctcagtgggccgactcttct

SEQ ID NO: 10688 - DNA, 1501 bp, Oryza sativa
cgtgagtgcgtcgagcagcctggaagggccagtaggtgatgatggcggcggcgacacaatcctcgtcctccggtggcgaagagagcgtcgcggcgagcatgatcacaccagtgttagggacagggccgtctggccgccccaattcagcagccgtcttgtccgggcggacaaaaaaggggaggttgaagcgcagctgatggtcgcggaggctgaggagcgtgttgcggcaggtctcgccgaggaagatccagccgccgtcgtaggcgccgaagcagcgcgcggcgcgcgcgccgtccgggacgccgaggccgtgcccgccgcagccgcggagggcgcacgagaaggaagggccgtcggcgcgcgggacgaggatccacgggagcgggcggagatgcggcgcgttctgcagcggcttgacggcggcgcgccagtcgtggcagacgcgggccatggtgcggcggtcgacgaggcacgtgaggcggttgtggacgaggcggagggcttccgccatgaagtcgcgcgcgggcgccgccgcgtccatgggagaggcggaggcggaggcgggggcgggggcgaggcgtgaaggtggcggtggcgagggttgggcggcggcggaggaggtggaacgcgacgaggacgcttcgtcgttgtgcgccatgtttgaacttggcttctggaagcaggggaagagaggggaacagagtggattggtttggaagaagaagcagagaaggccagccttttgccagccgagcaagtggttgggcccaatttatagtgccggttttcttgggcctgaagtttggatcgctgctctttgctgagcgtttcttcttgggcctaaatgttttttttttttgagaacgtaaagttcggatgtacatatggtgcagaatcgtgtctagcagacaggagaaacaaatgggagcagggaaggttaacccttttttttttttttgagaaaaggcattcaagcaggttaacagttcagatggacagatggttattatcctacaggaaaaaaaaagagaaaaaaaagatagaaaaagttattggtccaatgaggtcatcatctttagtaacataggcacacatgttttctgtaggcgatatggttaatcttttcattagtgctgaactgaaggatgctcagttcacagctcgtcctttacagagagaaggggatgaggaaatgttgatacatacacaggatgcttatctctgaattccttgttcactttttctgaacttgtgcatcagtctgatggtacaacaaaaacactagattagacgctcgccaagccgtgcttttgccgaaaatatacagacatggcacccatccgacctcaaaacaaaaatatgcatggcagagctggcatcacaaacgaactcccagtttgaattttaaattcccggaaggtcacttatgaaaaagaaaaagtaaagccttcataaattttagcccatttatccgcctcaagatttggggcccaagaaagct

SEQ ID NO: 10689 - DNA, 1501 bp, Oryza sativa
ccgttcttggtcagctaacgatataaatctcggactgtgattgggtgtacgagtcgattgatgggatcatttccttggcttccactgataataataataataatctcccctaataaaaaccatgtttagccatcgtaatctccagccgaccacgccgcgtgctgacgccgccgccgccgcccccacgcgcgtggtctacctcatcgtcgccacccgaatatccccctcgcgccacgcgtcgacgccgcgccgcccctccggtttctatccgattccgcgagagaatttttgacttttcgccggttcgagactctcttgggttcatgtgcaccacaggattttggggtgtagcagatccggcgccgtagtcaatttaagattttcaaacttcatttttggatttttttttccgttcatttctatatttgatttaattttttaattacacgaaacgcgtgcacacacaccaacgccacactcacactcccacgaatatgtccccttaacacatgctctaataaatggaaaccaacgttacatccctgatctaactgcaatcctgttgaaaactcacttgaatatgcgtaatattcgtgtgcatcaagatttaaactctgatagatgaaataacatcattagaggtttcccggtattcgattttagtttagagccaataaaagtagaaatgtaaacttttatatcatgccttcgactaacgaaaatatgaaccgcaacaaataggctcgaacaaacaagtccattgactttgactacttatccttttcattgatttctatcataaataaatatttaatgttcagaataagatttagttaaacttataatattttgagaatcaaatctggtcctaaacatcaatattttttttaccttaaggagcattttaaggactatgatttttcattttgtaatgcaaaaatagggactaaagttttgaaaagaaaatagtagaatttaaacagggttttactgactttgaaacccttttttgctaagttaaaaaaatcaatatttttcttttgctagaggcacattctaacataaccgcgaataaacctgaatttttttaaaaaatcgtttcaaaattggcaaaagcctggatctaatatgcttgtcagttaagcttccatctagctagagtcctttgtccaaagcttcaaagtactaatcttattaaaaatctcacttaggactaatcttcctttgcacaaaggtgaaaggtcattattagttgatggcgtcccatgtcccatacacacgtgacagccatcagccacataacccttccaacccaacctaattatcccaggggcattcctgtccatctcccgtgtatatatactcaccaccacccttctcgaaccctgacctaatcaccacctcgctctttgcatttcttgatttctcctcgatcacctagtagttgatcgagcaatggcggccaaggtgcaccccaacctggccgtgccgtcgctgatcc

SEQ ID NO: 10690 - DNA, 1387 bp, Oryza sativa
ccaaaactctctatgaagtgacactgcaaaatgttttaccgcctccttcatatcttctgctctactataaatcgctccctgaataacctcattttctttgtactcccatctcacactatcctcttcagagacgatcagcctagaaaaatcctcactagcccattctgctggattaatatccgtctcatcatctgacgaatcaacttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttctttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcctgcaaaaaaccctccctccgtcaccgtccgttcctcccccgtttgccacgtcagcttgccgccccagaggtgggcggcaggggctatttctgcaatttttttggtcgatagattatttctgt

SEQ ID NO: 10691 - DNA, 1501 bp, Oryza sativa
gcgtatactggttgtttgttgttcttggtgaatgctgatccgatccattgctttagttgaggatgtatccgatcttgtttgtgctgaggtgacgagtagtcttgcagtagatctcttcgtgtttatgttgtgttgtgctaaggtcttgtagttcccaaaattttttcccaaaaatgtcacatggaatctttagacacatgaatggagcattaaatatagattaaaaaaactaattgcacagtttgcatggaaatcgtgagaccaatcttttgagcctaattagttcatgattagccataagtgctacagtaacccacatgtgctaatgatggattaattaggcttaataaattcgtctctcagtttctaggcgagctatgaaattacttttttttattcgtgtccgaaaaccccttccgacatccggttaaacgtcggatgtgacaccaaaaaattttcttttcgcgaactaaacaaggcctaaggcgtgaagttgggggtatagtttctctgaattgtagatcaactgacagactttcgcatgctcatagccggtttgtttgcggtactcaagaaactgtcttgattggtcattccgtaggtggggacttgtgaaaaagctgattcctttcttttcatttccacggttgctttcttgttggcgtgggaaaaaaacagttttcagtactgtaccgatcgactttcttttgagacttttttctcctcaacaaaacatttcatagttcacacaaaaacacaagcataccaacgatttcattatgtgacatggcttctaaaatctgaattaaagaagcaagttgcttaactgaaaactgcctagtttcagaaatcatggagtttaaattttgtactaaaaaatgtatgcttatggaccactattctaagatgcttcacatcttgatgacggctgtctgatcagaaaaaaaataatgcttcagatcaaccaatcagacaatccaggatatgagcagatcatgttgcattcatttcatccactgaagcatgtcccttttttctccctgaagattggtctaaatcgattcaaatacacattgcattgtatgctcttaggagagagcaccattcctttggagggttggtgattcagaccagcctcggttgattgatttgaatttcttaactacaagtcacttgatctagttataatttacgcatcatggaccattcattttgggagtttcctatatacaactaaagtgttatacttcttcctatctgcgccttcctttttgtttgaataatcctccctctttcacaatttgcaatactagttagtcaattaatagctttgaatgtgatatcttaaagacatgtattttgtcattcatgtttgatgaagactcgtgtttttgtaggatgaatgtttagttcaagttacatttttctgtattaatctatagtctttgtaaacactgttttgaatgatttattttgtgttatgcagatcagttaaaataaa

SEQ ID NO: 10692 - DNA, 1501 bp, Oryza sativa
acaatctgaactcctggtgcaatagacacagatgctaagcagaacataaatggtccaataataaaagaaagaaacttccaggatcaaaataaataagatagcttaaattaagttaccaacccaattcatagtagaagtcaccaatccctagaagttctgcccaagctcctttattcgaagccagagggtctactccaacttttgcacacatctcatggaactgttgtctaaatagtggatttttacggatatcattctgcactagcacaccacatacacaaagttatttaagagttggaatatgctgtgccatttgagctctattgtgaacacctagaacatcagtataatattgcaaatgtcacccctgctggaactagatgccatgggacaagtgaaatgtatcacaagaaataatgatcaattggcaccttggtaactccaaaacctttttctgttacattttccatctttaactgttgagtgtaggcgtgtgtatttcagcccaatagggcccattccaccaatgtatatgtatagtagatgagaaaggaaatgaagtgaagcttctagaggaaaaatcacaaaactacatggtatcagagctgggtcaccggcgacctcgccgacgcgaaccctagtcggcggcggcgctgtgaccagaggggttctgcggcgacgtcgacggctgaggcggagcggcgacgtcggacagcggaggcggagcggcagtgttgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctgttggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagactccggagcatctagacatgttacaggaatgtcgagtgagtttacatcatatactccatttcagtcatcatttaaagaaacaattcaaactgccg

SEQ ID NO: 10693 - DNA, 1501 bp, Oryza sativa
tcgacgtgtttgcggaaatgccaggccggcgcgcgccgcggcgcggccggggtagcaagcacgtacgcgtcttatgttacgcgctagcttaggagctaggtgcatcaggaaattacgtacaaaatgcacagcggcttactctaatactcgatccagtcaatttcataattcaggaaatttaattatatcgatttccaggacaggtttttcacaaggacacagggggcgtacacgtataatcgtatatgcgatcagagtatatatacgcgcgttttagcatctgcttaatcaggtcagccattttccttctgtttacgaccatttcttttgcttaatagttaatcagtttctatacgcgcgttttccatttcttttattttgctaccacgtcgtgcgtggacgatgccatcatagtgtcgtcttggagctagtcaacctatttgtgtcaccgctatacatgtactattataccagttcattagattcacgatgtattttctatatgaccgaacaatctattatataattaaagtaatagaaaaaggagcctccatattcgctctcacggcttagaaattctcacattaatcgaaagaaaataagagaaaaaaacaaaacaccaagtgtattaggattagaattctcacattaatcgaaagaaaataagagaaaaaaacaaaacaccaagtgtattaggattaggtcatgcaaacggacaagaaaaattaaaagttaaaacggacagaacaaatagaaaaaaaacaaaggatattataatgatagtgtgtaaacagataatgattctttggaatccgtatgagagaaccaaccataatcatattctgcatgcccatatgcgtgggccaccatgctatttatattattaaaggaatagaaaaaggagcctctatattcactctcatggcctagaaattctcacattaatcggagaaaaagaaaaaacagagtccatatagaaatacaatttagaaatagctgaaattcggaattaaaaaataaggaatattagaagaggagactagagtctatatagaaatacaatttagaaatagatgaaattcggaattaaaaaataaggaatattagaataggagactagagtccatatagaaatacaattaggaaaaaactgaaatttgggaattaaaaataaggaatattagaagtagagtatagataccatatagaaatacaattaggaaataatataaattcggaattaaaaataaggaatattagaagtagtgtatagagtccatatagaaatacaattaagaaaaaaatagaaattcggaattaaaaaaataaggaatattataagtagagtatagagtccatatagaaatacaattaagaaaaaaaatagaaattcggaattaaaaaataaggaatattagaaatagagtatagagtccatataggaatttaaaactaactaaaattcagaataaacataacaaaattaaaagtagagtttaga

SEQ ID NO: 10694 - DNA, 1501 bp, Oryza sativa
gtgtcatcttctccctgttggccttagggttaagtggagcctccgtaagaagaattggatgctcttctggtgctacacgaagctcattgtagaatgtgtggtgccaaattttctccatgtcatcccagttgcttacaattccatgctcaatggggtatttcaaggttaggatacccctcttggattgggcctcatcaccgacataagcatctttttgtcccatcccaaccataacgcctgtatgtcgcggacggccaacaatactcgggaaaacagcacggggagcatcatctccagcaaacccagcctatgaaaaatgaaaacagttaatacttgatgagcttctcaattgtaacaataattaccatcaggtagaaattttgttcaacaatgcgatgccaagtcatcactttttattaccttgaccattccggttccattgtcacagacaaggggctgaatgtcctctgcgtcagccatttattttaactgatctgcataacacaaaataaatcattcaaaacagtgtttacaaagactatagattaatacagaaaaatgtaacttgaactaaacattcatcctacaaaaacacgagtcttcatcaaacatgaatgacaaaatacatgtctttaagatatcacattcaaagctattaattgactaactagtattgcaaattgtgaaagagggaggattattcaaacaaaaaggaaggcgcagataggaagaagtataacactttagttgtatataggaaactcccaaaatgaatggtccatgatgcgtaaattataactagatcaagtgacttgtagttaagaaattcaaatcaatcaaccgaggctggtctgaatcaccaaccctccaaaggaatggtgctctctcctaagagcatacaatgcaatgtgtatttgaatcgatttagaccaatcttcagggagaaaaaagggacatgcttcagtggatgaaatgaatgcaacatgatctgctcatatcctggattgtctgattggttgatctgaagcattattttttttctgatcagacagccgtcatcaagatgtgaagcatcttagaatagtggtccataagcatacattttttagtacaaaatttaaactccatgatttctgaaactaggcagttttcagttaagcaacttgcttctttaattcagattttagaagccatgtcacataatgaaatcgttggtatgcttgtgtttttgtgtgaactatgaaatgttttgttgaggagaaaaaagtctcaaaagaaagtcgatcggtacagtactgaaaactgtttttttcccacgccaacaagaaagcaaccgtggaaatgaaaagaaaggaatcagctttttcacaagtccccacctacggaatgaccaatcaagacagtttcttgagtaccgcaaacaaaccggctatgagcatgcgaaagtctgtcagttgatctacaattcagagaaactatacccccaacttcacgccttagg

SEQ ID NO: 10695 - DNA, 1501 bp, Oryza sativa
taagaaactaatccaccaattacctttgttgtgtacatgtgtaatgacactgcttgtgcattagttctgctttgtgtccacgtgtgcacgtgcttgcttgatgtagtagtccgattgtttgtctgttgcacagggacacggtaggctctatatgtgtacacgtgcatgaatcggtttggtcagtgacagtcctgatcgagtacgtttaatataagtaagccgatccagactgcttgcgttgttgccgagttgggttcagtgctgcgtcctcgcgccggttgatgtcgtacatgtgaaggaattggtaccggatcaactccggaatttgtcgggtatctgcgatgacaatgccttgaagcttgctcgatcgtgatagataaaacagttggcgatgatgattttgatctggttggagaacgcacatcgatgggattgtaactcccacagtcaaaagacgttgagtagttgaaaaatccacgtgttgaacccatctcgtcgaaaaccttaaagcaccaaaatttccctatctgacgcgccattgtcgacattaatttggtatcacggctacggtatttggatggtatggggatcgttggtaccagggtatatgcgagattgaagtaaaagaaatgaagacaaagattttatacaggttcaggtcccttatatgataggtaatagccctacatcctgtttatatgggattaatatagaaaaccacatagcacaacaattgaaataacctatctagccatcgtcgacttggcggcatgaacaccaactcgtagtcgacgacagggtagtcttcctccttgagtatgaactcatcgagatcagatatggcgctagatccatcttgccggcatctgtaggcaccggatggggtatgtctaggcttatctctgatattgatatgcggcggcgtgtgttggcttgtggctttgtggcgtgtcccctctcgtcctaggagggcttgtatttatatccatagatggcaccttgtccaagtaagactagggagataaagatggatacaatccgagtaatccttgttggttcaatatagaactctatttgtcctttcttatccggaactcgttctatatacgaggtttgtttccgtataagacatggtatatggttggccatgccaagtttactcaactactattaggtatgtggtatccataaccatgacaatgaccttgtgtatttgtgaagtgatatatcacatattaatctttattgttaatgttttctaaaaaaaatatttatcaccatttgaatatataatatacaaacaataagtatatacatgtatgagtctaaaatagtttataacgaagaaatcacatactctttcttcttctttttgttgtatgaagttattgatcttttatagttcgttcgatcatttctcatattatgaaaattatatgattataatctattttgttttaatttattttgtctttaaactagtttaacattagttacgttt

SEQ ID NO: 10696 - DNA, 870 bp, Oryza sativa
caatgcaagacacgcacttctcgggtctcacttgctagctaggcctaaaactctataaggacatgagttttcacatagccatgtgatttaggagcgggggcgaccacgaccgtgaaggcatgatgtgataaggatatgacctccacaatgcaccctcacaattctcttcctgcatgtcacacgccatcgtttcgccacgggagaacgagtgtcctattttggcttcgcgttcttcaccgggggacaacagaggccgatatggcgtgaaatattacgagccggatgccacgtagatatgcagtgaagatcctaggtaaaagaagtgttatttatatacataaataaccaatcatacttaaaaaaaagttaaacaaatgaacacaatttgttcaactttaagttactctacacgtaattgtcgatcctttttgtttttttcttttgcaattatcttattttattttttttcttttagaaacaagctagtatatctatatcactatatgaatataagtcacttagtcacgtgtaactggaattatttttcatatcaatagtacatgcctatcgtcgaataattaaagaaaatcttaagacccaatcattgtggtatctaaaataaataaataaaaacgagatatatgcacaatcaattttgtttggttcaccaaaccatactaataacgatctatccatcgaaaccactatcatttggtaataataactttaaaataaacaagtcaaactaaccaaaccgtggttgcatttaaacaatcatctcactgttctaacacactttgtttacgaatttcgttgcaaaatttgttaaatttttacacccaagtggattgttctgatttccgtgggccg

SEQ ID NO: 10697 - DNA, 670 bp, Oryza sativa
aatccatccatgtaccgatgtacgtattaaccacacaataatatctctgaatgaccatctgaagttctgaaccagctaccaactggggatgataagaaattccaaagtaaatccatccatacttagtgcgatttattaaccacacaataatatccctgaatttatacttaaccatgcatctgaaccagctatctattgaggatgcgaaagtttttgtttgtacatgttacacgacaaaaataacacactactaaaaaatcttaacaggtgatagctcatgggtgccggttcatttaaaattgacacatattgaccgtttcccaccattatggggtatttttttaaaaaaaccggcacctttaagaacttatgggtgccggttttagataaaaaaaaatcagtgcctataatattattatgattttttaaaaaaccaacgcttatgctaacattgaataaattttaaaaatatacctattttttcataatttgtatttatatacatgtgtggggaaatttggcgaaaatataccgcctccgcgcgttgggaacgcgggaacaggatgaaagcgcggcgtggcagcgtgggaacgcgatgccgcatactggatgtgcgggatcggctcgatcgcgcaggccgaaggtgcggaaccgagtcggtcccgcgcga

SEQ ID NO: 10698 - DNA, 1501 bp, Oryza sativa
agccaaattttaaattttcaaacttaattttaaaattgattttgagatatttttaacgtagtttcttttacaacattggcttttaagtcatcaaaaaacatatttataaaagtttcatctacaaattcatttttattttctaataagctgttttgacttattaggaaataagccaaacgatgtgaaccataggcacgtccctgtcctgactcgtgatgtgcattcatccgtatcaatgccctatagctctacaagtagttttagttcagtatagggttcatgtatcagatcacatgctgacatgcatgcatttgactcgtctactgttatttcagcctgatcagcgcacgaattttagcatttttgtaatgtcttgttagagctcgttcggttaatactaaagaatctaaaccgattagttccacgtctcaatagatatggaattatttttcttcatatctccttcaatcccaacggaaaaagggttaacagttatatgaacttttattacttcaatctccttcaatcccatcgaaaagggattcataggcgtaagccttagaattttttttctaccaagttagagatggttttgtgacagtgtcctttgctaaagcagatagcaaaggagaaggtaactggctttacaaatacattttctttaatcatgtggccacatgaggcatagggccagtaggccatttcatggaacatggttcctcttggagctttgcgaagttccttttcggtttgtggactcaggtgcatccatgatccatgtgttgccacaagcaacgaagcaaataccaagcctggatgcttcagctagacatctctcggcgtctataactctgtcggtatgttgtttattaaccacgactaaaaatcttggttttgaaactaaattttgaagttggttttagatttttattgttcattgattcttaatccaataataatatagattaaggatgtgttcttatgccacttttttcaactcacctctcttgttttccacgcgtacgttttttaaactactaaacggcgtgtttttatgcaactatatatatatacccacacacacgacagttgttttgaaaaaattatattaatccattttgcaaaaataataatacttaattatttatgtaagaatatgtgcttcgttttacgtgccaggaaccccttccgaacgcagcctaaaagttttactcgtaatttatctttggctgcttcttttctagtatatcctatcggccatagctcgactatcagattaagaaggaaaatcacatagttacttcgtttttcatgatttttacggtgctatcaataaattcccatacaagattttcaaataaaggttggatacgtgctagattactttagtttctgcaggaacgaacaatatagttttcattcgttccaaacatggccacagatatttatcaaaaaattcgagtgggctatatggacagacaagtaccatcaaaatgttatc

SEQ ID NO: 10699 - DNA, 1156 bp, Oryza sativa
aaacattttcaatcgagttgatagcggctgggctaatttattatagagctttgattaagaacgagacaacggggacagatggattgaacgcggagagtggccaggaaacggggctacataaccggtgaacgtaatggcagaggggacaaaaacaccatgcgattattatgcagaacaagtatcttgttcatatgttctgatgttcatgtcgtttgatatgaagcatctctatgtaccaactaatcaagccacccaatataactaaggcccctttaaattaaagggaataggaaaaacacaaaattataacagaaatgtagtgtaaattaaaatagagattacaaaatatagaaaaacacataaataaccatttgattggatcataagatagactcatagaaaacttttcataaggttctatttcacgttaaatttccttcaaaacttatatgaaatgaagcattccatagaagattcatttcctttgaattaaaggtgggctaagtaaattgatagcaacccctttttagaaaaatacccccaaaatcaatcacaactttaaatcccttaaggctaagaccgggtttttcctctccgtattttagattatcatggcatgctttctaaactccaaatcgttgtaattttttaaaaccatatattttttttaacaaattggcaagccgccaattaaatctttttatatataagttgcatagaatactttttctgtgacaactttttaactttgcaatatactaattaattcatcattcgtttgtattatcaaacattatcaccaaatcatacgatttatcatccatttatctattatgacctttcaaattgggccaagtacccaagcgcacaaatatgaaaccacaacctctcatacaagatctttagcatttcttatgcttttgtcacttgtacaatacaaactttaaagtagaactatcaagtaaatcactagcaaaaaaggttaaaagtataaagaagagaaaggcaggaaagagaaaacattcttcttttccttaaccacttcctctttctctcacacacacacacactaggcacaaattctcatcttgttctatatgtacccaagcccaaaactatagcccaagtgagttaatacttaagcagcaactaatta

SEQ ID NO: 10700 - DNA, 1501 bp, Oryza sativa
cgcgcgggcagccgtggtgaaatcgctggctaccccaagacctgttcacttggatgataaaaaaaaaacttaccaaattttagcaatgttaccaaaattttaacatgatttcttatatagttaccaaaatttgacagcaaactaaatgtagctacttttttgataattttaccaaaacttggtaaggttaaaaatgacataaaaataaacaagcccttatttgaacgacgaatttgtctgggcaccatgcgcagattgtattacgtagtaaacctctgtttcatatcacgggttgtttgactctttttacagttaaacttgtttaagttcaaccaaatttatagaaaaatacaataatattttcatcacaaaacaaatatattatcaaaatatattcaatgttagatttaataaaactaattttctattttatatgttgctaaatttttctacaaatatagttaaacttaaccaaattcaactaggaaaaataaataaaatggcttataatatgaaatagatagagtatttacgtgcgactttgtcactttgggtagataaagatataaaaacttaatgaaatatggctctctggtgagaaagcgcagtacttaatacacgcagagaccaaatcgaattatgcatccactataaatataggagtttatccatgtttgaatttggggcaatgtcatccacgatcaggataattaagaagacacggaggagaaaatttccggtcaaccagcgaggcctatagcacgcttacgtttaagcccatcatagttcacctcatatgtgaccaccacaagaatatccttcatttccgtaatccacccaaaccgcctcgaaacagaacgcaaaaacaaacccgaccttgaactcgaaacaggcgcacatcccacacctacccatttgaccgtaccccaaaacaaccgagaaattagcgggagagatcgacaagcaagaaacacacccgaaactaacccaaacacgaacaaaacccccaaagctaataaaaaaagccatcctaatctgaatcacaccgcccctagccgcaaccccaacaaaaaaaaaaaatccccttatccccaaacgcgactcgcgcgcgcgcggtcgcggcttggctaacgacgcgcgacgcgacgcggccacgacgtggtttggtttggtggttacggcgcaacggccggttcagaccgcgagatcggctataaaatccagcgcgcccgcgtcgcaacgaggagacccctcctcccctcggcaacgtaacacaagagaagaagagatcgccatgtccaacgtgcccacctccctccgcgactcctccctcaccgtcttccgcctcgccatctccagctccgacccctggcccttctccctttaaccccatcaaacgcttcttcctcttccaagaagatcacaagcttcttcgtgttcttgttcttcttcggatcactcggttggtttcttggtttcttggtttcttggattgttgcga

SEQ ID NO: 10701 - DNA, 1501 bp, Oryza sativa
cctttccttgtgttagaatatggaaattatagtttgtttcgtgggaatatatgtgtttttcagctctcttaaagtaataatggtacttttaaccttcccgccgccatatatatggtcgttaactctatcatgacatatagataatacacattggaaaagaatcttgaaatgtcggtaccagaatattcctcgctgacaaagatcggccaatcagcactcatatccaatcgtcatccttttgaccgttactatcgctacaggcgtttctatcactattgtcatcatactccatttattttctattactaaaattttatgtcatcaaccataccatctccctttctcttcgttgcggtcatttctacaacgtcagcctgatatcaattattactaccattaatttatcttgtcatctaaagtaaatttgtatgggcccgcaaattacttattcatgtccacacaaattactctcgagtgcgtgcttattcctacaattagtattatacatgaagccatctttatgaacacaaatattgagatgaaccgtacaaaattatggcacgctagctccattagccacatatgcatactcaacaacatttacttaactttcatactaatataaaactttaaaaatatcatctaaaacgatgataggaaatacagcacgtactctctcaatatagaaaaaaacttcgttctagcccctaacctcgtttgcgatttaaacgacgttatgaaccgtagctaggccttgtggacgggattgctcttgtctattcaatagccaagcttccacaattaatccgcagcacgcctgctcacctcgtttcccatgcaaaatcatcccaaggactccagcctcaccgcactagccgcttgagttaagtttgcttctcaaatggaatgctacgcacaactgtatttaatagggacagatatagaaaaataccccctaattaatcaccccttagtatgctaaatgttgtcctaaacgttatattttaccagtatggagggagtactaaataaaaaacaatagtggtttattaatcattcctaagtcttgttgaacaagagtagtttaatcatttctatgtttctatgttttgcatgcaggtccatatatatcgaaatatctccacccctatttcatgtaggcaactaccagctactataactatggttcccggaaaaatattttttaccttaggccttgtttagattcttaaaaattttagccaaaaacatcatatcaaatgtttggacacatgcgtggtgcattaaatatggaaaaaaatcaattacacggtttgcatgtaaattgcgagacgaatctttcgagtctagttacactatgatttgataatatgatgctacagtaaatatttgttaatgatggattaattagacttaataaattcgtctcgcggtttacagacagaatctataatttgtttcgttattagtctacatttaatacttcaaatatacgcccgta

SEQ ID NO: 10702 - DNA, 443 bp, Oryza sativa
cacccccccccccaccccctcgggagtggcggcgatagaaggagtgaacggccggcgtcagtggtgggagcgagcggatccaccgtccccgcccgcgtgagtggcggtggcgcacggatccgtcgtccccatcctcaggagcgacgggcgacaagcgatgggaatggatggatccactgtccccaccctaggaagcgatggtggcgcgtggatccgccgtccccgctctagccaggggcggagctagaacgaaacggaggtatagctgattcggttttaacgcttaatttactctattttagatcgagtttaagctgattcgggtgtctatgtttgtattgaggggggtgcacacatgataaaaataggtgaggtatagctaaatttttttcttggccggtttcctagacactcctctaatatactatgcctccgcccctagc

SEQ ID NO: 10703 - DNA, 1006 bp, Oryza sativa
ctgcgggggccgatggcgcttcctccggctctggttccgcgtcgtccgggaggaggaaggggagggcacaagcgattcctgcccccgttgcttctccgaccagcgctggtgagtttgggggcggcggcgaagttagggtttggggcggcggtaaaatccgtagtggtgaagcggcattcataagcttgcaatcggggtctagggttgcgaaacggtcgatggagcttggtgttcaaatgggtggggagatgggtctcggatcgaatggaggtggcggggctggaggccaggtgcatgatgaaatgccacaccggaatgtggatagttcggggaagcgtcgtaagatagggatggagatcccatacgtctctgattcagagagtgacaatgatgatgactgcatacttccaggggaggatggcagtaggatgccggtacagttatgcgctgcttctgatttgattgaactgaatctgttcaccatgagcatgggcaggacagatgaagggagaatgggtgattctgtgaagacaggtaaaaagaaagctagtggagttactattcgagaaaatgacatccccattgacgagcatgtgcacggacagagttcggcaattggtgagagtattgagctattagcatctcctatgcgaagtgcattaggcgaaaaccatgcaggtatgtattccacagaagaggagagaaggcagaaggctaggtatgatgttaaaggcaaagggaagctgtatttggggaacgatgattctggtgctggtaccgggattggtaagtttagtcccgatagtaaaggaaaggctaagatggttgtggaagagagttcattgtctgttagctcaggtgcggatcaaatggatttgaactcagtgatttctgaagaggtgcagagtttcccagcagatcattgggaaccacgtcggagagaaagggcaagacagagagctattgaaatggctcctaggtttgcattcttcaaagcagatgaaga

SEQ ID NO: 10704 - DNA, 1501 bp, Oryza sativa
atgtctggactactgatcattgctgatggaaatttgctgtacttccctccacatttactgtaggcttattaataagagtttaaaattttaagttagcatgcatttgttggttccagtgttgtgattttttgcttgtaatcaaatggccacccaatcacagcctaatgcatttgtgtaccaattccacctcttaactgatctcctttccagataaccctgccgaccagcttgtggcattgatcaacagcaaccgcactgccagcaaggcatctactcttgatgataaccaaggcctaggatgcattgctctgcagtacattaaagcatacgagggtcagtgcaaccaagtcggtgaaagcaagaagcctccggagaccagcttcgctgaaacatttgccccaaattgtggcgtccaagctgcaacactcaccaagatcaccgggaggcttctggcttgccagtctaactatgcgaccccagaccaggcgttcaacttcctggttaatgatgcgaagagcattcaggtactgcacagcaagaaccacacggaggtgggagcagctgtcagtggcacttctggcggcgggccgtacttctggtgtgtcttgttcagcagcgggaagccaaccaccagcttcaaggtagatggtggagtgcccaagtctgtccgtccaggatgcttcagtggcaacaacgacgattgcatgggtgccaatgctgcagtttcgatcggtgcaggtacatggagactggtggctgcactacttttctccgcggcttgtgttttcgctttgtgagtttgagtagaaatgtgttgttgcaccattcttttgctcgtcttggacctggtttggaattttgcttctgaaaaccagtagaacactcttgttgctgccgcactgttcttttcctttcttagcagctgaactctgtcaggattaaagagcattgttttctgcacttatagatgatgaattacctgtgcaggctgttcatctgttgtatttatagtatttatctattcaaatgtactctttggaaaataattgtgattgtaagatccttttgatcactcgtctattcccatcggatgcgctttctgcagcaagtgccctgttgtatctttttttttataatagaaatgaattacatctccggtttttatcataagacacacatttataagtttgttaaaaaaaaggtaaagataaaaataaatcaaaatgggaaatggagtgcctgttgtatcggtacagaacttgccattgattgaaagagaattaactgagaatgttattccgaatgagatcccttggacatttcatagggaaaatatgggaatggtaaagtaaacatttgctccatgaatattttaagcctaattgctccataatttgacaatgtggtgctacattaaacatttgctaatgacagattaattaggcttaataaattcgtctcgtggtttactgacggattttgtaattagttttttatcagt

SEQ ID NO: 10705 - DNA, 1501 bp, Oryza sativa
tagctgaaattcggaattaaaaatatgcaatattgaaagaggagtccatataggaacccaatacgtgattaattaaagttcggaataaaaataaaataaatttcgaaattagaaaaaggaaaacgaggagttcgagtaggaatacaatttaaaaataactgaaattcggaattaaaaataagaaatattaaaataagagtccatataagaatccaatacaagattaattaaaattcgaatgaaaaatttaaaaaatcaaaaattagaaaaaaaacgaaaaaaagagttcaagaaggaatacaatttaaaattaacttaaattcgaaattaaatataagcagtgttgaaaataatagtgcatataacaacctaatagtagattaattaaaattcgaaagaaaaaacaaaataaaatccgaaattaggcaaattaaaaagagagttaaagtagaaatacaattttgaaacaactgaaattgaaaataaaaaataaaaatatcaaaagaacacaatacgaaaaataaaataaattctaaaattaaaaaaagaaaaatacttggaataccatttataaataactaaaattggtgataaaaaatcaaaactattgaaagaaaataccatctaaaacacatggcgagattaattaagtaacatgcctataaagaagtagagtggtggcggttgatacgacatataaaaactgttaataaaacaccaaatagaatcctaataacgattgaaatgaaggacgacaggtaggccgtgaatcaatcgatcaaggcggtgccgggacttttaaaaagtaaaaaaaaaccaatgctaatcatattcgatttttaaaatctcaatgataataaaaaggagaagcagcgggcgggatgtataggaaagccgccgacggttggcgagacttttaaaaaataaaaaatgaattccaacgatagttatgttcgatttttagaatcccaatgacaataaagagtaggcggcggatgagccatagaggagtatagtgacatcgtttaatggaacttctaaaaattataaaaaatgaaaacaacaagactataaactctaaaaactatgaggtccaatttttaaaggtttggaacttctaaaaagtaaaaaaaacacaatgatagtcatgttcaattttaaaatctcaatgacgataaagaagggaggcagcgggcgtaccataaaggaaaacaatggcaaagccgctgacagttttggcgggacttctagaaaataaaaaatgaattccaacgatagttatgttcgatttttagaatcccaatgacaataaagagtaggcggcggatgagccgtagaggagtatagtgacatcgtttaacaggaattctaaaaattataaaaatgaaaccaacaagactataaactctaaaaactacgaggtccagtttttaaaggtttggaacttctaaaaagtaaaaaaaaaacacaatgataatcatgttcaattttaaaatctcaa

SEQ ID NO: 10706 - DNA, 610 bp, Oryza sativa
tcacaactgcattacaaaagggaagcggaagccaagacttgaaccaaacatcacaggcgcgacttgggaactaggccgaaaccctaaaactcatcgaagccggcttgctcctggaagaactcctcatcagcgggatccgcttcatcttcttcagcaacttgggggggttatttatatagagcaagggtgagtacgggagtactcagcaagccatgggaaataagtgtttaatgcatgcttcaaggaaaggctgttatttttgcaattgatttaattttgaactcctttattgaaacaactaagtgagtgcttctcaaacgacacggatgagacagtgcgtctcgtccggtcggagtatgtgcaatgtatcagtcttttgaattgttcaagattggcacccggccaacaacttttaaacggccacctgggcctagctgatcccatcagctacagattttccaaacatcgatccccttcccacaacagcaatttcacaaggcagtagtcaaacaaaactacgctaggaatcacctcacatccgcccatgaccgtgggcacggctgttcgaacagtttgttaacctctgcagagggggtacactttacccaca

SEQ ID NO: 10707 - DNA, 1501 bp, Oryza sativa
tcatttcttcaattgctcaaagaaaagagaagaagccacaatatagctattaatattaggattgaaacagcaggatggtattattaacctattagcagttgacataaaaatgtatcctatgattcgatgcagcaagttacttctatttctgtcgaatttgatttgttcaatgcctgctgaaaaaactcgatttctaatgcctgcttataatttgactggtaggaaagaaattattctgggtcgtgatgaattgccttttgggcgctgtttgacagtttgagacggcatgattttggcaaatcatagctgctgtgattccccttggtgtgccccttcactgaaatcacgaaatgccatagttgtctctaacctagatggaagaaactctcattaatcttttgcacccagaccacgacatgaaaacagatttctgttttaatagcaatacctgccaaggcgaccaatcatctgattcctactagtgctgcagcctgcaggctcgagtcctgccctgtccatggagcaggtaaagctactgcaactctgcgagtactcgggtcgggcacaaggcgatgccgtcagattccagcaagggaagggagaaaaaacgagggccggccgatgcgctccgaaacgaagcaatccgcgcgtctccttttccggctccccgacgagtcacgtacacgtcagtctccaccaccaccggcacggcacggcacgacactgccccccaccgctggcgcacccagcgcgcgcgcgggcacacggccgaaacccaccaaaaaaccgatggaaaaacacgccccgcccgaaacaccaatcatccgcacagctgcacaggcatagcagcacgtgagaaaaccgggctgcagcgtgtgtacgttcgccatcgataccgcggcgagcggggcgggggcgactagtccaactccagcaacgggccaaccaaccactagtagctagggagccggagccaggaggaagccaccagcccggccaagccagccagccacccctaccaacgcgtcccgtgcgaggagagagaggttgcaagcgaggataaagcgcccgcacctcgccgtactccgatccgatgcttcccccctccgtcccctcgtagcctccgcgttcccccgtccccgtcccggcgcgcgcacgctcgcccccctttccgttttcgagccgagctcctcgccgccgccttctctgacctgcgcgtggtcgtatatattaaaccgattcaaacccacggggtaaccactaggcgctggaaagggaaaccaccagataagctctggagctggtattggattagtgggtggtggtggtggtggtggtgcgaggccgtcgctgggcggtgctggttttctcgcgcggctggtgcgatcggagaggtgggtgtgtgcttgtttcggcgtgtgatttgggcggagggatccggcgatctggttctgattcgttgttttttttcttcctcttggtgtgtagggatggggaaggg

SEQ ID NO: 10708 - DNA, 1501 bp, Oryza sativa
gagcatggtgctttttttatttttggctgtgtacaccctccagcctactctcttctttggctgtgtacaccctgtacatacataggccgggtttaatataaaggaaaaagtacgaattaccccctgaacaattgcgacagtatgaattaccccccaaaccacaaaaccattcataccagacatataaccccccctcacactgttttgaccggttttgatttcaacttgtacacgtggcgccaacgtggcaatccagtcagaaaaaaagtaaccgttggggcccacctgtcataacccttcatcaacccaatccccccctctctctctctttctcgttgtctcgcacacgtgctcggacggctggcagcggaggaggggcacactctcagacgaccgacggcggaggcgaagctcgtccggaactccgtctgtggaggcggagatcgcccgcgtggtcggcggcggaggcggagcttgcctcagttgcctgggagtccggcggcggaggcaaagattgcccaagcggcacttgtacgaggagcacttgtacgacagggacaccggcaactgcaccgccggcgtcgacttccacaagtgcggccacttcgtcttcatggtttgactcaacttcaccaggatcggctgcgcccgcgccgagtgcttcaacggcggcgtcttcatcacctgcaactactacaaagacgaggagcagccggctgcccgtcctacctactcctagttgcatgatatgctcttcttcttctctcttatcaacaccttacttgctgcctgcctgcctgcctcatgtacatatagctacccgaaccaccgccgccgccgccgccatcttcttcgctcggaccgccgtcgccgccttctcagcccgaccaccgtcgctacactggaaaggagagggaatcggaagagaaggagaggggaaagggatgagtggcggccgtggccctcctgtgcagctccatctcgtgcgtcgccgtcatggacgcggccaccgacaccgccctccgctcccgccaggacgccctccgcctcgagtgcgactccctccgccgcgacgccgcgctcctaccacgcccgcccccgccacgcccatcgctcgctctcagccatgcctaccgcccacctcgcccatcgccggctacctagtcgccgctcccggcgacatctgagagagagagagagattgagaggaagggaaaagggaaagagagaggtgggtcccaccatgttttatttgtttttggctgacaagcgggtcccatatcttttttatttgttttgctgactagagtgccatgtatgcatccacgtaggatcaaaactgccctggatcgacataggggggtaattcatccgatttgtaaagtttagggttaaaaataactggtattagagttgaggaggtaactcgaacgaccgcgattgttcataggtaatacgtactttttttttctaatataaatccattatctaaaaaattttc

SEQ ID NO: 10709 - DNA, 1501 bp, Oryza sativa
ttttcaggttgcttgaatttctgggaagcttcctgttaggctacaacgttaacagtgtttgagccagttcgtttttagtactccgtacatttcaatccgtggtaagacctgaaaaaatttcacgtgtgtagccatgctctgatttaagcctgttcggtcgctttgtacagcagtacaggccaggtcatctgcattggttgctgggtgtccgtatacgattttacctgtgcctggtcacctggccttgctgccttgcatatgataagctgtatcccagtgaggcttgactcggagtaaactagtgccattctgaaacgggcgcagccgcggaaattacgctgttatggtggttgcagacttgcagctcatggcagagcgctacgcggttcacatcttaatcaatcgaggaagccatgttccccactgacgagcagcagccagctaccgagcatggtgcgctgttacccttggacattggatactttggggtatcattacgaaattgttactgacgcagcaacgttgtagggctagccgggcagcggcatctgtttcccgattgcagtaaatgcaagtgacgagatcgaggcaaacatgagccggaactcttatcttttcgtctatgcttatactccctccgtacttagagagtcgtttagaacaatgtttaagtcaaatcttaagaatataaatcatgaataactcttaagttgttgagtttgaaaatataaaaattatatgtatagatttgtcttgaaaaatactctcataaaagtatacatatatcacttttcaataaatacttttatagaaataagaaatcaaagttgtgttttggagactgtgtcgctgtcctaaacgacttcctttacgagtatggagggagtacttatcaaccaaaatttaaattttcaaccttaaatttaaagatgtttttaaagtttttttattgaagtttattttttcagcctttgcttttagatcgctaagaatacatatataaaagttctatttacaaattactactttctccatttcacagcatcaatatggatgtgagaaatgttagaatgacttacatcattttacaaatatagcgtttggtggggccgctggattctggaagtaaccgagaatgatcaaggaaaactcgtcaagttctggcacttgtcagagtgaaatttcggaatactatcctcctgataattcgattactagattcctgataattacccggacgggcaaaccgtgtcagggaattcggtttgtgcatccaaggcacgaaacgggtgaagtgaacagagcggcacgtcggggcgacaagggccccaccgttcagtttcagtggcacgaagcgacgcgacgcgtgttcgcatgacccgccgcattccgcggccgtgccgaaagtgtgaacggtgaacctctcccctggcccgcgggccccaccccccaatcatcttctcctggccttcagcctccagctgatgccaactgccatgtc

SEQ ID NO: 10710 - DNA, 1501 bp, Oryza sativa
taacacttgtagtatcgccttcagtttactaaggttgtgtttagttcacaccaaaattgaaagtttggttgaaattgaaaatgatgtgacggaaacgttagaagtttgtgtgtaggaaagttttgatgtgatggaaaagttgaaagtttgaagaattattttggaactaaacacggcgtaaagacgacacgaaacctcgtgatgggctgatgtctcgtcactgcagaaacgctgtaatatgcccatgtcgaccacgaaatctatatgccattgcttgttgctgggtgctactcttctcgctggaacagttgcatcccatacggaatgtgactgaactgacgagaatgactgtaccaaacttattcttacacactgggtgggtttaattcacatcaaaactggaagtttgattgaaattggaacgatgtgacggaaaagttgaaagtttatgtgtgcaaaaatgttttaatgtgatgaaaaagttggaagtttgaagaaaaagttaggaactaaaccaggccactgtcctggagaaacagacaatacagaactggtgaaaaactctattagggttcaggaacatctttcagacttgttttattggtgagaaacaaacaatagtctcctcttctccatctaaaatgcaattagctcaatcttgttgtaaaatcaaaggtgtttttgattattattctgtgatgaacaattgggcattggagattattggttttgttatttagaatttattcacgaggtggttttggagatgattggatttcacaggtgatcacaggattcgtcattttatgtgaccggtcagaccggactctggtagctggtcagaccggcgtgtattgcacggtcagatcggcgtagcccgcggtctgaccggccgtactgtgtcggtttcggtttcgggttgtttacttggatattcgtgattatttcataattatggcttctagatggatactatacgtatgtattactgttgtttgctactaatgagtcaagttggagattgcttggtctcggaatatggtttctttgtttatttgatgtgtatgtgacttgatgcctcgggagagtatttgcggtgatggaccggaagtcggcttgaggataagacgacgtccgtggtggtcagagatcatgcaggatacttaggctagaattgatgcacatggttgatggagattccatatggcatacgatgaaggtattgtgtgcgtatgggatgcggagtcgaatttagaaggagtccaaatttggtacgattggttatgtaaagtttctttcttgtactagtgggtttcctaaggtgtttaggactcctagtatgagtttggttcgtggttttaggctgcctacctcatgtataaatacagggggagcgtgaggcttcccggtatcactttacagagcaattgagttgagttttgagttagggtttcgagtttagtcgaaattttgtaaggagtgctgttggtgcactttgtaa

SEQ ID NO: 10711 - DNA, 1501 bp, Oryza sativa
cccacaagtacatccaatggtcatgtctttagatatgaaactgctttgaactttaaaaagctttttggcaagacagagggtaagatccaaccacttgagaagttcagattggtgggaaacaatgactaatttccatgacattcagaaaggattggttttactaactccctaagggtaagagacagctataagctataaaataagactgcaccacgcaatacctcgtccaatagaaccagagtctttcaatgaacataacaatttttaaggagcaacagtttgccacaggcttagaaatgaaaatggattaggatcaccatcttgcaatagacttcctcatctccagcactatttctggattaaacagcacaggaaatgaccgcaaatgccgttcctccagtaaggacccttcaggattggttcatgatgaacttggatactatataattccacaccacaaaagacacttaggttatggccgcttggttaagaaattcatctataaccttagatatgaaaggaaatattatattggaatttaggcaacattatcatcctttgctttgcacttctaagaaagttaatttcctactttggataaaggatatatatatatataccttttgataagtaggtccacctgataatgcataagaataacgatcttgttacgaacaagaaagcagtttgttaagaaagatgaaatagcagaaatcattgggtaaacatggtaacatcacctcttgaagaaaacatagatgctttccaacaagacaattaacacataattcattccattagtagaagaaatcatagcagtgggatttaaatcaataagaagtaggtctctccagctaatgaataaaatgaaaattatgaactttacgggcacaaaaatgcttaccttcagtgacatataacaccataaatggtccaaaaatatttacctgatgaaattacgagtgttgcaggcgcttcaaacaaaacagttctcaagtatcagctatatccaccaaaagtgatcaaatatgtctgatgtgtgatcatcattgtgttattttttttcctttttacaaaccagaataaccaagtagtactaaatctggacatatgatgtatcacatccaaccaaaatcccttgtatttagagatggagggagtaattattgctagtggtgatgatgtggtatggttatatgttgagctttagatttagtgggctataattttatagaaagtatagattaagattagctttactttctcactcattcactaggaggatggtatgtcttgacacagctccttcacctatatctattggtacatcatggtgaatacttgaatacatatatggcttgcaaattcccacaagggtcgtaaaaacaatcttagctgtaattgttctacaacagtaacaagtaccctttttatcttttaaattcgttatgtgacaaagctccatgattcatgattctattctgcagcactaaggcaatgg

SEQ ID NO: 10712 - DNA, 1501 bp, Oryza sativa
gaagccagtcagaatcttggaagtaaccgagaggaataccaggaattgtgttatacggttctgcaaggttcagtggagcaatcattcagaagaagaagccacttgggagcgagaagatgaattgaagtcagctcatcctcatctgttcgccagttcttctgaatctcgaggacgagattccgtttaaggggggtaggtttgtcacgccctaaaaattgcctaaattaaaaatgcatattttaaattatttttagaaattattttaaaagcctacaaactaaagtctaattttctaggaaaattttcaacataaaaatgagctacataaaattttattaaatactatacttgctcctctattttctagatttttctgggaattatttgagcaagggaagtatttttaacaattgaaacaacatttcacaaattgttttatttgaaaaagttcaaaaaaacccctccctaagccgttgggccgaattcggcccaacatcctttccctcccgcgcggcccaagccggcccagttgccgccgccgcccctctctcatgtgagacaccgacatgtggggtccacatgtcgggcctttcttcaagctccagccggccggccgaccaagccgagccgccccaccgcgtcccctttctcctctcaaatccgctccaatccgaccccgattcctccgggtttttgagggattttgatcctctcgttctcctctatctttcccctcaagaaacggagcaatccgttgagtattctctccgaatcgagttcgtttcgagtttatccctaaaaaccgagtttggatttttcccgagtcgattcctctcgtttggagtccgatctcttcaatccaaggctataaatagcatcccctcgtcgccctctttcgtttgccccctctcccgtggtctcccgtgcctcctagtcgccgcgccgccgccgtttagtacgccgccgccgccggccgtcttcggctgcgccgcgccaccgtctccgccgtcgccgccgcttgccgtcgccgccgttaggtgcgcacggaggtgaggaagcctggccgcacctcctctttcgccgccgaccgccgtagttcgccgtcgccgaccgaccgagccgccgccgtcgtccctctcgtcgccggccatcatcggtcgtcgtttgtcgttgtggtgagtaccgttgggttcgtctcgtcgtcctctacatgtacatgccctccaaaaccccggccgactgccctagctccggcgaggtcgccaatccgagccgggccggccatggatgacgtcatgctgacgtcatcatctcctctttttccaatttcttttaatagattaaaacttcggaaaatcataactaaataaccgtagatccgtttcaggtggttcaagttgctaaatttttctaaaatcaagatctacatgttaaaaatatccacatgtactgtttatgcttgtttttgtactgttttgttgattttgtttaattgctttag

SEQ ID NO: 10713 - DNA, 1501 bp, Oryza sativa
aattccaggaaaagaaaaaatttcattcacactctacacacccctacaggtatagccatctcggcaaagacaaagaggaagaattatacaggtatttcagagaaagattgggtacaagtttcaaaggacttcaagccttaactggcgtttgctaaacctcccctcccttgatctctctgagcttgaagaagatgtttcagaagaggaactaaaagccacgatttttgctcttccccctgagaaggcgccgggcccggacggtttcatcggagcccttttcaaagttgcatggaatatcatcaaggaggacctgctggcagcgatttcttcgttcttgaaccataacacctctcagctagcagaacttaactcggcttatatttgcctcattccaaagaaagacgatgcccttggcgcagaccactttcgccccattagtctcattcatagttttgctaagatcatcgccaaaatcatggcaaacaggctagctccgcggttaaatgatttggtttctcataaccaaagtgcctttgtccgcaaaagggcgatccatgacaacttcctttatgtccaaaacatggtaaagcttttccacatatcgaaaaagcaatgtcttttcttcaaaatagacatagcaaaagccttcgacacagtaaattggccatatcttttggaggttctcaagcaatatggatttggaaatcgttggctaaattggatttccaaccttttcgcctcatcttcgtcccaggtgctgctaaacggctccccaggccgacaaatcattcacactagaggactccggcagggcgacccgctaccccgatgctttttattctagctatggaaccttttcatcaaattattagagctgcggaatctgccaacgccctaaccccgcttggtataaggaatggccgcttcagatgttctctttatgcggatgacgttgctttgttcgcaattccaaccttggacgacacgacggccctttctcagattgtgaccctctttgcgaaaatctctggcctacacacaaatgtaaacaaaactgaaatcttccctatcagctgcgaaggagtcgacctccagcatgtcattgctagttggccaggacagatcaaaaacttcccatgccactatcttggtctcccacttcattttaggaaattgaggaaagtcgactttctccctttgattaataagattggctcgagattacctggctggaaagggcgttttttcacttcagcaggacgacaaactctggtctcctccgttcttagtgccatgccgactcatcatctaactgcccttcaagctccgaaatgagtttttaaaagaattgaccgtttcaggagatcctttctttggaagggagaagaccctgatcactcgaaccctggagacagtctgataaattggcaaactgtttgtagacaaaaaagtttgggtggggctggtctcttagatttggaaagattttcgagagctcttc

SEQ ID NO: 10714 - DNA, 1501 bp, Oryza sativa
gacaaatcattcacactagaggactccggcagggcgacccgctaccccgatgctttttattctagctatggaaccttttcatcaaattattagagctgcggaatctgccaacgccctaaccccgcttggtataaggaatggccgcttcagatgttctctttatgcggatgacgttgctttgttcgcaattccaaccttggacgacacgacggccctttctcagattgtgaccctctttgcgaaaatctctggcctacacacaaatgtaaacaaaactgaaatcttccctatcagctgcgaaggagtcgacctccagcatgtcattgctagttggccaggacagatcaaaaacttcccatgccactatcttggtctcccacttcattttaggaaattgaggaaagtcgactttctccctttgattaataagattggctcgagattacctggctggaaagggcgttttttcacttcagcaggacgacaaactctggtctcctccgttcttagtgccatgccgactcatcatctaactgcccttcaagctccgaaatgagtttttaaaagaattgaccgtttcaggagatcctttctttggaagggagaagaccctgatcactcgaaccctggagacagtctgataaattggcaaactgtttgtagacaaaaaagtttgggtggggctggtctcttagatttggaaagattttcgagagctcttcgcatacgttggttgtggttaaaatggaaagatgataccaaaccctgggtgggtatggatttgccctgtgatgagatagattggagactgttccaagcagccacgatcatctcggtgggcaatggcgccaaaacaagtttctggcatgacaattggctgcaaaatcaatgcctaaaagatgtgtttccaaactgttttagattagcaaaaaggaaacagagatctgtccaagtcgaattaactaacaacaaatggctgttttcgttcaggcaattcacatcaatagaagagcttcatgatctcattcagcttggaggtttactccaatcagtctcgttctcccaatttccagatgacataagctggaattggacaagttcggggtcgtatacctcaaagagtgcatatctcggtcaatttcaaggttctgttgtttacaatgatttcaactccctctggtcggctccggcggaaccaaaaatgagatttttcggttggttggtgctccatcaaaaaaccctaaccgcacagaatctactccgaagacactagccatgcaattggatttgctgcctttgcacttatgcttttgaagatacaaatcatcttttcaatgaatgcccttttatcaggcgtgtgtggcagctagtgtgcaggtttcaaactatggcgctgatggctcctctcttttcccagatatttcaacctggtgggctaatcttaatttagtgggaagcaagaggcaaagaacgacgatcagaggtatacttttgactgcat

SEQ ID NO: 10715 - DNA, 1501 bp, Oryza sativa
gcacgggcaagggaggtcgcgcgtggctcagtagcgacctggaaagagcggcgctgggtcgggaagggttcggtttgggctagacgcagatcaaacggttggtggacgatggatagagcgcccataaaaagaaaaagaaaataacgaaagggaataaaaggaaaaagagggagagggaggggctaaactgcaaaagtgaatgggagtggaattgagatgtagctctctatacgtttcggtatggggaattcaaatattttatttaaatatttgtttatttgattattcatcatttcccaaataaaactggctttacattatatcatcccaaattcatcctatatattttggatttgagaattcaaatatttaaatttgcatgtttatttatttattcatatctctacctaatgattgtagtctatattggattattccaaaattaacttaaataattgggggctttgatagtcctaaaattaattaaaatattctaatgggtccattattaatacaatagcacatcggttgaacttatttgtataacaaggtattttacatggacatgtttcatctattattccataaaatcaaattgagacttggtacaatattgatcgaaatgtttaattatacactcacataaacgtattttatatataaagcttaattcatttacatgaccaattattttatgttagtaaattttattccatgagagactcgatgaaagttctaaatattaatttaattattctagtggaacactcctatatatagagagtcattgtagtggcgactatttcatggttacttagatgtcatgacacttgtcacatggttccaatatttaatatttgacctataaattaaattagtaattaaccttctctttgtatggctttgttgtgttgtgcgtaaatatttatagggttcataatgaatatcttatttttataattattaattagttgtatagctttagcttaatattcaattgtaacaatttatagtttggcaagcaataataatcataacatccagcatgatgcaaaagttttaaaaagtttgaaattttagtgattttttattgtcagtaattttcaggatgttacacaaggcatatcaacaatattggctagaaagaattcaaagatatcagtatgaagaagatttggccaatagaattgcaaagttaatagaggagcagtttggacttaagcccaaggaacaaacttctgtgtatcggctgccatatcttgattgatttgatagagttacgttaccacaccaatacaaggttccagacttctccaaattttcaggacaaggtggtatatatacaatggaacacatcagccgattcctagcacaatgtggggaagcatcgactgaggaagctctaaaagttagattgtttccactgtctttgactagatcggccttcacatgtatttcttctttaccatcaaactctatcaaagattgggccgatctggaa

SEQ ID NO: 10716 - DNA, 1501 bp, Oryza sativa
caccctgaaaactcagtcattggcttgattgtctagatattacgtttcttttaatacttagtgctgcatcagttaagtttgatctactaagtcatgcttagaaacataatctctagcctgctttttgactataaataagggtttcatcggggtttcagccgatgagttatttggatgttgcatcggcttacaaggattgcatacaagttggatttagccgatagcaaaaaagatttcattgtttaatataatcttatggattttatgacgtcggacctccagccaatgtatgctttaaccttcggatcaatgcttattctattatatcatattgctagacgattggtttatactagattatattattgttatattatattatcatcagccgattgcctttatatcattatttactcaagtatcagaatctacattgggcatatattcgatagctcaaaactctatcgctatcggctggtatcagcatcggctggaattactccatcagcttgttagccgatcggctcattgatcttcaatttacatatcttgtcagttgcagggtcaaactgactgacatgcccgcatctcaccaacctttggtcctgcactggagctaagcaaatttcacatgccagtgtgtttttcgcgtcaacagaccctagtaaccattgttccccaccattcctgattttattattcatggtaattaataatctcttaattaactacgtagtaattagaatgaaaaaaattggaaattgggaaggatacaatgagaaaggacgtgcaaaccatggacgctattgcgtatagcatctaggcctggccacaattaagaacaacgtccacattctgaaccgcaaatcactgatcgatagtctggtttagcctgaccgcttgattgctccttatggtttagtcactttagattgattcaaaatcatgtcaactttattttttccatcagaaaatctttccaaaaaaactgttcaaataataaacttcatttgtcaaattagcacaattttcacaattgatcaacacccttatttttgcgacatctggagcaagaaaacacttcatcaaatttcacaatattttttccatgtactcaatatgacctaaggcatcttttagcttcatcttgtttagtaagcatgttgagcaattcaaaacatcatattgttcatttcactttttggcacaaatcatgtcaaacattgaactagcataaaaaacagtttgatatttttttcaataaaattttagttaaaaacaactcatccaaagtgtgtgtgcatgtcaactccaagagcgagagaagattttattctcaaatcatgtgtagcattatgtcacggccagaaattcaagaactagaatttccatgctggatgtgccttaaacccctatctaggaccaaccagggtacacaaacgacaatgttgacatacagatccacgtcttacaaatatataaaacattacaaatgcaacag

SEQ ID NO: 10717 - DNA, 1501 bp, Oryza sativa
agaaaaggattgcacatattgtagcatttcaataccaaaatacgaattctgtatatgagaagaaagagaggacagagctaaggttaacaagtgtacactcaaatgcaatcttttgagccaaagctaaatttatggcaacagaacaatcaatagaaaattgtcttgcattcatgccggcagcacaaatacatcggttttatgatgaaggaaagcaaatttcattgccaatggatcttgtttgacctactagaaagagtacattgctgacaacaacgaaatatttcagcgcccaaacaggatgaacgccaggaactgatgtatgcagaattaaggcaactatttgcttctcttgaccgcacgccttccctggcccttctttggaggacccttcccgcgacgcttaagcatttccagctttgacaaacgcctacaaaagagagatgtgatgttaattacaaaattccatgttatcattgtatacgagttaaaaagcagaaggcataaagggggaaatggcgataaaatcaaattgacaagaatagcaggaacaccttctgtactttagccgtacatttaaaaacagtaaatacaatgataatcaactaaatgtaatccacatacatactgtacagcataactcgagtggtaaagattatatcaatcatttctatcagattataacaacacaatattcaagagaatttggggtcaaagttgggcaagatgaactcaaccttcggtggttatatatatcatggatgtggaagttcaattcactacaattggtgactaatgaatccactgtaaacagaaaccaaggcttgaacttgttccctcaagacgaacaaagctacaaagccatcaaattatcaaaaccaaccaataatattcgcagtgcgccaagaacagtggtgagtgcagtgataatactactcatttcaaacccaacggatccacaacctcacctaatcataccacaatcagcaattccctaccaaaggattatgcacctagcaagtggaaatcggtaaaattccatggtactcaacacaacagacaaccggtaaatctaccatggctgcacggatgagtaacacaggacgaatcgagcaacaaaagtcgcgttggtgacgcatatcgtcaagcacctatcaggcatgatccaacagaagtcaccacctctcacgcatatcaacaaacagttggcgagcacatgacacagaaactgccccccaacagagcagaaatcctggatacttctcttatagttcgtcacctaggcatatcagcaaacacgtcctgggcgtaacccagacctcctccctccccgtgaagcaaatgaacgaacacatggtgggcacaaccaggcagcgtgcaagctagtacagctcaagtggagggatggggagcacttacgccttctcctcgcgcgccatgacgagcgggtcgtcgcgcttgatgtcgtaggggtaccactgcgcgagctgctcgccgaccatct

SEQ ID NO: 10718 - DNA, 1501 bp, Oryza sativa
gttttacaatgtaagactttctaacagtgggcaatgctagaaagtcttacattgtgaaacagagggagtattaagcaatcttcttcctaaataaatcttatatagttattgtacttagcgctcatttatcatgtggcaggttaggcaaattactcaaacatttataatcccaccttggacaaggatagcatcaaccctagttggaagtactattccatcccataaaaaagcaaatcctagctacgaacctggacacgcatatgtccaggttcatacctaggattagattttattttattttattttattggatggagagggtagattctaatggccacaatcggaattggatgcagaaaaagttcatatacgaaccaatgtcaaacaagatttacatatgtttggatagagagagaggtcctagagacaaacttaaagccaaagtatagtgctgctcaagtttctctgaatatagatcttcctgaagtcctgacttcctgctgcatatagatctttaatgctgacatgaacgtatgatcggtcatcttaatcacttcttttgtttatgagagatgcttgatgcatgctccacggcaataatctccttttattttctttgcctgatgttccatgatcagtgagctcttttctccttccattattgttggtacaatattgttcttttgtaacattcagtttttacaactttggttaatgtgtcctgccaacgcacagagacactatatccaagaatttttattttatgacttgattatatggttagataatgttatgtaagtgtagaatcatgtgacgatttaatcttggtgatgaacaattgtcaaaagtaagttgtcgacgggtggtacccgtagaccggatatagagggtattggggtacgttggtacaaggatctacgtaatacgacatcaagcagacaggagacaagagttatactggttcaggccccttgataggtaatagccctaatccagttgatgtgggattatatggtgaaaaacacaggttacaaaggaaacaatggaactcgtcggatccggcgagatcgtagtcgagttggttcgactagatctcgatggcttggctcctcgcaggctccggcttcgtaggctgtgtgggttgtgttggctctgagattcgatgtcataagcccttcccgggggggtcccttttatatcgcagatctggaggtctccaagtagaacgcggaggtatcagaccctatacgatacgtcaatgacccagtcctgtccgagtaggattcttcccatctgtagattccgtgaaaggtttccttagaatatacaggaagtatccgcatgcgcgtgggtatgccataccgatatgtaacgtatatcgaagggtaaatggtatgcctaacccgtaaccctgacataagtgtttattgaaaatacagtgaatagtatattcagatattagtgaacggttttgttggcattgtgaggccagtcagaccgg

SEQ ID NO: 10719 - DNA, 1501 bp, Oryza sativa
catttccctgtatatgcttgactttttagtcaggaaacaacatgtgttcacagtatctgctttaattcagtcaaaaaaaaatacaggtagataggtagagatatactatattcagtgtgagtagtgaaggctgaaggattaatttgggtgcacatggaggaacatggagaggtcacggggagggaggaggaagaagaagaagattgaatgcagtggatgtaatgcactgaagaaagtacgtggagaaaaatggcagcatatgtacttggttctgcacatcaccgaaattgttgtgcttgccgtggatgatctctcagctgctccggcgccgtacctactctctgatgccctatctctctctgtatcttggcacatcagcttctctcacatggctggctagtaaacaatagagatgttgagttgtgatccaaattcatttgcacttaataaaagccagcttttgccgtagcggagcgaaggctgaagctggcccattgggctgtgcgcatggggatgcccgggggtgcgggggcggagctcccgcggtatggatcatcatccattttagggttccactatatatatagctcttgtaagccgctgtgcggcgatgtaaccttacctcagatatagtgaagatattttactggctggcgcccgtggttttttctttcctgttttaggagggttttccacgttaaatcttgtgttttttatgattgatctgttttttttatcgtttgttcgtctatcgtttcctaacaagagagcatatgaactgaactgattccgtatcgatctctgcctttctctgtctctgcactgaattggagcctgacctgagtcacgttggatcctgaacctgaacatggagctttttggatgacagaaggtttattgcactcatccaaatatccaatttcatcgagccgatagaattatcccaaaacactttcgatttctgcataactaagatacacacaaccacctgaatctgaacctaaacaacatgcatgatctccaagaaacgatttgcatgtcatacagatacatcacatttctttcttcaaaacacacacacacacacaaattttgcacttcctttcttttattaacataattttatactactacattttatttttattgagaaagactacattttaatttttaatccccttttagttttagattacttttcaagtcttcatggtgattgatcactctcggacactgattttccactagacgaagttgacggccattccttttctgcatttgggcctaatcctcctgtatataggagtagtaggccattcatgggccgtttgcgtgaggcccacgaacgtgaggtgtgggcccacagcccagcgagaccccgcgaagaagagctcaagggtttagtagccgcctcggcggcggcgcgcgcggggaagaaagcccagaaccctagcccctcccgccgccgacgagcagcggcgcgcgagaagaacggccggcg

SEQ ID NO: 10720 - DNA, 1501 bp, Oryza sativa
ttctctttgttctttaccagctcgattctgtgaatgagttgggcatattgaagttcattcccttccataatatcacaagttatacatgtatctagctataactaatcaaatagtgctcacatgatgcttatcttctgtctacaatcaatcctcatatgctagattctacatgtataatttcctttacagtaccactgatattgagctagtattagtatatatcaaagttagattgcaccttcaatacagatcacaaaaagccctgaacttcagcaccaaagtttgtacaatgtagaaaagtcattcaagtatggccataatataactaaagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaactatttggctacattggaagagtagtataagcattattacttttagtcacacatatccagttaggccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggatgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacgatgtgtatgctggtgatgtggaaattgtttttgaacaagaggagttggatgattcagatgaggaagatgaacatccaaacaaaaatcttac

SEQ ID NO: 10721 - DNA, 1501 bp, Oryza sativa
acttcaccccgatttatattttttgtaggcggtcatttagctataagagtcatgtccgcctgcgaaaaaaaagtccatacgttggggaaaatgcgttttctagtagtgagtttaatccttcagtgataatatatgatttggttttacgaaattgaatatttaaaactctgactaataattgaactaaaatttaatcttggatgtagtatcattatacttccttcccttcaaattggtaatacttgttgttttggataaaactatggtcaaatttttaaaactttaactataaataacatttaaaatatttatcttagaagtacggagagcatacatatggattagtcttaaaagtagtttaataaaatcatatatttattgatatttctatatatatattatattgtaataaaaattagtagttaaagttattttttggagaccatgttattgtccaaaacaataagaattaccaactcgaaaggtgtatttatatttaaatatattttcatatgatattaactttatagttgttgataatgcattatgaaaaaaaaatcaaaggtctaaagtaattattacgaatgaaatcaatggaaaaaaaatcattactactaccacagcaactaaagtatcataaagatgctctatagaagacaaattttacctgccctatacgggctaattggcaggcgtgccaattggcacgccaattttttagtttatctcttattcggaatgatttatcatcctttctctttggggttccgtaagaacttaactaaatgtgttgaaggctctcctccaaagagccaatagtcaacctcctatcccctggtggtggctctcccgttatactctctctagggaacaactcattactcatagattgggccggcgtatctcatcatcagagaattcttcttgacttctccgcatcctcgaggcaacatggaaaggcccacaatggatagggcagggtggctactttcatgctcgttcctccaggacctcgaggccacttcgcatagggcccacactgagctagagtgcgatggcaacccgccatgtctttgctgcatccgcgtaggcatgtgatgagcaggaatgactgcacccggttgggtgttagagcaaggctaataagctggtgattagccggtacatgtcatcttgatctgatgtggaaggaaaaattactccctccgtcccagaaagagacgaatcctggggggagagctttgtcccgaaaaaaaccgatttctggacagaaaacgagaaacttcccatctatctcatcctgtgtgggccataggtggaccgcgtatcctctcgttcacaccacgcaaaccttatcgcctcccagttttttttctgtcgcgtctctctctctcgttcctcctggatcgattccatcgccccgtcgcctctctctcgcgtttctctccatcgctccctcaccccctcccggatcgattccgtcgaagcggcggcgtccaga

SEQ ID NO: 10722 - DNA, 1501 bp, Oryza sativa
gaatatggaggcaactctgcgagagaaagactatctgatgggtcaaagaccttgcaatttggggagcatccctggttagatggcataaagaatggagcatggctgcaaagttggattcccagttctctatgggaagagcttcaaacgtggctgttcatgttgatttgaccaacaaattaactggacgggtcagcataaaggctaatacatcagagcagttgaagattgccctattaggtgtctgttcaatgacaatgtatttatggaacaggatgcatccttttattgatcgtaattattaatagcactggttagtacaacaatttagaatttcttgaccattttatgcttttcttgccaattctgttgtgtttctgcttgttatttcaaacttccgttaaaattcctccagctctactgtcaactcatgttcgccttgtgttcttgtttattttgcacatgtataagtaaaaaaacaacataggagggctatgtttttttgttagagtactattgttgctgactagatttcctcctattcattactcatgtacactgtggcttttcattgtagaactgttttctacatgttctttcttttttaacaacaaagggactgtctatctgttatcctttgtattgtataattatccttggttccttccagccttccatatttaaatcattttgagaagaatttaggagctcatataatatactgtatatatattggaccattttttccagactggttggaaatagggattatgtgcataaaaatgtgatgggctaaattcaatttgtattggccaattgggctaaatggctttgagagaatgagggttacggggtcaaatgactaaaaaaggaacaaacttcagttgatggctacatttcaactaaattaacaaactctaattcccaagtgttttaaggtcaggttataaatctaattcccaagtgttttaaggtccagttataaattagtgttgtatgacaacccattagacaaaattcaaacagctatatgaatctactttcttctgctcaggttatttatatttcaaaactgaatttctcttggaaggtcatgtaaaggttctgtcctttcttggagtcctccattccaaggtaaaccatcatagtgcccaatctttttaagtcttttataattttagtagataaaagtcacttaagtgaaaatcagtgttttagctgataagttgctatatgggctagtaaaacttgtcagatgtgcaacgatcattagtctgtcggtaaagaagctgggaacttattgttggttacttaatggaaattgtgatggtgaactgtgttttacccaaatacttattagaagtagtgagtgaagctttgttatgtgaattttgctgatacatctagaaaatgatattgtgcccaagttcttatacatcattttcacccttaacttgtgattccataggtgcgttgggaagtgctcggaagcttcagagttcag

SEQ ID NO: 10723 - DNA, 1501 bp, Oryza sativa
ggtggggcttattaccaacgtcgtagacggcgatgtcggagaggaagcgcttgtcggcgaatccgccgaagacgaccaccttggacttgccgatgctcaccgccgtgtgcccgctgcagaggcacgaaaattcacatggtttcaggtggcggcagcggcggcggggatttgaggtggattggatcgagaggattacctccgaggggcggggatttggcctccgaagtcggaggagtcggccctcgcccagtgcatctgcttcggctgcagctgcggcgtcattgctctctctcagactctcaatccacgcctccacggtagctcagctcttgatcgcctcgcctcgccacggcggtgaccagcagcacggcggcggaaggaaatttggggatacctcaacctcacgcacacgcagtcaggtggagcgagagggggtgggccggtttggtcaaagagtaaagccggtttggttaagcataatccgacaaccgaataaatcgatactttggttcggtccgctcggttttgttcggtctccagcttttttggtgtttttctgcccgcccaaggccctctagctgactccccctagcatgttttagtaaaaaaaaaagaaaaaaaatcccaaaaacatcacatcgaatctttggacatatgtataaagtatatattaaatataaataaaataaaaaactaattgcacagtgtgtatgaaaatcgcgatacgaatcttttgagcctaattaatccatgattagccatatgtgttacagtaacccacatgtgctatgacggattaattaggcttaataaatccgtcgcgcggtttccaggcgagttatgaaattagttttttcattcgtgtccgaaaacccctttcgacatccgatcaaacgtccgatatgacacccaaaaaatttcttttcgcgaactaaacacacctaattcgcatccgtttagtattgctataaaacaatgtttttaattcatataggtgcaagttaaccttaccaagccttatggaaaaattattctctttctgttttaatatatgacaccattatattttaaacatatgtaatttattttattgcatagctattgtttatttgtattgtaatttcttttacattaaaggaactttaagcatagcttatacttttatatatttgaaaataaaattgatgaggtcatagccaaacatatgtctaaaaatctagggttagttggatatatgccactgtaaatttgtctatttagaaaaatgttattacaattcgactatccgtaaccgtgccgttggaattttataaaattaggatcgtgtcactgtcgtcacattttccatccatctccttttttcccatcttcttccttctttctcctatcttctttcctctcctttcctctatgcttggcacagtaaaggccatggtggacgcgacctctccaacgatctccatctcaatgcttttgatttcctctctatttggtagtgcaa

SEQ ID NO: 10724 - DNA, 1501 bp, Oryza sativa
ctcacaccggccacccgctagagtcgcgcacgctagctcccaccaaggcttcaatggacgtcgacgcgtacccaattgaccttggctagatctgccacagaggcatcggatctagctatagcagcgctagatctagccaccgatggcagtgtcctcttaaagccttcaaggccacagacggtgcccaactcaatgtggtgaagccccactgctgccttcattgcagtcgtgcagacttctggtggctcactgatcagacgacagtaaggtgtagagaaggaagaggaatgacaggggcagtgacgatgagttccacatgtgtcaccctagagatgatgcggggatgtcatgttttattaggtctagtttggaacacaacaattagttttccttagatttatagaaatagaattgactaatgtggaaatcctacatgcattgtgttagtatgatgattattgttatcatgcatattttgttttatgcttgagttattcaagattagtaagtgcgtgggggtactttagttgttttttatatatcaaatatttaattctcacataatggaagagtttcatgaaaataaaaaaacaagagggctcgagatagagcaagttttaagagaactagctgggtggcccacgcaattgcgcggctagcacaaaaaaatcatatattttttaagtatgattttacttaaaatttattaaatagctatctcattgttaagactttgaaagaccaaaccttatcatcctcgtgtttctaattatatactttataaaaatcacaccagttgctaccccttatgtcaactccttctttatttgcttgcttgatctatcactatttctattcattcttcttggaacctttaaaaattggattttatagtttttagagtttattgtcacgttgggtttcgtttttataatttctagatgtcccgtcaaacgttgccattatactcctctacggcccgtccactatctcttctctttattgtcattgagattttaaaaatcgaacataattatagtttgggttcatttttactttctagaagttcccccaaatcgtcaacggttttgccattgtactcctctacggctcgcccgctgtctcccttctttattgtcattgagattttaaaatcgaacatgattaccattgtttttttttactttttagaagttcagaacattcaaaaattggacttgtattttcattttttataatttttagaagtcacatcaaacgatgccactatgcctctctgcagcccgtctgccgcctactctttatgtcattgtgattctaaaaatcgaacataactatcgttgcaattcattttttatattctagaagtcccgtcaaccgtcggaggctctgcaactatactcttacacaccccgcccgctgcttctcctttttattgtcattgagattttaaaaatcgaaaatgattatcaatgtggttttttttttactttctaaaagt

SEQ ID NO: 10725 - DNA, 489 bp, Oryza sativa
ccccccccccccccaacacctgttgttatatggctgtactaattacaagatcagttctgaaaaaaaattagaaagaacatgatctacaaatttcaaatttagtttgtgatttctcatctttttttcaaattaaaatagaatatacttatttatgagattattcagtagtttagattgaaaggatttagcaataaagacttgttccaaactttcaatgatattattaaagagctagaattgaagttttttttaaagaactagtttacgaattgattgttattgatagtgactatttgacctctttgctattgatattggtcaatcagtcttgagaacttttacagtacattgtactggcagtatatgctgctagtatttacaagggtaaattaggaatttgataaaaaattgtaattcattattcaggctcaattaatccttatttatagaatccttatattatatttgtgacgtaatgtgtaagacagg

SEQ ID NO: 10726 - DNA, 1501 bp, Oryza sativa
ttgggaaaacgaattgcatacgcttgttaccttccgaagaaggtgcacattgtcaggttagaatgtcgatcctctacaatactgctcgtctagcagcagttgctcctgcctcctggttcttgttccacatcagtgtgtggctgtgtgcaccagtggtattgtggaaaatcccggcattcaggagttatttgataggagctattttcagttgtatgaaaattctctataattccttcaacctaataaagtaatagaaatcaaccttaatgcctcctttagaataaaatgttttcacttaaattagttgaattcatctaaatttcatccaaaaaaaaatcctccatagcaaggaaggccttaatcgcaaatctatatacccttctaatccaacctaaattttagctgaactggctaggtttacggttgtggaatcagccacccagattcaaatcctaaatttaggccgtgtttagattcaaaattttttcgtcaaacttccaacttttacatcacatcaaatgtttggacatatgcatggagtattaaatgtggacgaaaaaaaaaccaattgcacagtttgcatgtaaattacgagacgaatcttttaagcctaattacgattacgctatgatttaataatgtgatgctatagtgaacatttgctaatgacggattaactaggcttaataaatccgtctcgcaatttataggcgaaatatgtaatttgttttgttattagtctacgtttaatacttcaaatatgtgtctatatacttaaaaaaaatttagcacacgaactaaacatagccttaatatggatgctcacatttacgactatctgttttttaattgataggcaacatacctatcaacaacaagattttatcaatctcaagatatgctggcccaattgcgaaggggagtgtgtgcgtgatgcgggcggccggctgcatttctactctttctcatgccaaacgggcccacgctagaataaatgaaaaatgtcgtgggcccacccatcccacccgcagaaccacctccttcttcccttccagtgcgccaactccctttttcactcagctcagctcagcttcacactgcaccctctcccataaaaacctcgcccccatctactgcagctgctagcctgcaactgctcccacttcactcctcttctcgcgagtcgagtccaaggatcaaaattaagcagttaaaaactgagagagaaaaaaaaaacaagaaaagaaaggcgagctctccctccatcgccattgccaccctccacaaaacaccgtgcggcgctcttcacgttgccgcctcgcacgcattgctcctctccaagaagcagctcactgctctctctctctctctctctctctctctgtccctctctctctctcacgccaagagagagggtgagcagaggagaggtagctagctcggagctttctttggagaggggacacacttgcaatggcgccggcgccgactccggctgccg

SEQ ID NO: 10727 - DNA, 1501 bp, Oryza sativa
ataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaaggtgagatttacttgctcttacacccctattaacaactgcccaaactcatgtgttgatctgtctgtctgggtgctatatgctaccttactatgtgcattttctctttgttttgttacaccagatcatcatgcatatgttaaagattgttgatttccttggtttaaattgtgtgttgtgctatgcatatggtgcagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatatttactatcagctgagtgattagcttgaggtttttttttattaccccctactgctgctaattaatcaagccacttttgtatcatgtttcttagttctttcttcttgtatctgttatgtttggagctaataataatatggagattggagagaatcggatgtagtgaaactagcagatcgtactgtaggtgtacttctactattcattgggtgtcgttcatggatgcatgacttgttcttgctgttacatatgtcagctagcttatgtatatatatgatctctgtcagttgtcaaaagctggccttctcactttttttgggagacaaacattctctctatcgtgtcagctatatatgcatgcatgtgtgtggcagtgaggctagtccgtagtgaaccctttgattttggaaatgtgt

SEQ ID NO: 10728 - DNA, 1501 bp, Oryza sativa
ttaataatggttgatgagcctacatcatctgaagacaagattcatgtatcaacatgttgctttcagacagtattacaaactgggcggatgtagtaattgcatatgagcctgtttgggctattggaaccgggaaagttgctactcctgagcaagctcaggaagttcatgctgctgttcgtgattggttgaaaaccaacgtgtcacctgaggttgcttccggcattcgaattatatatggaggtcggtttcttatcacttggatgagtttcactgtgtttctcctctcttcaccccatgaaattgattattggaaggcagaatttaggaacattgatatattatgaaacactctgttatgaatgtccttaacaacagcatctaacaaaatggatttttctatttttctcttatataagcaattgaaagcctggttattccttgaaatatgttgtttgtggtaaatatctagaagcccgatctagtggtatcagtacctgctaaggcttgtgacttcagagaatatttgcaccattattaatttgatgccagctaggatgtggcaatatgcctcactgattttatgattcgttctggtacaggttctgtaaatgcagccaattgtgccgagctagcaaagaaagaagatattgacggcttccttgttggtggtgcctctttgaaggtatgataaattaacatcatatcctgaaatacagcctgttgattgccgtgttcttaaaccaatgaacccgctattgtgtaattgtgtattgtatttcattacgcaacattccgttttgcagggtccggattttgccactattatcaactcggtgacttccaagaaagttgcagcctgatgtaacccttctgtagaaataaatgacccagaggcagcgagacggctaccacaccatattgcttgatagagatacttcgtgttcaatcaccgtgcttgttttggcacacgagggaataatgcaagatgccactgtgttgttttttctcatagacctggctggcgttacgagagcctattatttgttagtgagtgagtgaccaataacacgtgaaaaattgctgctatatgtggtgttacccgacatctgtggaaggcaaggaatgttgtggtgttgagcataataatcgatgttgccgtaggatcgttgatcctccacaccttactggccctgcaagaaagcctgaacagtgttcacacaacaaaataccagttttcaatatttacacaataaaaacaacccagtaactaaactacttatggtggaaaaaccagatccagtcagctaagttttagatgattgatttctaagcgtaggcacaagacacccgtttgaattgggggcaattgcgtgtttggtgtgtatcaactgtttttttagaggtgttaactgttgaccgctcttagggcccttctttttctacagattatatatattatcacggtaaaaaaattatcggtatttcttagaaagcttttttt

SEQ ID NO: 10729 - DNA, 1104 bp, Oryza sativa
ctattttagtaaatttatacacctaaagtttatacacctcatgtttacacaattaaatttagagactaaaagtttattagtcaaaagtttatatatccgattcaaatttgaatttgaattcaaatattttttatatatagtatttctatacatctaaagtttatacacctaaagttgtttatagacccaaagtttataagtcaaaagtttacatacccgtttcaaatttgaatttgaattcaaatattttatatatatagtatttttatgcatctaaagtttatacatctaaagtttatagacccgttttaaatttgaatttgaattatatccgattcaaatttgaatttgaattcaaatattttctatatatagtatttctatacatctaaagacccaaagtttataagttaaaagtttacatacccgattcaaatttgaatttgaatttgaattcaatttttttatatatagtatttctatacataaatttttctaactttttgtttttttaaaaaaaatttgtggagatgtgtaaacttgaggtgtacaaactttaggtgtataaatttactaaaatagaaaaataatgtggtgccaaaaaagaaaatcaggtgaagggagggaatcagaaatctgatcgctcctagcgatccctagcgatcgatcgctaggtagcattctcgtacacgaaaagtcttttcagctgtcgcttcataccagggttaaatctcgcggtttcaccacgtgtcagcctctgattggccgctcctctttgcaaactcgaacgttgagccagcataacatgttgacctgcggacaggcgcacagcaccggccatcacgaggctccaagcaagcgctctcagtctcttataacttataaaccccggtgcttgattacgcgcaatcgcatcgctaccacgaaaactccacaagaatccatcaagaaacatacactcgtttcgttttttcctttttttgatccatcttgctgctagcttgctgcaaccggcaatggcgacggctcgccgtctcctccccgtcactctcctactcatctcactctcaagtacgtacttgcattggtgatcagctgtgcaat

SEQ ID NO: 10730 - DNA, 1501 bp, Oryza sativa
gtggcattttgttgctggtcaatttttgcccttgcacgtttgcacctatgttgttctgagctctttgggtaacacgggtctatatttgagacttgagaggatctttgggcctcttgccgatttggcccttgaggatatggctcgaaatcgaatattgtagggcattatgctagtccatgccctcatggaaagcatgatatacttgctcttacttgaataacataacaccaagcaaccaactatcgttgcatgattcatagggtttttttattatgtacgcccaacgagcatctcgtttggagcaactgaaatggatattgaattgcttctgaaacgaagcaccggctttcagttgaacttctgcaagcttcagttaacttgaaatccagttctgttctaggttaaaaataaaacacgcttaattgcagaacatgttgaaaggcttgaagctcatgtggctcaccgtgcattgtccttcgttttcgtccttttaagagcaatcgatggatggagaaaacgtacaaatccacgtgttacatggtgaataccggatagggatcgttcctattcagctagtactatattattggagagtttactataggcagctgaccgagggaaccttgacagcaaagctcccatttgtctgtagtgtgattcccgtggtaatttatcttgcaacctgaacctaaaatagaaaagtatcatgtgtaaaagatgctaattgagatgcccttggacttagagactcatcacatcctgattctattgtacagcctgccagtagaccacaataccacatggctattgcaagtttgtaacactttcacctttctctgctagtaggtgcttctgctgctgcatctctgcaatcaatcaatctatggcttgtaaatctgaatcaattaaaagctccaaccttttcccccgacatgccattccatgagcgcctggaaccttcatcttcaattcaccatgacatgttgacattataatacggcatccaaccatacaacgcaacaccatatatgacccacctcactcacctatcattgtcctcgtggcccctttcccctcactatcccgccataaaaaccatcactccctatgagtaaagaactccaaaaacgttcttgtccttagaaaaaaaaatcttgtttggccagccacacctaacgccagttcaaccaagaactcggctttgcctctgttcctccttccgagtcccaatcggaatagatcgatatcatctcctctcatctcatcttaattatctctcccatgtgtccctagacatatagtccatgcactaatcgatcgatatatctatatagttttcgagagatattttgctggttgcaattagtctcgagcttacagcgaccttccaggtcagaggtagccggattaaatccttggtttatttatagtgcttgatcgatcatgtcgtcttcctccaatagcgactccggcaagaagggcggcaaccctctggaagcca

SEQ ID NO: 10731 - DNA, 1357 bp, Oryza sativa
atatttttacagatatatacctcctcatatatctgtaaaaataaatgagaacctccatacttagatatgaattagttgctgatgccagatatgttctgaaataaatgctccaccaaataagtccaggaagatttgtatatttggtagtaatgttattatggccaaatcagtagtagcagtgggcggttggatgcagctgtactggttggcagtcactttccgtgttcatacctttttttttgggtttcaaaaaacatctgtgttcatgtctcaatatatcagtaccactgagattcggctaaagttgaaacatctgtgttcatatctcaatatatctcacctattttagaggatacaattgtgatatactataaaacatttccttttgcttggagtagttttttgtaccggtgcaacatatttcacacagataaagaattggttatgtttagaaagaaacaagagacagtgtatagaacgcgttcacaaagacagggtgaagcactgaaatttgactataaaactaagcccccattctgtaaaaactacacacagattgaaggaaatcagatacatgaagaaataagcttcctgcaacctggtaagttccctcttgtttttctcacaaattctaatctggtttctgttcttagaagtacatagctttgcataccgtagatttgtagagaggtaagttccttctcgcttgtcacaaattctaatatgttttctgttcttaaaagtacatagctttgaataccgtagattggagagaggtaagttccctctcgcttgtcacaaattctaatctagtttctgttcttagaagtacatagctttgaataccgtagagtagagagagaaaaaaacttgtttcttgcttttgaaatcctgaaatccaccatctaaagatctagactttgttgtaagctttttctaatcagatctacatgggacttggtggtttacaggaggtttagacgttcttgtaagcttgtgattatcagatctctgtgaaattctagcgatttattacaggtttttgcaggttcatgtatgttttgtgtggtgccatcgccaatgccattttttcaatttttttccccacacaggttttgtctgcaagattcgaacggaggaaggtggtgaaatccgccgacctgacctgcctaccatgggagacgccaacgagaacccggcccagcaaggagatgccaacgagagcccggcccgtcaaggccttccacctcgccacctcatcatcccctacgccatcgccgctgccatggcgatccggcccattcgccttgccagccaggaccggcttctcggcggtggtggcggggcggcagcccag

SEQ ID NO: 10732 - DNA, 1501 bp, Oryza sativa
agacgaacggtcaaacgttggacacggaaaccagggtttgtctttttttaggacggagggagtatgttggaagacacccactaacgttcagtcgtatacaatactactatgttggagtacgtaatcagtatttgaactcttgtagattataaatcgctcaactttaacaggttaaaagtaaccgagcaaatgttaggcatcaccactgctgtcgacggacctggtcatgcttgtgcctaggtgcaaaaggtgaaaatttagcttgcgggtgtttagatccaggagcgtaaagtttttgcttgtcatgtcgggtattatatagaatatcgtatagggtgtttgggcactaataaaaaactaattacagaatctgtcaataaaccacgaaacgaatttattaagtctaattaacccgtcattagcacatgtttactgtagcaccacattgtcaaatcatttaccaattggcttaaaaagattcgtctcataaattagtcgcaaactatgcaattagttttttttagcctatatttaatactccatgcaagtgttaaacgtttaatgtgataggatgtaaaattttagagtatgctcttattctttaatcttttatgaactgtggacattttgacatttttggttgcttacgccgacatttttctctgtgttttcccttttccgcacctgacccggtgtgagctgcacgttacgtttgctacgctgtaccccccccgggtctgtacgtacacggggcacgcgctcccgaagaaaacgccaactttgccaactctccgggccgtcaaaccggtcagacccaggagacgcgaaatcctgcgttgggcggccatgggtttttccgggcaaaaacaccggtcgatcggtctcgccgccgcgccgccgcccccgccccgcgtgcgcgtgaatgattagacgagtggcccgggaagcgagccatggtttcgcagggggaaaaaaacggtcagtttcgccgcgcggcgtgcatgattagccgcgaaccagccgactatcggccatgggtttttccgggtttcgctgtgcgcgtgcatgattagccgcgcgaaccaggcggcgggcgcgcggaggcggggaggaaacggccggcgcgggttgttctcatgcctggggtgccgacgtgcggcgtgaattcgaccgcgtttttgtacgcttcctcgcggagatttctgtgtcggatcgtgccgttttggcgacgtacactccactcgtgtcacacccctggcacagttggcacgggtcgtacaacactgccacgaacatttttcacagtgtgcgcgaaacagaaacagaggggaaaacctgcaagttaacgtgtttttatactacttggaaaattagaggatttttaggcgtcctcgaagtaaatcggacatggagtaattcggattcagatcagattgaggaccggccaaaagctaccgatccagcgttgtctgtctcgtaggactgttcaggcttcaacaga

SEQ ID NO: 10733 - DNA, 532 bp, Oryza sativa
ccgagactaaagatcaagaatctttactctcggttggtagtactaaccgggactaaaattaaacacgtagtatataatccctatccattattctctcctccacagttacaacttagacagatcgaatctcacccctctcctcagatctatcctctctaactctcctctccaactcctccccttctctccccttcctccttccttcccagccggcttccccttcccatccggcgggccggccggcggcggggccgcgcccggcggggtcgcgcctggcggagggcggcagcgccgcgcgcggcggcgggcggtggggcttcgggcggcagcggctgtggcgggtggcagggccgcggccgcggcagctggcggggccgcgcccgtcgttcgtagcgaccggcggcggcggcggcttctttgtttttttttaatttgtgatgattcattgttatgtatttgactaagaagttacaaatttgtgattcgcggttaggggagctctcttaatgacgtggtggaatgtgtggttaga

SEQ ID NO: 10734 - DNA, 1501 bp, Oryza sativa
acaaacaatcataatatgcaactctttttatttaaaatatcttacttttatagatattgttgcttatggtagaatctcgaagactatgtcaagttccaaaaatgattatatttgaggacagagggagtacatatttttttattgtcctacaataaataccatgaactttaagtgtcatgtaagaaactttgccatgaaaaaaactagataaccttatcctcatatgtgtaggatcgaaacaccagaactaagccaaccagagagggggtgaatggttggtatacccaaaaactcaaacttttagcagaaataaaagttaccttgaaattcgacggatcacggtctgaccgcttgatagccgtcggtctgaccggagttgatcgcccggttggaccgccgagatcagctgccgtcgcctgaagccgccgccggtctgaccgcaggttcgctgccggtctgaccgctgccttgccgctagtccgaccgccggtgtgtcgccggttagaccgccaaaaccgatgaaacacaaatcgaagaactctcaatgacaactttattgcttctctctgtatttacaaagtgcaacaacagcactccttacaaaaatctcgactaaactcgaaaccctaactaaactatcaactcaattgctctcaaaagcgataccgggaagcctcacgctccctctctatttatatatgaggtagacagcctaaagccacgaaccaaactcatactaaagtcctaatcccctaggaaaccttctcgtacaagaaacaaactttgcataaccaatcataccaaatttggactccttccaaattcaactccgcatcctatacgcacacaatacctccatcgtatgccatataaaatcttcatcaaccacgtgcattgaactctagactaagtatcccgcatgatatctgaccgtcatggacattgtcttattcctaagccgactcccgatctatcaccggcaatactctcttgaggcatcaagtcacctacacatgaattaaacaaaaaaaactatattccgagaccaagctatctccaacttgactcattagtagcaaacaacagtattacatacgcatagtatctatctagaagccataaatatgaaacaatcacggatatctaaataaacaacccgaaaccgaaaccgatacagtgttggccggtcagaccgcgggctggccggtctgactggcagcacctgtccggtctgaccggacccaaatcacaagcagcagttcctattcacctgcaaattccaataatctccaaaaccacttcgtaaataaatttcaaatatcaaaaccaataatatccaatactaattgttcaactttgattttacaatatgaccatggttggataatgagactaccgagggattttacaggtacgtggatagaaaatgggttagagacaaaaggacgacgataatgagaatggcacgagttgaagcgccggaagaatggcacgcttgcta

SEQ ID NO: 10735 - DNA, 1501 bp, Oryza sativa
ggggaaatcggcggcggcggcgggtttccggcgggtagaggtggaggtgggggagggggagggggaggcaccacccatgggaggaagaaggaagctttttttgctggtgcgacaagaatgaggtagatatagagagaaaaggaaaggcgagcgggtaagacgattaaaaaaataaaattaagtttggtggggtagtagaatttttttttatggttttatccttccttttttaaaaatatatttctttccctttttttatttgtaatttaccttttcctttgctttaattggtcaaagccaatgggcaacggacttgtgttcctctcgctggaaaaatctgtgaaggcatttccttatttcatttgtcttttccatcatttcttgatatatatagaagtattaggtcgcgaatcaatttgtggatttgtgctgggtttgtttttttttctttctgttctgtatatacagattttgtatcatttgacatatcttgttccctattgagacttggctacatgtgtgtgtgttttgctttatcttgtactcttcgagtttgtgtctatggactgctgttgttcacaaataccacccatcctaatcatactgatagttttaattcaacataagaatttcattataatggagaacttttagataatgacactagttcatttttcaaatatcaatcttataagtagtactctttagaaaaaaaaggtagatggattcccttatctcaattgatttgtatattatgcaccgcaataatgcaattttgctgtggtcttatctcaaacattatgtccataataaagttttatcattactacaccatcattgctctagattacactgaattgatttagccgaacatgactaatttgtgtcgcatattagcaagcgtgccattcttccggcgcttcaactcgtgccattctcattatcgtcgtccttttgtctctaacccattttctatccacgtacctgtaaaatccctcggtagtctcattatccaaccatggtcatattgtaaaatcaaagttgaacaattagtattggatattattggttttgatatttgaaatttatttacgaagtggttttggagattattggaatttgcaggtgaataggaactgctgcttgtgatttgggtccggtcagaccggacaggtgctgccagtcagaccggccagcccgcggtctgaccggccaacactgtatcggtttcggtttcgggttgtttatttagatatccgtgattgtttcatatttatggcttctagatagatactatgcgtatgtaatactgttgtttgctactaatgagtcaagttggagatagcttggtctcggaatatagttttttttgtttaattcatgtgtaggtgacttgatgcctcaagagagtattgccggtgatagatcgggagtcggcttaggaataagacaatgtccatgacggtcagatatcatgcgggatacttagtctagagttcaa

SEQ ID NO: 10736 - DNA, 545 bp, Oryza sativa
catatttttatttacttgcagtttcagtcagcagtgttggaatgtgttgggttggagatggaatacttcccaggaatttcattatatgatccaatcacagagtgtttttatctctaatccctgcttcatggagcttatgatgttggctgcttggaatagttggaaggagagaaatagcctattttttaatggaattcagcctggggttcttacctggaaaaggaacttcaagcttgatttgagtctacatttatctaggctcaaggagattcatcgccctctagttcaattatggattgaccttttgtaacactgttgttttctttcttttgatgcttgtaaataacttttctctattttaatatataccgtggaggtctcctccactgcaatttcctcaaaaaataaacatatcaaatatttttaatcagatgatactctactttttttgactgtttcccaaaaagagcttttctgtctcaaggcaattttgaacacttttgcctcttcaactggccttaagattaactatagtaagtcatgca

SEQ ID NO: 10737 - DNA, 155 bp, Oryza sativa
gtatacatgtataccaagtttgtgtacatacgtataaaacctaaaaaatatacttatacaaactttatatacacgtatgtaaactttgcatatacgtatataaagtttgcatatgcatcgtttgtatatgcgtatacaaagtttgtatttataca

SEQ ID NO: 10738 - DNA, 820 bp, Oryza sativa
ggaggttgtgtttatcggtactactagacgcgataccctgcgctttgctacgagatatctgaataaatgcatgttaattatacgtaaaaaaatggtagatatatgtttaaataatatgaaaatgatgtagagataatgatttgacattacttgcatatttttcagttttaaagttataacaaaattataaatgatatgtcatatttgcatgatatttaaaatactctagataattataattgctagtggtgatgatgtggcacacttccatgttgagttttaggagttagtggatatcaacttaatagtaagataagattaattaatcatgaacttattttgagaataactttaccatgttagaaagtagtatgagtatattttgttcgattacacgaaagacccaaatacatgtgaaccccaaataaacatgtacacctataaatgacaacccctcccctctcccccaacccgaaccaaggttgagtgattttctcaaacctagctttggctggatttgtataattcgctctcatcggttaacctaatattgattataagttgtatggtttattactaataaaaatagtttatgtttcaaacttttatatgtgttcatagcgatggaaaaaccaacattgaaaaataaactacaatgaaagccccttaaaatcaacttcaaaattagttttaaattttattagttgtagggtaaataatttaaatttatataagttcccctttcatcttatactctatgcaatttcaataggtatgcgatattagcccccaggcctaattgccatattcctgtctcagt

SEQ ID NO: 10739 - DNA, 1501 bp, Oryza sativa
atgggctggcaggccagacccggtacacaaagtatagggactaaaaatagacatataaatgtcaatgtctaaagaatagggaccttaaatagacttattttagctatttatataccacatcacaaagaagagggaggtaaaatagacttttttttagctatacaatgtcacagcctaataggagggagaaaatttagacttattctgaggaaaagcacgatggcccatcgtgccttcgggccggcccggcacggcccgaggcgtgttgggccgtgcctgggctgtgagtgcggcacgtgggctggcacggcacggcccggtgcgtcggtcgggccgtgccggcccgacaagcctcggcccaggcacggccaggcctgggccgtgccgtgccgggcggcccacatggccatctataccaatcaccacctcctgggccgagtaaacacaaggccccctgattgtccgggccgaacaacatttcgccgagcaactccgccgtggccatggaaccacatcccatgaggtcgtggatagtagaattaaatttaaaaatatacaattttttttaatatttttcgtttatatactgcataggaaatatttgcacaaatatttttttccgcacgacgggaacgcgggatcgaaacggtgccgcgcttggtattccacgggaccggcgatcgcgcaggacgggtgtgcggcaccgtctcgctcccgcagcttaggagagcggcagcgtggcggagggcggcaccaagcgggacggagccggtcgcgcggcgccatggcgcgggaccgtgcttcccgtcccgtcccgcgcgtgcgtgtgtcgcggatgcaagcatcacctgtcaagcatgcacgcacgcacgcacgcagttgatccagtcaaacctcacaatacataagcacttgcttagcttattaattattccatcctgatctcctcagctccatccatcgatcatttccaacctaattcctcgagaaagtacaagctagctggttagtcatattgttaattttggcctccgttaggtctataattaatccagacacaaccgagctgcactgtttagcgtggtggagggcagttgcgcggcactgatgcgcgggactgtgcttgtcgcgcagcgccgtggtgcgggaccgccctccagcgagtccatgtgaggcggtgccgcacgggcgtactgcgcgactgccggtcccacggaataaaagagcagcacctcctcggtcccgcatccccgttatacggaggtggtatatttgtgcaaatatttttcatgcatgtatataaacgcaaaatattgaaaaaatatatattttcaaatttaattcgtggatattacccattagactgaggtacaaactaagccttacctattagacatgtgataatacggtagtgctttgcagcagaggcctgaagaccgattcttatgatgatcgaggtgctactaccaaaaccatccgacccgtcttgagacacggacca

SEQ ID NO: 10740 - DNA, 448 bp, Oryza sativa
gggagcgacggcgacagcgcgcgcggaggggaggggctcgagacgagcggtgacacaacgacgttgcgcggcgacgcgatgcaacggcgacaagacgcgacgcgcggggctcgagagcgacgcgacggcgtggcgacacgacggcgcggcggcgcggggctacgcgcggcgggcgagcggcgcatggtgacggcgcgcggcgcgatagcggcgatgggacgggcgcgcggcggcttggggcgcgaggccgacggtgacaggcgagcggcgcagcagcgacggggcggcgggcgcgacgacaagtgatgggaaagagggaagagaagggagggggtgacgcgacggcggcgcggggctcggggcggcgcggggctcggcgcgcggtgagggcgacgggcgacgcggcgacgggacggcgtggcgcggcacggggctcggcgcgcggcga

SEQ ID NO: 10741 - DNA, 1501 bp, Oryza sativa
cgcgcggcagcaggcggcgatggcgacggcgcgcggcggctcggggcgcgaggcgcgtgctgcagggggaggggcagggcttagggaacctcgtcgagcacttacagcgcaatgaacagtgacttttttctatttttcctatttggttgtttttgctattcaaatcttgtcccaatatttctaattttcgcacaaatgaggttcccccaatgtttgagttattctaatcagagggttcacccgagattaatattattcctatttatttttatataatttgcttgaatttaattagagtaaattcttatcccattgcacctaaatttaattgttaccaatatggtcgcgataatattttatttatttccaacctcacctaatctttattttaaattatattttaatcagttattttgccaatttaattttagggtttattcctaattaattattccttattcacgatcagtaaactttgaaaccaaattccaataaaataggcaaataaaatcagcatgatgcaatttattaaaaagtttttgaaggcccatatttttagagttttgattttcgttggtcgaattttcagggtgttacatacggcaacacatgcttgcggctcaaagtagacagaagagctacgccgatgtcagaagacgggaattagagtttgaagtgggtgatcaggtacttctaaaggtatctcctaccaaaggtgttgtgagatttggaacgaaagacaaactcagccccaggtatattggtccattcttgatagtggaaagagttggaatcctagcgtatcgccttgagttaccagagtccatgaaaggtgtacatgatgtgttccatatttccatgctgagaaaatatttaagagaccctgaacatcatattaccgtagagtcggtgacaattgggcaagacttgacatttgagtctcgtcctgtaagaatattggaggaatctgagagggtgctcaggcatagaactatcaagtatgtcaaggttctctggacgcaccagaccgagcgagaagccacatgggaacttgagtcacagatgcgggagaagtatccagagttattcacgtctggtgagttatataagtcctacctatgagttcctttccatacttgtccaaggtataactggacgaattcgagggcgaattcgattgaaggagggaggaatgtaatatcccgtgttctagagtatgattgggcgaattcgagggcgaattcgattgaagaggggaagaatgtaatgccctagggaatattagcacaaacgcgcaaaagttcaatttttaaaccgttatttgaataggcgatcaggaaccgtagatgcgtagagctcgcagagtagtgcaaaatagactataagtttataagtttatagtaatcggagtccgatcgaagttccggggattaaaacaatgtgggtcgttagatcttttcagtctctttatataaccaaccaaaagaaaaaaaaaaggaaa

SEQ ID NO: 10742 - DNA, 1501 bp, Oryza sativa
tttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctaatatttctttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctaggccatgagagcgaacttggaggttcctttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattacttatttttaattccgaatttcagttatttcctaattgtatttctatatggagtctatactctacttctaatatttcctatttttaattccgaatttcaggtattttctaattgtatttctatatggactctagtctcctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcatttttctattccttaaattatatatttaattccgaatttctattttttcctaattgtatttctatatggactctatagtctacttctaatattccttatttttaattccgaatttcagttatttcctaattgtatttttatatggactctagtcccctcttctaatattccttattttttaattccgaatttcagctatttgtaaattgtatttctatatggactctgttttttctttttctccgattaatgtgagaatttctaggccatgagagcgaacgtggaggctcctttttctattcctttaa

SEQ ID NO: 10743 - DNA, 1501 bp, Oryza sativa
tttcaaaattttgatccgaaattcctgaaattttaaacaaaatttagttgaatttgaacaaatattaccaaaaaatcacgaaaaatataaaaaattaaaaaatttcggccgaaataatattgtctcgaccgaaatttccaaccctgcatccacgacggtcgtctaattaacaacctcattgctgcctgagctgccccaagagaagacaagggagggcctcaccatgccagatgtgctcacaccgaacgccgcctcgccctcctctgtgcatccattgcccagatttctggtgtgccactgatgaggattttcccccttcaccaccatcctacctcgccgcacaccatatggctttccggtagtgccgtagtggcgactcggaggacaagggaggaaggggcgcgtcggaatcgtgaaccctggttctccatcgctcgagtcgatcgcccacacgggggagggcataggagctcttaattaaatcaaatgaataaataccttgtactaatattatattttggtatatggtacaagattatattttggtatatggataggcatgtcatcgacttttaatacatgatagatataaattgcaaacctgactatatgacatctcacataatccttgtaccgtagtttggctggacactacctaggtcccataataaaatcatttttttaccccttctgtgtgtctcaaataagtttatttttttaagcaatcatgacattagagtttgtaaaagtagatgataaatgcattgtgagtaaataaagtgagaaataattgcattgtgcattgataaattagggatattcttttcttaattaatatgtgggagatgaatgaaaaataaatttattttagaacagagagagtatctatgttattttttacttgacacatatggacattcatgcacatgttggatcattatttactaatatagttataaaaatataaaatatatatatagctatatggaattgttattcggactgaatatttaaatacaattttcacacatcaaaacttaaatattttgtatgactgagaactagaacattgtgtatactctccattcttgaataattgacatgaacactataagttcttttcttttttcttttttttaaaagcaggtaaaattttcattacccggcttgacaaccaagccaacaaacaaacgtagttggacaccacatggagggagtttacttttaaggtttgaccttttcttttttggtaaatttataaatacttgaaaatatatcagattatcgattattaccatattaaatataactatgtaattaatcatattataatcattgaaatgtaattcgtcgtaaaagtgggatgaccgttatataacacattagtaattcgataatggatggagtaacatgtatactaatgacgacattaattaatggtttaaatagatttaactgaaagatctctagaacgtcatgtatttaagaactgagtgggcat

SEQ ID NO: 10744 - DNA, 1501 bp, Oryza sativa
ggaatattagaagaggggactagagtccatataaaaatacaattaggaaataactgaaattcggaattaaaaataaggaatattagaagtagactatagagtccatatagaaatacaattaggaaaaaatagaaattcggaattaaatatataatttaaggaatagaaaaatgagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataggaaatattagaagtagagtatagactccatatagaaatacaattaggaaataactgaaattcggaattaaaaataagtaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttagaataaacataataaaattaaaagtagagtttaga

SEQ ID NO: 10745 - DNA, 1501 bp, Oryza sativa
tgtattttttttaattttttctccctttcctttctttttcaccactgcgacaacccctcccctcgtgccgcctctcaccaccgagaaaaaagaaggaagaaagagaaaaaagaaggaagaagggagaaaaaaaattccatgtcattgtccacgtggcgtgccacataggcaagaccacagtcaaacacggctttggaccggaatgatacaataaaccaagtttagagacctcgatgtgcactttgcaagtttgtggacctaagtgaaacctcctgacaagtttaaggaccactagtgtattttactctttttatatagtcctactaggagttggatttgaaattaaaataggtataggatagagttagagtcggactttgtcataagttctctcttaaatagagaggggtactataatgtaatcatgacgactacaatatagtgtaggcatgtagggaggacaatagcggtgaagccatggactcgtagtggctagttgctatattgattagggaggagcatccatatcagagccctggagatgtaggctttggctgaacttcattaattaaactagctgggtggcccacgcaattgcgcggctagcatccatataaaattatatatttttttaatatgattttacttaaaatttattaaatagttatctcgttgtcttaagattttaaaagaccaaaccttatcatccttgtgtttctaattttatagtttttaaaagtcacaccagttgctaccccttacttctgtcatattattctttattagcttgcttgatctaccactatttctattcattcttctttgaacctttaaaaattggatgttaagacttatagtttttagagtttattgtcctgttggtcttcttttgtataatttctagaaatcccgtcaagcgctgtcattatactcctctacgatcgtccactgcatcttctctttattgtcattgctattttaaaaatcgaacataattattgtttaggttcatttttctactttccaaaagtttcaccaaaacgtcaacgactttgtcactgtactcctctatggctccccgttgctgctcttctttattgtcattgagatttttaaatcaaacatggttatcattagggtttatttttttactttttagaagcccgaacctttaaaaatttgaccttatagttcttagagtttattgtctcattgggttttatgtttttttatatttttttagaaatcccgtcaaatgctgccactatactcctatacgacccgtccgccgcatactctttattatcattgggattgtaaaaatcgaacataactatcattgaaattcattttttaatttctagaagacccatcaaccatcggcggctctgccattgtagtcttatatgacccacccattgcctctcatttttattgtaattgagattttaaaaattaaatatgattaccattgaggtttatttttttactttctagaagt

SEQ ID NO: 10746 - DNA, 1501 bp, Oryza sativa
cgaataggatcacgttgtattttcctgggaatttgggatttggaatttgaaggggatttgaattggattgaaatttgaatttcgaaaattgtaaatggactgtactataaatgggacattggactctaataatcctaggattatatttgtgaactttggatgatggagtagaaatctctaacggtacaaaccaaaattcaaataagtaccaaattttgaaaataaattttgtatttaaaataggttttaaatggaggcgaaaatcgggatgttacactttgtaactgcactgtaactatgatataacttatataaaacttgtattcaactatggtttggtttgttagcaccaggatcttacgcgtgacatgtgtgaaattttctttataatattatttctctttataaacaaatcttgaggcgatccgatgatcacaaatataaaaggggtaaaaaaaatactcaatctatttacttttgatagtcatatttcatcttggtataattctactagttattcctcgtaaacaagcgattcattaatatttacatttctcgatgcccatgtagccaatcttatgttgaaaaatagagagtcacgcattaaatccgagaaagtcattaagagaatagatggttggattgaaatataactatcaagtaaatttttcagatttaaaaatatgcctatcaaaaatacatgaaaagagtacttacagaaattttatagcaaatccgccagcgtaattacactctagtctatctctctgtccctcggggcttgatttcgactgttgtgacgggcatgtagtttctgtgcaccattttgacaggccaatcataaaattgatgggttgatttgtgttctactaccttcgttctaaaaagtcatgggtattcgtgtttaatgtttgatcatccgtcttatttaaataatttataaataaaaaattagtcatacataaagtattatttatattttatcatgtaataataataaataaataaaatttaaataagactaacggtcaaacgttggatataaacaatgtaaaacggtacttattttaggacggagttagcagtaagttgtagctgtacgccagaaacaaactaattttgcagtgttttcatatttcaaaacctgcaatgtgatgattgtaaggaaaattgacccattcaatagactttcatattgaaaaccgaaaaagctagagagggagagcaatccatggaaggaacacatcatcatacgcagtactcgtgttggagctccggcggctggagaaggaccatcggccggccggcgagtaacggcggcggagctcgggctgctggaggggaggtgccatccgccggcgtcggcgaggcgcccgcgcgatccgcggaaatagcatcgtcatggcttcgcgcgacatcatcatcgcaattagcgagcgacataggcggggattccaaaaaattcggatcgatcgaacgacgcaatccaatccaaacaagc

SEQ ID NO: 10747 - DNA, 1501 bp, Oryza sativa
tacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaaccatgtcggccacgacgcgcgacgacgaggcgtgcccgtcgacgaccaccaccaccaaatccacaacggacgacgagccggcggcgccggccgcgacgacgccagcggtgacaacaacaacaacagtcatccacgacgacggcgcccctgccccgccgtcgccgaagaggcgcaaggtggcggcggcggcggctccggctccggcggtggtcgacgagagggcgcggctgaagcggaggatcgcgtgggtggcggacaagatcgcgacgcaccgggacgaggtggagacgccctacggcttcccggacacctgctacggctacgccgggtacggcttcgtcgggtgggtgcgggcggacttcgccggcgaggagcgcgccgccgagagggcggcgctggaggcgtggatgcagatcgagtgggagaggcggctcctccggtggcgccgcagcgagcagcagcagccgggcgtcgacggcggcggcgactcctccttcggcgtctgggatgatgatgatcaagaggacagcgagaagaaaacggaatacaaaataatagcaggatgattcatggttttttttgtctatccatctaatcaaatttgatcgaaatcacgctaatgatccatcaatgtgcctgatgtttatacattttttgcctgctgctactgcaatctgatatgtgttcagagtcatctactcctagcaatgggaaatttaactatttgccactcttgtgacatggcaattaacgatttgccacaccgtgtctatgacatgtgggcccttatgtgtctatgacatatgggcctagtggcaaatcgttaagcaccactcgtaagagtggcaaatagttaaaagcccccctagcaattgaatgcgcatctatagatgcaaatgttatgtattcgattctttcttcagtgtcaaatttatgccttcgtgcccccaactttcgttcttgattaatgaaaacatccttggcaaatgctttcgtagttgttcgtctttcataaatccaagaatttcacctctgactatgaaatacgaatgcccccgactgtccctattaatcattactccgatcccgaataccaacacaatagaaagaaaaattgaataagacgaatggtaaaaagttaacactgtcgtaaatacggaaggagtacgtcgaactagcttatgtaatttacatttgaaaat

SEQ ID NO: 10748 - DNA, 1501 bp, Oryza sativa
cttcactagcagctttgtgttccttcagaatagctttcttcaggctatcggcgataactggaaccttaagcacaatagttgaagcagtcaatatcaccttacaacttatacttcctccgtttcacaatgtaagactttctagcattgcccacattcatttagatgttaataaatctggacatatatatgtgtttagatttattaacatctatatgtatgtgggcaatgctagaaagtcttatattgtgaaacggagggagtaccaagcaatcatgcatatgggtatccatgtgcaggcactcagaacattgtgtaccttagaccttttcatgaacagcacatcaccagtcatagcgattcgaggaggcaactacaccagaaaagcaagatcaccaccaattgtaacaaaactcataaaggaaaaaggcaataagaacaattgtatagcaattgtggtttctcgggatttatagaactaccttcccgagtgatctgagcaaggtagtaaggcggcctgggattgggctgcagaccgagagagatccccgctcgtcgattacaatgttctatcaaattggggatatcacacaagcaacacattcgttcattataacaagcactatatggattgatcgaacattgcaagtaagagaagcatcaatactatagcattacaatggtgtgcctgtcgtcttcgggaacaatcaagtaggtcgtgcccctctcgaccatgtagtgcacccttgatgtgtaaatctcccccttgctgccaaggagccccaaagatgaaaaatcaaaacaagaactatgcggattatatgatcagtacgaatcgaagtgtccagcgtgcacaccttcccttgatgtcagctttgatagtgttgaggtgcgcttcccaatttgcacacaggatattctgcgaagagaaagcgaaacttaccgaggtaacactaggaagaggaaggaggaggagggtgagttcaggttgacggcgagcggtacccggcacttgtcggcgaaagatagggaaatcaatttggccttcgccatcgccatggcctctgcctcagcgcccgcaccaactgctcgacgaaatgcttcagagaggcggagattaagctttgggtttaggctgtgaagctctctcttgtacttgtcggctcgcaaacacccatggaacttgtcgcctcgaggaggggaggggagcaccggagcaccgccgattcaaacctggcctcgccggcgccggagatggaggtggaggcgaagtgggggaacgatgcggcggcgaatggggaggaagagatttgcggctagggctttcggggttttcctctttttcaaattgatcctcgcaactatttggaattaatccgtagccatattttttcattaaagacctttatgtaattatttaatcaaaaatatagaaatatcaattttatgtaggaccttttatgaaaaataagcagaactagcagatcccagaaaaggcctcaac

SEQ ID NO: 10749 - DNA, 504 bp, Oryza sativa
aatatctagctgttgtagttgatcatcgacatgaacccatcggcagctttattaattactagatcgacgctactctgctcggctttattaagttgtttgttagtagttgatcatcgccgcactgtctctattaaatactactaaatcgatctgctcggctcggccaattaaatattcaatttttttcgcgctaagttgttagttgaccatcgccatgaaactcatcaacgtaccagatcaatctgcttggctcggccagttaattattataaatttttagtgctaagttgttacttgatcatcgtcctgaacccatcaacacagatagatctgcttggttcggtcagttaaattttaaatttagtgttacttaataagttgttagtgaaaccatcaaggtagatcgacctgctctgctcggttttgtcagttaaaacttaaaatttcaattttcagtgcaaagttattgatcaatgatctgaaacactcgatcgcttgtttgca

SEQ ID NO: 10750 - DNA, 472 bp, Oryza sativa
tgatgttcaggtagattcctggccaggcgacagtattcccggggaggattgttgcaagcacaatcgaacagacgaagttgccctccagtccgaggtgttggcatatacgtagcggtgtgggagaaacgtaaatactgccgcctaaaatataaacatttctaagattttaaacttctattataatatataagttatatttttttttctcatcccaaccaatcacaattattctgaccttaatcttaatttctgctaaaacttctagaaatatttatatttgagaatagagggtgtacatgatagctgagaaatgtagatcagacctgaagcttaaaccaactgaagaaagagcattccatatgaaaagccctccatgctccagccatgcaatagattatggatagctatgtagggaaatcttggcttaacaaagtgaacaaacaattcactgaaactgtgagtcaggcaagta

SEQ ID NO: 10751 - DNA, 417 bp, Oryza sativa
gtacatattttcgtttgcttcacagtatacagtccctgttagtcgttgtggataacgtcctaattaaccgagtcaaatataactagtcaacgactcgtagcaagcagccaatcagccagctggctcgcaatatctgcagaaactagtgcatcgacattgccatgtccgactcagcaatagttaagctcgtagtagtctccatatacgaccgtcaacatcaaccattgcatgcaaccaattaaagagtcaaaaaaaggctgcaatcacatcgctcctaacccatatccaactcatctttataagatccaaccattcctccccagtgaacccaagccccccacacacacttctaactagctaggtgtgatacacagcagtgacagtgagagtgagagtgagcttgagtgatcatagcca

SEQ ID NO: 10752 - DNA, 1501 bp, Oryza sativa
tgggacgaagacatagtcaaaggagctacgtaggcgtctcatcggccaaaaccgcccttcataccaccgagggacctcgtttgcccggttttcgtaagttgggggatggatcgtattcggttttgtagttaagggacgaaaataggactgaccgacaaatagagagactaagggccagtttgttttgtgaccaatgtttttggtaaggccaacatgtgtttggattgaagccaaattaaactaatttggctattaaaatggcctatgttatataggcatgtcaaaaacatacacaattattgttaaggttgcaaaaaaatttgacaagcctaatttaggcctgccctaagtgacgatatgcatggtcccatggccatatgctaccgtgttccggcccatgaactacagctaagggcctacataggtgatgctgtcagcctgccacaggcacagcccaacggctaaccactgtcgagcctctgcacgaacaccggactggcccggcacgcatagcacctgcgcaaacagagggaattttttttccatttttcattttttattttttaatatttacagaaatattgtaccgacgaaaatatttacagaaatagaccctaccgccctctctgagagtggcagggtgacgcgagggacggacaagttgaaaaaaaaaactagaaaatatatttttggtagggcgaaaattgcatttactcccttgcagcctttgtagagggcggcaaaggacctaagtgcaaaatgcgcacaccttgcagccctccacttggacggcaggggccattgtgtaaatattttggatggtataatatttctataaatattaaaaaaattaaaattaaaaatgaaaaaaattcctcaaacaggctcgtacaaggctccttccatctaccatctctttctatacgttccaggtggcgaaacgtaagagaaaaaggaaaaaaaaaaaagcaaaagccgtctccaagaaggcacagacgctatacataactccagcgttttccacttggcgcgggaacccgctcgagcggtcgagccggacggaccaacctcccaaaggaaaccaaaagaagatctcacgtcgtcgcacccaacccaccaaccacccgccgcacgaaacctgcgagcgaaccgagagagatcaccatccccccgcaccgttctggagacgtcccgtgcgcgcgccacaacacccgaaccctccacaagccttaagcccggccccgagccgaaaccgcctccgcctattcgcgccacccacatcacgcccctactcgaacattcgtgaacgccgcgccgctctgctcctatataagcaaatcccctccctttgcctttctcccccaccaaagtcgagagatcgaagcgaaaaaaaacagagcaaaatcgtcccagcgcgagcgaatcagaagagcaacaacacaactcgatcgttcatcagcggagagcttgatttgatttgatcggaagagaagaaagatgg

SEQ ID NO: 10753 - DNA, 310 bp, Oryza sativa
gtgcaggaggagagattttcgtttttcgtatcaacccgacggctgtgtgatggacgcgagggaggtgtgaagcccagtcgctgatgctcgtggagagattcggaggagaggagcgcgcggtgaggaggcggtggaggcggaagcggcgacgagttggcgagaagcgcagcagcgacggacgacgagcaaccggcgggcgacgagggcaggaagagggctgctcctccccctccgcctccgccgccggccgacgccgtcatgggggagtcgctgctcaccgcgctctccatggacaccaccacggcccacc

SEQ ID NO: 10754 - DNA, 1501 bp, Oryza sativa
ccgatgcagtggcgtggagttcgagtttgacagttcggtgcccaatccagggttgcagtgctggaacaaggcagagtagttgctttgtctttgtttttctttgtatgttgcaaattcgcatcacatcaaagtacgcatcagtatgatctcaggattctatggatgagagtacacatcaatatgctctctggggatgagccacatgatcttgggatcagattcatctgagcaacacaagatcttggctaattggtgtatatttttgatagcttttttttttgaagggagatttttgatagcttattaatactgaacatctggatatatgccttataagagcgaggaaacttaagtctatggcttgagctaataaagattgtaggtttttagagtaggaacaaggttagcatttctgtcattttattatacacgcgttgttctttttggacgtgagatttagttgtctgtttgtcagtcaatggactaaaataatgtaaactaggcatataacaaccatttaaatttatggatttatggtttgatgcaatttagcacatgctaggtcctcttctcaaattagtaggagtttaggacaaagtataatggtgctaccttactcatattatactggattgtcagaatcagttgggccattcattggctcctcctcccctcctctatgctcactttgtcatgctctgtagcggtggtggcgtcatatcagagatggagcaagaattgttgccgcactgaatgctccataatgcaagaaaaccagtatagagaagccagatacatccgcataaagcaaagacaaacatagcttattttgtcggcttataactatgttagttttgcagtttttggttagagctttgctttttgtgataactctgttcttttgcagagtagatgaatataagcctgtagtctgtgatctatgtgtacacataacctctttttttaaaaaattctcataatatggatccaaatttcataagctataagaattattgataatattcctgaagcttttgttctggcttgctactcatttaatagaagttgtcttccattgcctgagtgctcgactataaagaacctaaatattagttcttatcaacctgtgacattgtagtgattttgtgctagctgatgaatagtggatagtagcaatgtagtttaatttcaggaaggaaaagagtgatgcatagggaaggaaaacctttgttcaaaataaatatatatcattagatttctcaaaaccttgctgttttgtgttctgctattcattcagcattttagctaaaggcctaatttttataaccaaactatgattacgacgttgcaattttccgttagttttattgttgcatgtacattgggtaagcactcgccttacaatgtggggtgcactctcctgcagtggatttgcctcgcctgtgcttgcatgtgcttcattctatgcaggtagaacaagaagatccagcttctacacagg

SEQ ID NO: 10755 - DNA, 1501 bp, Oryza sativa
tttcaaaccctggctcccactcgagctcaccaaagaagatgcttctgcagtagtgcctcgacgcggttgaaggggatggtgacagtggagtttctatggaagcttgaggtagacaacgacaagggtacgtagggaagctgaagcaggccatgacggcgatcgagaagcaagtcggagaagaagacatcggtgccagttgtgccagactcggggccgggccctgggacgacggtgcaaatgcgcggcagcggattcttggtgtccatgaacccgttcgactcgcctcttgttccgaccctcgccggagtcggagcggtcgccggagttgaggaagacaacgccgggagctgcaacacaacacagaacacacacgaacgtggacagggaattggtgcggccaaaaaaaatcaccgcgttttctgtagctcttgctatttataggagaaaaaaaacatatggccatgccggccatgacgcgcgcaccgcacgccacgctcttcacgaactgcgccatcccacagctcgagcgtgccgcgagactcgctcacgactaccagactcccgcgtgaacgtgcacacgtcgagcctctgtacaagacgcgcccaaaactcgggctcagctgaaaacaaggaaactcaactaactatcctaactagaacacgccggggtttattcaacacctcttgctagcggagaagctcgccctgcaggtgttcggtgccgttcgtgctgcggagctccatggtcagtcctccggaagatggcggtggtggtcctctccgagatggggcacgcctacgccggcgccatgggcgggctttgggcgctcccctgcggctccactgacgacatcgagcggctagcggaaaactgcagggatgacacgtttgcgtttgctgctttcaatcagtactgatctgatcgatcgagttagccattccctgtcctgcctgccttgcccgccggatcgattgttgatgaaagattgaaggtgagagtgttagatttaattgggtaattgatccatttaaatcaattaagtcaaataaatttcaaggctcattatactaggaattcatgtgtattcattctcttatgggatatcaatgggatgaggagttttgagaattaatcaatttgattagggaattggtaacttatatcaattactcctaattgatggatggttgatggttgtatagtggaggatggttcatggctagttgatgataattagttgctctattcctcttcctattccattgataacctacagcaattactcctaattgatggttggttgatggttgtacagtggaggatggttcatggctaattgatgagaattagttactctattcctcttcttattccatgactcttactcttcatcttccattcctcatataaaatgagaatggatttgatctccctaaggagaagatagacacactttcatccatttccaaggctgttgctgctacagtaatcccatcccga

SEQ ID NO: 10756 - DNA, 1501 bp, Oryza sativa
aagagaatgaatacacatgaattcctagtataatgagccttgaaatttatttgacttaattgatttaaatggatcaattacccaattaaatctaacactctcaccttcaatctttcatcaacaatcgatccggcgggcaaggcaggcaggacagggaatggctaactcgatcgatcagatcagtactgattgaaagcagcaaacgcaaacgtgtcatccctgcagttttccgctagccgctcgatgtcgtcagtggagccgcaggggagcgcccaaagcccgcccatggcgccggcgtaggcgtgccccatctcggagaggaccaccaccgccatcttccggaggactgaccatggagctccgcagcacgaacggcaccgaacacctgcagggcgagcttctccgctagcaagaggtgttgaataaaccccggcgtgttctagttaggatagttagttgagtttccttgttttcagctgagcccgagttttgggcgcgtcttgtacagaggctcgacgtgtgcacgttcacgcgggagtctggtagtcgtgagcgagtctcgcggcacgctcgagctgtgggatggcgcagttcgtgaagagcgtggcgtgcggtgcgcgcgtcatggccggcatggccatatgttttttttctcctataaatagcaagagctacagaaaacgcggtgattttttttggccgcaccaattccctgtccacgttcgtgtgtgttctgtgttgtgttgcagctcccggcgttgtcttcctcaactccggcgaccgctccgactccggcgagggtcggaacaagaggcgagtcgaacgggttcatggacaccaagaatccgctgccgcgcatttgcaccgtcgtcccagggcccggccccgagtctggcacaactggcaccgatgtcttcttctccgacttgcttctcgatcgccgtcatggcctgcttcagcttccctacgtacccttgtcgttgtctacctcaagcttccatagaaactccactgtcaccatccccttcaaccgcgtcgaggcactactgcagaagcatcttctttggtgagctcgagtgggagccagggtttgaaatttcagttcgaaatttccgaaatttcggtaatttcgcccgtcaccggcatactcaaatctcgcccgaaatttttggctttttacaatttttttgtgaatttggttaaattttattcaaattcattcaaattaagtcaaattttcaaataatttcagccagaaatttccgaaattaccaaaatttcagaaatttcgcccccccccctctcccacctgcataaaatctaatttcgaaattgaaaaccctagtgggagcagcgcttccctcgctaacgccctccttgccatccactgcatttggctcaacaaggtggagagagatgagaggaggggaggatgaaggaagaaaatagaactgacatgttggtcccatatctagggttattttggtatatatgataacag

SEQ ID NO: 10757 - DNA, 1501 bp, Oryza sativa
ttttcatcatgatcacactagagtacttgagcattctactaacttgtgagataatatgacttaaagtccaaagaagtctttagacttgaatgtaaaaaaacatcatcttacctcaacattcttcagttcaaaatctggactatgagccaagcatgagttcccaaatgtctgacatgatccactggttccatgtaacctactccataaatcaagatataatactaactatgattgttttccgcaaatcgaggaaattgtatgccacaatagcaacttacaaatcttcatcgaggcacaacgcgaaactcccacctcctccaaatgccaaagcatcattcaagcataagtagtagtacctgttggcacctgaatatttttgttccgacaagtacaacttcaattttaacagtatattctctatgttgatacagaacatttgtactactattaaaatgaatcaagcggtacataaatttcattttatatttcttgaatattacatagaacattaacatggtagattatagatttatgcattcatttataactttcaccacaaattacatccatcagcatatcatcctggctactttcattaaaatgcattgcaattttcctgaccaatggatcaacaaaagtggcattatgcaaaatgcaaaaggtgaatattacatacaacattaacatgtaaattataaagttatgcgatcatttggaattttcaccataaaatcacaatccatcaccatatcattctggctactttcatgaaaatgcattgcaatattcctgaccaatcatcaagagaagtggaaccaaattttcttgtcacatcaaccagtttgatgtgacaactgtagaagttcaaaactataatggcagaagatgtgtaatttatgaagaatgtgccaaaacaaaaaattgttctccgacgccaaaaaggtataccaaaataaaatgcttaccggttggtctgaaaagcctaggttcaccataaatcgttgtgaatacaaatgtctgattagttccctgcttcatcaggaatataaatacaatcattacacaaactagggaaaaacctaataaaggatggtctaaaaggcagtaacctagcctgctaaggcaatactaggcactgaagggcattctcctgcctaggcaagcctaattacaaattaggccctaggcactggcttgccacctgactagtttctagtgccttggtgaactagggctcatgccctcatagcatgacttcataagcataagtagcacgaaaagctatctaatggctgacctggtattttcttttctctgtaggcctgagaggaccatttaacaagccaccaaacacagccccccgcatgtctccgacaatctaacatgagaaaggtgagaaatattgtccgttgaaacccagcttctagaaacaagttgaattgtaatgacacataacacctcaaaatggtaaataaatcatagttggacataccaataggca

SEQ ID NO: 10758 - DNA, 1501 bp, Oryza sativa
ttggatctagcagactagcatgaacgtgcaagatcaatcccctcctccctcaccgtgcattttgcagaaaaccgcccaccaccaaagaaagttttgcattttagtccctctggcaatctggcttcctcaccctctctccttaccatcttcatccgagttgggaatttgtgagcgaaaaaataactcagtgtcaaatttgagaataaaaaaattactgcaattaatgaattcgagtaaagaaattacattgagcacaaaaaaatgaaaggtaaaaagaaatgtgcacgatgggatatctattcacagccggcgaggggaggttggcggcaccgagcagatctgacgcccatgacgagtgcgagcatggccccgtcgtccccgatcggcaggagcgaggagagagggaggacgacgccggcagttgcgaggagaaagagggggaagaaaggggaccggtcgagattcacgcgcgctgctcgtcgtcgaccccggaccggctgctccctcccgttgtcgtcgcctccttcgctgtgtctgctcgcgctcctgcccgtcgttgtgctgccgcatccctccgcctctatccccgacctcgccgcatcgggacatacgccgcagccgcccctttgccgtcgccacttttcctttttttttctttttttgctgtataattttttttactctttaattcatggataaatattggttgtaatttttttactgataggatacaacatttgtaatatttttaccttcaaaatccacaaagagtgatttttttactcttggttttaagcatgagtaaaattttcactcccaactttaaacgtgagtaaatttttttactttgattatagatatgagtaaatctttggttttaagcatgagtaaaattttcactcccgactttaagcgtgattatttttttactcccgtttataggtgtgtaaatcttttactcggtgaggtgaggaaagtggaacgatataaagagaaaggaagatgagttcaaggaccaaaataaaaaaaatataacgagagataggtgttttttctttttttgcaaaatgtgcgatagggatgagattgtacacaaaggaggttgcatgattacactgaattgtgctattgcacttgatacttctccatttcccttgtggaccctgttgggccaacataaattcacctatgtctgtccaagtgtctacgtggtttccagtttccaccatccagctatggtcgccactagtcaagagaagggctaaggtagtaagtgcaaatgaaataaaatggataacgttcttatttatagggataaatttgtatgttataaatctcataaataacttagaagaagtcatctaaaaagtacaatagggaaaaagagtttttaataaatcgtattttaaaatacattgagcaagtaatccatgataataaactaatgaccctcatgtgagcgctcagggcgactgtggataccttaagatcataaaattat

SEQ ID NO: 10759 - DNA, 597 bp, Oryza sativa
atatcttatcaaggctacaggtttgctttataactgttgcaccataatactccgataatctaatggatagttcataaccttcactttgactactgtttacaagttgtctggttagaaacttgattcatatgagtgtgtttaattttcagggtgcactcctaggatttgtttttgaagtgccacttaaaccctctctctgtatgttgtgtgtttgatgcaggtgaggcaggaactcttgtaaaaactggggttaatagagtctcaagaaagaagaagtaggaattaattaatgaatcacgtaggctatctgggttgaagaaatgaaacgagctgcagagactgggcgattaatgagctactttatcagagttgttctgttcaagacatgctactttctgtaatggatttggttttcgcctatctatcctgagttaaactgtatcttcccctgatgattggccggaaatggatactcaggaattttgttcagttattatactataataaaatgtcaagctggcgaccccatcgttagagttcgtgttttacctttcgttttgtaatgaactctcttgctttccggctttcttcaaaagc

SEQ ID NO: 10760 - DNA, 1501 bp, Oryza sativa
ctccctattctaatatacaataaagtacactagagcctcttgtaattcagctcatgctttggtgtgtgtaagaatgagggaggagaggggtatttataggtggagaggtgccttgggagagtggagatgctccaagcatcttatgagcatctttgctctcctcatgacaagtggcatactcaagcatccaaagagcatatttcatctcctcttgtcatgtgtccatgacggtttcttcaggtacaacgctcacaaccgttattgggataagaataactattgcctggtaaaagatgggcctggttaggccagctgggggttcgaccgaaccctggtttgctcccctggctcacatctttcttcaggatgctgacatgtatgccctactttatcctactccatgttttggctccgaatgattgcacattttatatgttgtatctcaaaaccaagcaagtccatcaacgcaagatatatttccattctttatgcctattctctcccaacttttgtggttgatcacttgcatacaaatatacaccaacaatcgtggaaattgttagaaataaatcctgtcactatgttggatgtttcacatttatggttttatgcaggtattgatggtgttattttggtacttaatagtcgtcaacaaacccccccccccacacttagctctttactcgtcccgagtaaaggttaaggattaatgtggaataaatttttctaagatactatacaagtacacaaattattccaagccatacctgtacctgtgaacttttgcacttttgcagtgtctaacttaccatcttgggtaattgatgaatggaacagtcataactcaagtctttcttgttcctcctatgaatttcttggggttttcatatattttcgcaaagtagctttactcctcaaatgaccttctcttagatcactcatgtggtttgatttgtggatcctcaccaaggcatgtttgccgaattgtccctattctattaggctgtataggtggagctcgatagggatcaattggggcatacctgcatcacatattttgcaaagccaaaataccagacccaaggagatagcaagtcatactctttgatcaagaatgtgcatgtgtgtgatatgtgtatggttgttttgtggtgcacggattggtaaatagggagaacaagaccaaaaaaaacaaaatggaacctataagatatgttctcttagtgcatcctgattactctagaagaataaaataacacttaaatgaacgaaaagattggaagtccctatgagaatgaatatcagttagcaaattaccatatatgcgtgcaggcatagcaagaagaaccacgaacagaaccaagagtaggctacgggacctcatctgcttgcccatttggttatgctgtatgaagctatggattgtgtaccttttttgttgctccatgattataaatatatatatatatatatatatatatatatatatatatatatatga

SEQ ID NO: 10761 - DNA, 713 bp, Oryza sativa
agtgacggttgaacgatagatatgtgcagagttgaagcttaatttcgtctcaatggcacgcagtttcgctggtttctgaggaatatccaaggtagctccatgaacgtcaatgaatattgaaatggagaggatgacaccatgaaggctcaagtggctcgtaattacagtgttaatgcctcttgagaaggtttaccttttcgtttacaaagtgaaaatcgtttttcattggtttatcgaaaacctaaaaaaattgacgactttcaatcagtacggtataaaaacatgctaataacgacaaactgataaccagcgatctcataaaaattgatcagtttaaggttaaacccatcagtttcgtgaaccctgactcatggtgacttagagcctatttggggagctttaaattctgagaagcagatatttggtagccagtttctgagaatctggaaaagcactaaaacccagattctccagcttttggcttcttagtttatttttcagaatatgtaactacatattctcagaagctgtggactgtttggggcagtttctagcagaagaagctccccaaacagggccttagtcctggactccttgttcttatataagcccatgcctcgagtctcgatttgtatagtgtgatttggggaagaggaagataatcacggtcactaatcctctcattagctaactaacagtagtcataataatca

SEQ ID NO: 10762 - DNA, 1501 bp, Oryza sativa
atgtatgcaaactccagtactccccgtactggtacattacataagtattagcataaaatcgttttatctgaagtctgtttgaaacgcaggaattttatagaatttttagaaatcagataaaattcctgcatttgaaacaggccttgtgttgtatgtgtaggcagtgtagccaagttgtcagtgtgttactgtgcagaatcatgcgttcgcttgccttgtttggtactacaatgttatcattttaattcattcttaactacatatgagagtaaaaaaaaatcaaaactactatattggacatacttatttttcctaagttaacattctgggaggagcagtctagtttcatatagtaagttgatatgaacagtcctgatcgaactgattaactagtagtctagttctgatttctgaatctgcttcgtaaagctgactgtttgtgtgtgtatgaaagttttgatgtgatggaaaagttgaaagtttgaagaataactttggaactaaacacgccgtgattaactgtttctgcacattgggcctcacaaaagcccaagaaagacaggtatcgccattgcctgtcagacatgtaacccaaactgcaaattaaccatatcaaatgccatgagcccatgagaaaacttctaattaacatctttcaatgcaacaatacgtttgtaatccgtacagcaacagtgtcactacgtgatcgactcgagatcattgccacaaagtacagtactttggaaggaactaaagctcgtagcgtagcgatcatacactcgtatacagtgacccgtcgtcaaccgtgttcacactaatccagagagccgtctccttcgtctttgctccgggcaacgccatcgcaaaggtcgctgttgcatagttatggcgaggacacttcagagctatccatggaccaatgaccatggacacaaatttgctttcctgttgctgatagtggccatgctccctctccacgttgctgtccattttacgagcttggagctcatctttccgtcctaaaatataattatttttacttgtcaaattaaaatttatatggcaatgtaattttttttgggcgctgatttcattacgcggaaattcatatattttcagctgatcagatgcttgggaggtgaatctaaataattcaaaatttaaaattcgaccaccgagacaactgaaagacgatagttttccttaattttaatacttattaaataattaagaaatgtttatatttttagaacggagaaagtaatgagagtgcaacagtcagcgggctcaattttggtacggctctaggtctgaaaatgaccctggtccaatgcactgcagggagggaaagatgctagctctcggatgcatcctctgaacagagagattctgcatttgtgatttgagtttttgggcgagatatttggagggccatgaccggttgcaagaggccactattggagaggagcagagtaggaacaagtcaggctcgcaggtgggc

SEQ ID NO: 10763 - DNA, 1349 bp, Oryza sativa
tgtttttttaaaaataattctatagaaaagttgctttaaaaaatcatattaatctatttttagagtttaaaatagttaatactcaattaatcatgtgctaatggctcactttattttgcgtatcttcccaatcttctcctatttccttatcttaaacacagcagacccgaaaaaagtcaacctagacatggatgggatatattttagaccaacgaatctgaacataagcataagcatgtttaggttggattttttattggacggatggagtactataggttatcaatgttagtttagttcaaatttaattatttattggagctcacacgtcacacgaggtccattctatgagctggatattctagagttctacgttgtacaagtctgaacaacttcttcttcctaaattaatttatattttctgcggagaatgcaaacttgtaaaggtgttgtgtcatttcgagaaggagagaataagggaagataacctaatcggaattattataaggtatttttccactttgggactaatggaattcatgctccaaacgcaagtgtcttcttactccaattctagaaagaaaaccatggaagtttctattgtggcctagtggtggcatttgtgggctattagtttgttattcatatattactaaatcataggcaatctaaaatagttatagtaatgtatattttaagataatgaaatttatttcagaccttgtttccaagaaattatagttaattattacagtgtttgcaacttgaaagactatgcattgccattacatatcacaatttgatactctctccgtctcataacatagtaacctactattgaagaagacacatactaagaatatgaatctgaacatgatgttgttctaggaaataggatatgttctattcagttcaagattgttatattttaagacggaaattagataaaaaaaattaatcggaacatcaccctaaagacagagacagcgttatctatagttggcgaaaaatctacaatttgcttgtatgtaatccttgttctcatcaaacctgaaaacaaactcctcgaaatcaatgcctgattgttcccgccgattggaactttgctagcaacatcgaaccgaaatgaaagatatcatcggcgattaactgtattgcaaatcaaccgctcgcctaaaaatacctgcaaaacgtgcagaatatagtcttgcccttctgaaaaacacaattttcacatgttccctccagaattacctttgggattttcttttacaagaacactgcagcctctagagttgatttaccttgtttgctttacttcgttcttcttttttttttccctatcaagc

SEQ ID NO: 10764 - DNA, 1501 bp, Oryza sativa
ggagcggcgacggccgcgccaccgcctgccccgtctccaagcaggctcgtcgccgctccccctctaggcccggccggcgcttggatccagcgcgaacccggatgttggaagcaagcagtaattatgcatgtgccacttaattgaatgtgcaaatgtagatgaaatcgatttttttttgactgaaatgaaatcgattgtgaaaatggatgaagaagcacacaaacctgtgagctgcagctgctgacgcagcgggcaatccgggagcagacagtggatctcgacgatctcctcgagctcgtcgatgagcagcacctccttctggcatttggtcgccggccagtggcggaggaagatgtctcgagcgacggatgctgccgcagtaggagagctggcggtggtacgtgtgcacccaccgcgtccggtgcagcggcagcagcacacgcgccatgaacgcccggtgctcctccttgagtggcacggcgaagccgttgatgatgctgccgcagatctcgagcagctcgccgacgccgcagtggcgctcggcctcctccggggacgtgtcgtagacgaaccggagtagcgcggcggccatgatgcgctgcataaacgcgcgctcgacggtgagcttggagtagagctggtggtagacgtacttgaggcggtcgcgctcgcgcgagtcctcgaaggcgaagagcgccacgaggccggcgaggaagctccgatcgacgtggttgcggagcgtcctggcgtccgcggcggtgagcacgtcgtagacgaggtggaggtgcggccacgatcgacgggagcagcaccatcacggggacctcgtcgtcgagcacgtcggacggcggcgagggcgacgacgggtaggcggacggcggcactgcccggaggcaggaacaagttggcggcgaccatcttgaccagcgccaccatcacccggtggtccagcccctgcggcggctgcttcttcccgctcgccacgtcagcgccatgtgagcaaaactaccctctaaaatcgatggaggagtcaaattgcactggttttaataattctgagagtcatcctacccggttttacagttaaggatgacgaactagatttggtgaacaattaagggtgtctaagtgcactttttcctaaatcgaaatgacacaaataagcccatctacttgtaaaggcccaaggcccatgtggccgtgcacctacaaccaaccacgtcatcgatccatactcccccatttcaaaaccagaatccaccgtccattctcatccaacggtggagcacaaccctcccacggatcgcgtccctcctccccgtcgtcacaagccacgtcatcgatccgcaccgatcccccactacccaatcccacccctccatttccaatccaacgctccaaacccaacaccccacggatcgcacccctcgccttcacctcctataaatatccgcacaccccaagtgtgtctctccatctaaaccaaaaaaatccccaaatc

SEQ ID NO: 10765 - DNA, 1501 bp, Oryza sativa
cggggggaatttctgctttgtgttggcttctgtgtagcgactcttctgtttaaatgaattcgatgaatctgaactgaagatttggttcccctgtgattccgtcattttatatttctgtttcctgtgatgtgaatttgtgcgaagttcgtgaaactgcctttcggatgaaacgaattttgttttcgtggaagttcagattggttgtgcatttaatatttggggaaatttgtagtctgccaagtatgtgtaatcagcgtgtggagttgaaaaatgttggtatagagaacacaataggtcagaagacgacgcggcgtgagtcgtgacaatgcggtcgcctggagtgctggaccatggcgaacctgtacagtacagctttggtgggtacagtacagcacacgctatacggggtgcgacacggccatttctgccttcaaccgtcccaatctttttatttcgaagtaaaaaccgcttctcacggtttatcgaaatatgtctgaaccaaaaaaaaccaatgaatttcagtcaacatcatacagaaactggctcataccaattggttttcacaaatcaagtactaacggtttcacaaaaatctcataccaattggttttcacaaatcaagtactaacggtttcacaaaaatctaccatttttcacgaaattccatcggttctatgaacatgctcatcacccaccggcattctacctgcatattgttttcttttttcaaacacagcagcacgcacacttgtcattacaattgcacataggagtactactcagcatttccatagactgaatagtcgtatgttgagattactgtcaccgttattgaaaaaataaatgaagttaccttaaaaaataaacgaaacaataaaaataatttatgaatagtttttcaacctgttagcagtttagaagctaatattgagaaatgtaattgatatacacttaaaaacctcaaaatcaacttaaaattgactttcaaaacttaaatttaccgctgataacaccagaattcaaatatgggtaaaggcatctggatttgaccatctcaaattgtttatcaggattctccctaaacgaagcaggagggaacagcagtgattaatggaacagaagtcatccatccatccactgatccccaccttctctctccccgaagcaatcgaaatcggcgcggtgtgaaaccaaccacgccggtggatccacggcggggcgcgcacccccgccaccgacgattgccggcgacgcgccgaccccgggagggagggagggagggagggagggagaccccgcacctgccgcttgccgctccgctgttcccatcccgctcccacctcggcgcccgcctccccccaccaacatctcctctcccatacttctcgcttccgctccacgcctcactgcctgccgctccaccgatcgctcgctcgcttcccgcgatctcgcctccgagagcagatctggtggcggggcgtcgggccccgtcggccgatgg

SEQ ID NO: 10766 - DNA, 453 bp, Oryza sativa
tatatatatatatatatatatatatatatatacctcatatggggcaccatggtatcaaatgcaaaaaatcactcaaattttttaaaattttcaaattatgagtatatacctagttataataattcgattcatacctatacctatcaacaaaacaactcaaatttaactttatttcacaatccatgattacatacctaactaaatatatgtatggatgctatatacctagaatcaaaatctaacaaaaacaagttcaaattcagttcaaacttgctttgaactagttagtaaagtggttaatgttaatacctaagtaattgaaaaagattcatactcatttgaattgggtatatactcaatttcaacaatggtgcccgggcaccatggagcaccaaacaaatttactatatttcaccgtatattttcccaagtaacgcagctagctaggcagca

SEQ ID NO: 10767 - DNA, 1389 bp, Oryza sativa
ccatgattaggaccactgttagttatcaatcagcgagctaatgatcgtgattataattgctgtttcaagaggaaggctgattagtgttcgtgattatgatcgatgtcgagaggtaaggtaggcttatatagggacaattgatgcagctgattggctgcatgcataaccaggacaaactaattaacacttattttttctggacgagcacctccataggttgcaagcggtttagaaggggtccgcatctaaaaaatcgaccccatttttaatacagttacttaagtgacccatatgcgaaaatccctcctcttacaactctttttatattctcccttcctctctctccccattcccactcccgctcctcctctcccatctcctccctaccaacaacgggtactagcggcgggcgtaggtgatggcgcacagcggccccctccaccctcccccatgctctcccgcacgaatccggcgcaagctccagtgatggagggctcgggtgggcggcgaccattccccgcacggatccggcgacggctctcccccgcgccgatccggcgacagccgccctcccccgcaacgacaacgacctcaacgacgataacttgggcggaagcagcaggctagggtttcgagtgacaacggcgaccagatggcggcggatctagggttttggggtggggtttgattttttattgtcgtagacggccggcttaagcgttcgtacgtgaaaatttgattttcgtgaccatctcaaaaaattgtttatgtgctagtgcaagatgttgacactatatataatgtgaccgaattaagtcattaactgatgatgtcaacgcctcatcgttttggacctctcggtatatgcaagatagagacgtgtgttcgtcgaattgaatgaagaaattatacagtggaattgatgatccacttgacttgagtcgtcagcaacgtggctactttgggttggctccataggtgaagctgtcttaggtacgttcttaatagaaatttataacctctaatatactttttctttctaactaaaccttttagccacgtcgcaggccatggtgtttgacagtagtgtagcaacggttttctaccttatgcaggtagtaaatgtaataggcgataccccattcaataacgaaggtagtcatggtgacttaattactgtcgcgcccataaatttccgaatagaattccaagcagaatgtgcattaaaatccctgtccaggatcagccagggtaaacaaacaacaaagttgacatacagatccacgtcttacaaacattataaaagtcttacataaatgcagcggaaatataaaagataactggagctaagccttgacttggattgcagcgggaacaccactccacagg

SEQ ID NO: 10768 - DNA, 1501 bp, Oryza sativa
tagttttaaaaactaactcttaatgtattttagtggaattttataggatatctgtggtctttaggacaaaggactgcacccgtattagtatgatttgggatgcacccatatttttttaaatccctatggaatgtctcattctacaggaattttgggagcatcatttgtaccaaatttcgtatccaaattcctcaattataatctatcccgagtttaagattaggacttgtttggttaatattgattatagagcaaagagaagggtttccgatggagtgtttagtggaataatatatagaactgaatgttttttttaataatgaacactaataattagatactttgtagggtaaaataagaatttggtgcaacaagaaactatacatgtttctattctcccaaaattcctatagaacgagatattccataggaattttaaaatatcatatgaatacatgtctatctaaaagttggaaccaaacatgtcttgtttcttgaacgcggagatagattaaaatgaggaaaatagcttttaaaattggcacacatgatgcatccctttgctctataatccatatgaaccaatcaagtcttgcatctcgaacttgggttgtattataatcgaagaattaagatctgaaaattagcacacatgacacatcccattacaagctagcatttcaaccttaaaaaaactaaaatggtattgatttcctctgatacaccacacatagtatgctttcaaaattcttgtggtgaacatggcaattcatcaaaataccaatttttttgccagcatcaagtacataatggttggttgtcctacatggagcacaaggatggatccgaaggcatccagctcaataattctcctctgacactggctggctctactgctaatgctcacctgtcaaataaacatccaaaattcaacttctcacctgtcagatcaccaccctctctcactgaaccacctggcccacaacctgcatggccccacctgtcagtcacctaagcaatgcaaagaaggggtagaggagaaaaaaacattgcctctctagagcaaaatctatggtagtccaaagagtccacagcccacactcactctcctcaccccccccccctcggccctggactccctcctccaaatctcccctaaaagcttcccaatttggcgagaattccccatatatttgccccatctcggcgtcccaacgagcccttccagattcccagccgcctctcttcttgttaggggatccgaaatctcggtggacgagagacttgggtaaagaaagggtttctttctctctctggggggaggcatgttcttgattctaggaggggatttgttagatcgaatcaagttttgtttgtgggtggggggagttttgttgtaagatttgtgttgctgatggcgttctttgttgtggtgttgatggtggtgttcgttgttttcttttctttttctttcttgtgcagtggtaagattcgccggcca

SEQ ID NO: 10769 - DNA, 1501 bp, Oryza sativa
gatctttttaattaaccaaaagaaacctagcaatttgtgttttcgtcacatgcatggatctttatagaatatgtgttgagcacgtaacgtggcaacttttggttggctacatagtagaagtttctttagcagtactgaccacctgttcgcatagatcgcgcctcaaccatgtagctaggacattctatctcaaaaaccattgacaacgactgcaccatatcggtgtcattcttctctaaaaaaaataccggtgtcattcacactataaaggttcaattatgcacataagtatcattcagacatcactgatgttgttacatccgaatgaataatattttcttcagtttaaccgttctctagtaaaaactgtatatagctttataatttttttattaaataaacctttcagccatgtcgccaaccgtacctttgaccatggctaggcaatagtttttaattttaccatactacggtgggtgatagatatagcaacggcttcttgtcatgccattgtattagacatattggattagtattgtaaagacaaaatgagagtgttccattcaaaaggttttagatttgacaaaagcttattataaatattattggaacaggttaaatgaaaaatgttatatttttggaggtgaattttacgcggttttcggcgattaccacggtaacgccccctccccccccccctaaaaaactaaaaaggataagagcagccatggaaacatgagctgtggatatacatagaatagtaagttagaggatttattttctttggacttgcggttaccacatttaccctgatctgctggcttcatgtttggtctagtctacttcatctactaccccattcagtctaaaattaataaatatagtacaagatgtgatacattataacattattatgaatttagtatgtttaaattcgtagtacttaagaacctatctagattcgtactatcagaatttatcacattttagcgaagtttgtttatttttaatggagcgaatacgtggttagttagtgcgagtgtggtagtacgtgtgaagcggcttctggtggaaaaagtcgtctccagcacgtgatccagaaatgcaaggtggattaagcataaatgttgctgttttagagttccacttgtcatatttggtgattaatttggtatatcagttcagtcgtcgtaactcgtaatccatgactattgactaattagatttcttagcaatgcctcccaacaattgatcgacttgaagctaccgttctgatttaatttcagagtgttttgctaagataactgaagaggcatgcagtttgtttctgaagctgtaagacgaaacttggttgatgaaccacatttttttttgaaagaaaaactgtaggagagcatcctaattcctacagtggttgatgaaccattaaagtattaaacatggaacagagattgaaatcgaagtaggccagatcgccacagaataataataagaatggagt

SEQ ID NO: 10770 - DNA, 1501 bp, Oryza sativa
tagctacatggttgaggcgcgatctatgcgaacaggtggtcagtactgctaaagaaacttctactatgtagccaaccaaaagttgccacgttacgtgctcaacacatattctataaagatccatgcatgtgacgaaaacacaaattgctaggtttcttttggttaattaaaaagatcaaactgaattttaaattttgagaagatagattgatccaattttatttgtttttatcaatttatcaatggttacagtaaaatccactcatgaacggtttttattctcaccatgaacggtttttattctcaccatgaacggtttttattctcactatcagaactagcatggtggcccgcgcaatttgcgcgggctagcatcattatattttctctcatataatagcatatatgttttctcattatattatttaaatatattacaatgacaacataattttaaattttgcaataactttacgaaactactaatgtgtaatattcatattgtattttatatacgtgttagttattaattatttttaatatcaattttttgttatttataaattatatattttcctatatggactctagtctcctcttctaatagtccttattttttaattccgaattttaactatttctaaattgtatttctatatggactctagtctactcttctaatattccttattttttaattccgaatttcagctatttctaaattgtatttctgtatggactctgctttttctttttctccgattaatgtgagaatttctaggtcatgagagcaaacgtggaggctcctttttattccgaattttagttagttttaaattcatatatagactctatactctacttctaatattccttattttttaattccaaatttctttttttttcttaattataattctatatagactctatactctacttctaatattccttatttttaattctgaatttctattatttcctgattgtatttctatatggactctatactctacttctaatattccttatttttaattacaaatttcagttatttcctaattgtatttccatatggactctagtctcctcttctaatattccttattttttaattccgaatttcaactatttctaaattgtatttctatatggactctgctttctctttttctccgattaatgtgagaatttctagaccatgagaacaaatgtggaggctcatttttctattcctttaataatataatagattgtgaacccaaccctgctccatgaaggctcaagtggttcattcaatttcactgtcatttcgtgcccactaatcctcgacgagtctctctcgcgtaccaattaaacgatgaggcgtacgttgacatctctttattcagttttttttatcggttagatttattcaattactatgcgacattacagtgttagttaaaatcatcttactcctggtttattgcatgcagccaatcatctgcagatataagct

SEQ ID NO: 10771 - DNA, 1501 bp, Oryza sativa
tcttcttggactcttttttttctaatttcagattttattttatttttattctgaattttgattaatctcatattgggtttctatatggattcttttttcaatattgcttatttttaattccgaatttcagctattttgaatttttattaatctcgtattggttttctatatggactcttctttcaatattgcttatttttaattccgaattttagctatttttagattgtatttctatttggactctccttttctttttctctgattaatgtgggaatttctagcccccacagcgaacatggtgtcttctttcaaaactgttttaataatataatagaatataatagatagatagatagatagatagatagatggctgcaattatttggccatttggaaaactagggatagagcttgttttgagaaaaaaaaaacccaaataaccccactgatttggtttttttggcaatgccattgggttgaaccctgggctgttatgcagaagccggaagcaagcccaaagaaatctgcagtttaagattcggatagagggctggcatcaggaggattgaaggctgatggagatactggtcatttggagaagtggggcttcaggggttttcgtgttctcctccgcataaaagtttgttgatgtatgctggcttgatctaatctgtgttgagagtagtttctgttgaagggtcaattctgggcacaggccccgctgttagtaacttcaattcgctttttgtttttgtgttcagttttaaactgctttgtaccagacttctatagcgtgtttgctcatttctagtaagagaaatgggggacttcatgacctagatcaaaaaaaaaaaaagaaaatcagtactctgcacaattttcgtcagtactagtttgcaagcgtttttttacatcatattcagggttgttgaagtagatacggaaacgtgtgaagcgcaaacttggccggggtttctgaatacattatacctggaaaagctctaatcacccaagctggtgggtaaaatgtatctgattctgtcatatagataggtaaaacattcatcgcgatcgattgcctttctggctggaaaaatctctgtttggttcgtgatctaaaacaggagaacttgtgagcatctcaaacctccttgcagttgtatatatcttcagaacttgatgtcttcttatattagcttacctactgtaccaatcatactatcttttctagaacttgatacatgtgtaaccaatctaacctagaaaagttgttttttttaatggaagcaagataactaagacaatgatgatcaaataaagaacaaacaatgctctaatatgaaactgtgaacatccatatatctcttcttttgtacctataaataccctgtacagaaatcattagttcagtacaacaatagcatcgattaacacagtgattaagaaagaaagaaacagctaattaatcagtcactaagccaaaccatgggcaagaacg

SEQ ID NO: 10772 - DNA, 1501 bp, Oryza sativa
tcatggtgcaactagtggacttgaattggtttggttattggtttagggcttcaactagtgtggcacacggagccctcatcgccgccgcgatgtagttgcacggtttccctcgttgtcgtcgccaccgctgccaccgccactgcgtcgtcacccactactagaaaaagtatttttccaggcggcaaaaagtgattttcgcaggcggagagttggaccgcctgtaagtcaacgactgtgaaaatcatccattttcgcaatcggggtaacagctcgcttgcgaaaatacattaaaaaaacaaaaaaaaatcacatgcggcgggcaaaaaaatcacgggcggcagtcgtcgccgccgccctcctccagcatcgccgcgccgggcaagaggggaggggaggggagccgcgccgggcgttgttgtcgccgccgccccgcgccgtagttgccgccgccggcctctccactccctcctccggccagatctgggagggaggggtgaggggagccgccgccacggccccagcgcgcatgtcgtcgtcaccgcagccccgcgccgtcgtcgccgccaccgccccgcgccgtagccgccgccgccggcctcccccctccctcctccggccagatctgggagggagggggggaggggagccaccgccaccgccgctcgcgctgtggtctccgctgccgccctgcgccgccggacgccgcgcgccgccccgcgctgtagccgccgtgggatagtccggccgaggggaggagaggggaggggtgcgttttgagacttagaaaaaatttaagtctatccaaagtctatttatagtcaagtctattttcgcaggcggatctcttaagcggcgccagcgaaaggaccgcctgcaaaaatagattttcgcaggtgaccgacacattcacctcgatttatatttttgtaggtggttatttggctctaagggttatgtccgcttgcgaaaatgagacccgtacgtcgggaaaaatgctttttctagtagtaactgccaccaacgcagccacctctcgatcaggatcacgtcaagaaagatgaaatgagatatgtgtacgttaagaaatcatattagggggttttctataaaatgagataggtctttagcatcaacgcaatttactcattctagatatattctatgaatcaggataagcgcgctgtctagattcgtagtagcagtagcctgcacggtgaggatggcatgcatcgcttgttggcggcgcggcgctggcgcgtaaagttcgcgcgcttctctgaaattctgtttcgccgggctgagaaattctcccctgaatcccgagctgattctgttttgcgcgtagatagataaattcgagtttatcctgtgatgattttctcgtatcgatctctccaacccacccgcccgccgcactatctccagctcttccatggcgatggcttgtcggtggttggtggtggttagctaacacgcggcatcttctcctccgtccattcgt

SEQ ID NO: 10773 - DNA, 1501 bp, Oryza sativa
tcaatgattttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctgaatctacacatatgtgctgtgtgctacagatgtgctaaaatatatggaactaaaactaaaacgtaacatatatactcaaacataacatattagtacaaatgcaaaagatgtatgggagcatacctgtgatgaattgagcgaaccagcagggcttcgccgctccccttctgctgccctcccctctctctctttcgttttttttgtatttttagtgaatataatgaaatttcacagaggaggggctgggctttatagggggaga

SEQ ID NO: 10774 - DNA, 510 bp, Oryza sativa
agggggcatggaattttgcaggcggcccccttgccgccctgggggagggcgatttttgcctctccccctataaagcccagcccctcctctgtgaaatttcattatattcactaaaaatacaaaaaaaacgaaagagagagaggggagggcagcagaaggggagcggcgaagccctgctggttcgctcaattcatcacaggtatgctcccatacatcttttgcatttgtactaatatgttatgtttgagtatatatgttacgttttagttttagttccatatattttagcacatctgtagcacacagcacatatgtgtagattcagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 10775 - DNA, 1501 bp, Oryza sativa
aaattctcggcctgttgggcagctctttacggcgctgcgcaatagcctgtaactagttctttcactacagcaactaagcaactgttggctatcatatcaaacagtgcatgcatcatgctgccaacacaaagccattaaggcagcgctcgagagggtgggagagtgagcttgtctgtttcgttttccgcgcgcacgtttcccaaactactaaacgatgcgttttttgtaaaaattttctatagaaaagttgctttaaaaaatcatattaatccatttttaaaatttaaaatagttaatactcaattaatcatgagctaatagctcacctcgttttgcgtatcttcccaatcttctcaatctccttctcctcaaacacaccctaacttgcaaatctaaccagcattggtcgactctaatctgagttacaaatctgactataagtcattctaacattttccacattcatactgtgaaacggagggagtatgtgggagggaatatatgaccgtgaggtggtgtttggatccagggacttaactttagtctctgtatttagacactaatttagagtattaaatatagactacttacaaaactaatttaataaataaaagctaattcgcgagacaaattttttaatcctaattaatccataattagagaatgtttactgtagcatcacatagactaatcatggattaattaggctcaatagattcatctcgcgaattagtccaagattatagatgggttttattaatagtctacgtttaatatttataattagtatccaagcatccgatgtgatagggaattaaaagttttagtccgatctaaacagggcctgacttacattacaagccaagcaaggatgaccgtgaaatagcaaaaaaaaaaaaaaaaaaaaaaaaaaaaaaggtgacggtgagtaaagaacaatcggccgttgatttttcaagaaacgcacagccgttggattagatgaacaacttctaccttctacctgtacaacacatggggagaggggagaccccatgcctctcttgcctgccttttaattgctggattatggttcaattcaaggctgttggttggtactctctgccacttctataaataataaaacaaaaaaaaaacacagtttgttttttttttttttgtgaatcctatgacaatatatgccaaattatcaaatctataacaatccacaaaaagaacggcgagaaattcgcatggattgctagatcaccaagccatcgatcaagctggcagagcaatagcatagcagtcaaaaatgtaaactgcaattaggaatccacaagaacatatatttatttcagcatcatccatggacagacacactggagactggagagagatgggagatcagatcgagctcgtaggctcacgaattccaagcatataacaacaactacaatctttttcaccacgacggcccggatctcactacttacttaccgctgctaaaacgcaacgccca

SEQ ID NO: 10776 - DNA, 1501 bp, Oryza sativa
caagggctgaatcaaacagggcctaaatttcttgggacattgtgcaagttaaaaccattactttgtaagcattcttcgtcatctccagtaagcttgatgtcctcgccaactctaatttcttctccgaagaggatgacagacattcctcggagcacaaaatcaccatgttcttctttaggttagttggatccataccactacaaatatgtcaaattagaaaaatgtcactactattcacgatatcgatttggtgccactgaaattttataaaattgtaaccatgccaccgtccactttcctgtcatcctcgttagatccacattctcttcatctgtggcgtgtgctttgtcaacctcatcggcttcttcaactccggtgtcaacgctggcaagtagcagcagcaccgacacacgggggagaacaaggagagctctgcgtccgcggcctccagcggcggcgtgcggctcggcctcctccctggcacggaagaaataagcggaggtcgtcgaccatgacgacatggtcctcgtcgtcgtcgcgcctggacagcagctcctcgtcgtcgcgcgtcgccactaccatgcccccatgctccagcccatcgatgctccacgagcaaccaccaccctcaccgcctcttcccgcactgacaagcgacgagcgagcggcgggacggatgagccatggcgggacctcggtagctcggtggtggcttctctctcaccagatctaggcagagatcccaacctgtcatcatcacgctcatcgatgagctcgagcggatgcgcgtcctgctcgccgctgccctcgctgaggagctctcctcctgtcccgcccctcccccatctatcgctgtgccctccttctccagcgccgatttgtctgtcgaggatctcctcgcgctcatctcctttggctccctcttcgaccgtccacgaccaccgcgtggagtcgtcgccatccacgaccaccatctagccttcccggagctcgctggctagcctccggcgtaggcttgctgcttgcagacgaagacgacaaggagacgaaggccctgatgtcagaaaatgtgacatggacaacataaattgcgatggagtagcatggttctaattttagaagattggtgtggcatttacctgatatcacgaatagtagtgatatttttctaatttgatatatttgtagtggcatggtgaccatggatttcaaatgcaaatatcacaaatgtagatgccttttatggaagatttccccccttctcctcttcgctttcgctgtcacagatagaactaaaacacctaattcccccaaacaattccaattccaattccagctcaatgctgcacggaatctcctcttcccatcccccaaaactctcccaaaaccgcgtataaaaagcgagctcccctatcaccttctccatcgcatcatccctcccccaaattccccaactccgggcctccggcaagccaagaaacccccaacccaactccggcga

SEQ ID NO: 10777 - DNA, 670 bp, Oryza sativa
cggacccaaaactcctcctctattatttcggaaaggaaaaggtacgtgccggtgacatgggaccggggatatcttgactagaggtttggggcagccgcggtcacccacgtggcctgaccccctcgggggggtcgggcccgagggtgatgaggccgccccaccctctatctccccgaggggtcgggccgctcccgtttgaccccccgagggctggggcgccccgaccccctgagggtttggcgccacgtgtgtgggttaggtgagcacagcggcgctcacctaaccgcgtttattgtgggttggacgagcgcctcacgccgcatttaatgcagcatagcgcatgcttatccggtccgtgatcggtcgcagtgtgtgaccggtcacagaccggtcagatcgcgggttaggtggcaacaggcggcctgacacacgcctcgccccgtcccgtcggaatgatgagagcctccagacactcgtccctagccggagccggcgtgggaactcctggagttggcacgtcagccccggccagatacattccaggcttcatcgcaaccattgcaaggaggtcattgtatgaagaagggcatacgtgtagcatgctaaactgacgcgtggtggacaagaatgaccggtctgtgactggtctgacgccggtcgcgtcatcagc

SEQ ID NO: 10778 - DNA, 1501 bp, Oryza sativa
cagagaaaggagaaaaaaagaaaaaaagagagagaaaaatgagaaggaaagaagaaaaaaggaaaatgaattttaagtcggtcccatttgtcagtcaagatgatgccatgtcacgtccgtgtttgtggcataccacgtcaacaccacataggatcttagaggggctatgacaaattgggacctaagcaacacactttgacaaattctgagatttggatctgcatttttagagtttagggacttagataaaacacccctacaagtttaagaaccgcatgtgcactttactcttttacattttacatttataaagtgtggtaaatgatcaaactatgatgactctccgatgtctcaaatcaaagttgtagctatatatatacaaaacacattgtggcttgaggcacttttctgttgcattggaagacaaatagcaatcaaagcagaatactggaaaataggaattagatcttcctagtctatagtaaaaccttcacatttgaaacctactacagactcatacttgagacaagttgacggttcagacgttcagctatcttgaaaataaacaatctgaagtgagctttatgaaagctacactcatatgttacctgggaatttatctaacagttgtaaatattgcaccacacatattagtccaacaaataggggaaattcatatatttgtcaattaaatattgacggaaagaatcagatgtttttcgctgtgccatacagcatatctcggaaagctaaggagacagaaatataccttacctttcaaaaaaccatcatcctcattcttcagaagatatgttagcattggagttattagtatccatggagccctccacataaagcctagacttgtatgcatttttatgtggaggtcatcaatccatgtctgatcagcaaaagaaattattagtcagacctaaaacaccgaaaacaatggtgatctggcggcgacattgaaacttcagttaagtctgaagacctgaaacagcgaaacaattcatagttgaactcccgattgatttgttaaactatcctaaactcaattgggtaaattattaaattggattgaatacaagattggttgcagggcattgagtcgaagtactgaaacatttgtaaaatcaaaattttaatctgaaaacctaaacatatgcatacacttccctgtgctgtcgcagtagtagttgcacgcccattagtaattggattgatcctgtccaaaccggttctccttctccatcatctaggctcgcttgttctgtggcaacgggaggaattccactcattagaaccctaaacccatgaaatacagagctaaaaactgaaacagcacttccatctatcagaacactaaatccacgaaggagagctaaaaactgaaaaagcagttaggattgatgtgtttcacctttacttttctgcacatgcaggatgataccccataaaaagaaccaaacactgatccatcgtgcctgcccattgcaga

SEQ ID NO: 10779 - DNA, 1501 bp, Oryza sativa
ggtaaatgagagaccgataagtcagggaaattaattgtgaggaaataaaaaaaaaagaccaacctagctaattgatgaaactgaaaaagaatatatataatcgatttaaaaagatgctccctgttgatgaaaatgacatggtcgtttaatactccaatatggacttggagaggggcgtacatgaagggacgacgacccactgggtgggaaaaagacggacataattgccgataatttaggagccttcctctaacgtatttccgtgtactagttttctctttagacaagcaagcaatggaagaaaaagaaacaaacaaagaaaagaaagaaagtgacatttaattagaaagggaatatatatttgaggcttgccaacgacccggagatgtcacctttttaattaagataatagaaaattttattgaactcagccaatcacattaagatggttaaaaaacactgaatatatttccgacatctgtataattagaatacacagtcaaaaaaacacacctaaaagtttataagatgaataagacgaatggtcaaacatgtttaaaaaagtcaaggacgtcaaatatttagggaaggagggagtatgttattttcgtcccataaaaatagaaatagatacattagtcctagcagatgttgggatgaggttgacaaaagccaccaagaatgaactggagatgaaaaggagagagatggtggtctttctcatagtctagatgatccatgtttaaatcgtttatgatatgttctcttagtttcaatggtttttttaaaacatgtctacacagcctcaatagtctatagtagtcaagggaattattcaatatataatcctgtgaaaacaaattgtacattattttctttgtgcacatatacatatgaacggtgttaagcactacctataagtacttaacgcagttagatcattgtctttacttaaaatatcacatatctatatatgcttatctctactaccataaaagggagttgtcctccggtttccacctatcccacgttccaaaaataataataaaaaaaactgttccgtctgcacccttttcaagtcccagaaaaccgaaagaaaaaattggaaaagaaaaaaaaaagtcccataacccgttacaatgcgcctccacatcataacttaaagaaagaaaaaacaaagaaaaaaatattttctccatatcccgttgtaacaatgcacaggcatgtgactagctagtcatcctaaatatcccaccggcatcacatcctccaccatatacaaaatccttttctccgtgcagtcaaaatccatttttccgtgcggaggtagcacccgtctacacccaggggtctgaaaaaaatcaatattttcacgtgcggcggcctaaccacatatgttaagtggactgcacgagataatcgactatcccatctagtcaacttataccgcccgcatgcacaaaaaaataaaataaaataaaaacctaaccctaaccctaga

SEQ ID NO: 10780 - DNA, 1501 bp, Oryza sativa
ttttgaagtgggtgagagggagaggtattttcgcgtgcggtctacttaatatgcccgcacgcaaaaattgatttttccgtacgtttctcttaaggagccgcacgggataatggggatcatccatgcggtcggattaagacgcccgcacgggataatgcattttcccgtgtgggcagcagcccggtgccggtcgaccggtttttccagacaacaccacttacggttcgtctggaatctaccggggccagcgtccaggaaaatattttgtgtaccagtgtacctccctctcaataccacgtatttcttcttctacgaagctatatatttggccacaaaattagaagggaaaagaactagaaaatagaaatgatgtccaataggtatgccaatttttttttgatcaaacccaatcaccttcacaacaaatatacgacactgacccggtgacttgaccgtttaaaaaagccattgtcacacctactttctttctctttctgcatcttacaaatgctcttgcctcttgtaaggatgtaaattaaacgcggttataaacacatgggtaacacgaggtatacatataaacttgtacgctatctagttttttttttcgcccctcccagtgacacactatatatacgaaggaaaggcccgtcgttgtctagctactagttgagttgtgcagccaagtcagctgcacatggggaacaagcgtgcaacagccagtacacgctactacgtactacatgttatcaactctaaccctccgtttataaaatatatgacaatacagacttttaaacactgttttattcagaaatttagtgaaagtatgaaaaatataagccatatttggagtaactttaatgataaaataagtcgcaccaaaattaattatacttacatatttctttcgtcccaaaatatagcaatttatgttggattagatatatcttgtgttaatatagacagtcctaatttaaagacggattcagcgtgggtgctactccgttgaataaccattgagaaaaaggggacagggaaggaggaagaagagggagagaataaagagaagtggggtcttgaggaggaagtcggagataagccttcccctctagtagaattgtggatctgctgatcttggcccaatctaaataggtggctgcttaaatttgtattgctagatgatatattcagtattaagtttatattccctccgtcctagaatattagcatttctaacaataaatttgggcatatatatgtttagatttatagctgaaagttgttatgttttacgatggaggtagtatattttagtatagaggcggtagttttcaaagagacgaaaggtaaaacttcatttataaaggtgaacggtcgtattaaacacagagatagtatagtggcactgtctaattaagtaaaccaccacccactctcgtcgtacgtacgtgtcctcggctatatatacctcctccgtctttctcgcctttcgccacca

SEQ ID NO: 10781 - DNA, 1501 bp, Oryza sativa
agaatgaaacagcaggggagcaagtgctctatccggcaaaggctcctgcacatgtgaggcgggtgttgtgcaggtgagcaagcaaatgcggtgcattagtttgaggcgatgtttagacgactaggttgccatcatggaataccatagccggggcactttgacagctcagagttctctgatacagctagatcatcacatatggaaagatttaacgggtgtctagaacagagaatgaagcaaaaaattgagggcaaattctgctccatgggacaaggtcccttaccaacctggttctatctccagttcctgtcagagatgagttagcccacctgcactatatccatgcctccattgcaggtcaatcaatcatcgatagaccaagatgcatctagatgtttttgctatgtagtatttcacagggcacattggtctaaagaacaaaaatctctattactctaaggccttgtttggttagtcccacccacaaggggattgagggggatttggaggggaataattccatacatattgagatgtggaattaatctccctcaatcccctccaacccctccctcacggggaataactgaacaaggtctaaatgagttttcggccgttggctctccaaactccaccgcgctatgtgcgtaacctcctgttatcccctacaaaactgaaaaagccaacttccccaaaagaccagctacccagaaaaactggttcagatctgcttggttcggtgccaccctcaccagagatcccacatgttgctgctgtccctcgtatattgttatgttctgtagcactgcacatgtatttggctagtaatacaggaatatggcagatggtgactaccatataatggtaaaaaatatgaacagagcaaccttttcatggtattaaagtgtaccaaaatatttcaatggtaaatagcggaggtcccgactcctgagtcccacttctaatggtgtatttgtttggtcatgttttgaaatgcacttcattagaggaaataatttattggattttagatgttgatacattcaatacaagtgatgaaacttcagtcatgaaaaccattacgtttttatattttaaatgagttgaaaccacatgctggcatgctgcattcattacaatgccacctgccaattagaggtaacttcgaggattatgctataattttttgttttgattcgttgttgctaagttattaaattgttctaaaactcacatgactggagtgctgataatgtgcatggttctggcattttgtgactgagtttcagcattttttgttcatgccatccatttgtttgtcatgtgcaactatgcagtatccaggatcacgactatccttattgagtttttgatcttgcatatgtttggtctggcataaattgtatcaatgttcaacattatttatagattttatttgtttgttagcaggatgttcagtgagccatgttttccgggaactaacatcattctctgtgtgcta

SEQ ID NO: 10782 - DNA, 1501 bp, Oryza sativa
tgcaacgatattaggacatgtcaaacatcaggctgtttttacagggaacatatcttggcatgaaaagcaaaagggggaaaatggggagacctaaaaagaagctgctaactgtgcaaaaggagagtgcataggacgtacctgtttctgactttccgctcctctgaaatttatgcatctcagattttacttaatttcaaccaaaacatgcttattgcttgtcactgatgaatggcaggctgccatcaactacgtcttccagaattctgcctatctttcatgtgacgttaatgttcttgcaaaactttggtgttagcccctgttctacatgtaagattcgccatgtttcctctcaaaaagaacaaaaaatatatcgcaaatgttggtcaacttgtagctgtatccctaccaattcttagcttccattgtacaagcttaagcaggcagatcaaactaagttttcaagcatgccatctcagcctgaacaatgaactcagaatttccacaatttgcaaccaaaatggcaacctcactacacagctacaatcttgtgcttatgaaaactttagcagacaccagctttccaacaatccaacgtgcacacagcttttctaccacatctctagtggttttctccacacatgaacagatgtctagtgttgtgtcagctataatctaatgccagccaggtcacagggatatcttccaaatccattacctctcactcattggtataaccgaagacatgacaatggaagaaaaatctacattacgactgaagtactgaactatcattgcaaacagaggatgagaatgcacaattttgttctatccaacaggagcccagcaaagtgattgcgtcaaaagggcatctaaattaagcactaaccgtttaaccgtccttgaacaaggatacgttacaagtgggattaatgccgatctttactagaatataccaccaggtagctacatcgctgatgcgcgggcttgacatgaaaatacccatcgaattggagtgcatttctgagggagagctcgtcagatccacaatgacattgccgtagtggggaggccagtaggcatcttcacatcagaacctagcacacagagaatgatgttagttcccggaaaacatggctcactgaacatcctgctaacaaacaaataaaatctataaataatgttgaacattgatacaatttatgccagaccaaacatatgcaagatcaaaaactcaataaggatagtcgtgatcctggatactgcatagttgcacatgacaaacaaatggatggcatgaacaaaaaatgctgaaactcagtcacaaaatgccagaaccatgcacattatcagcactccagtcatgtgagttttagaacaatttaataacttagcaacaacgaatcaaaacaaaaaattatagcataatcctcgaagttacctctaattggcaggtggcattgtaatgaatgcagcatgccagcatgtggtttcaactcattta

SEQ ID NO: 10783 - DNA, 385 bp, Oryza sativa
tgatgtgcataatatgggggtgtttgggagagacacacaaaaccataaatccctagaagagggacttatatttttatatttttgagagaacacctcctatgtatacgagaaaacttatgtgcataatataggttcctctgcagaagctacaactaaatgcagaggattcggctcccacactatcaaagtactggaagttttaatagatgagatctcgtgggctcagtccaagtccagtgcaggggaccaaagaaaggcactactccgtcgtgaaggctaaaaagggagggggatcgaggcgagaggaacgccaccgaacccaaaccccatccaatcaaaaattcgtacgggagagctctcgatttgatcgccgcgaccgcgagga

SEQ ID NO: 10784 - DNA, 1226 bp, Oryza sativa
gagtgtgacaagccacccatgtcacggttttctttgtatttcggtggaatatggtatttatgtgttcggagcaatgtttctctcgtaatcttcgtcgcaaccgataatactattatgtttcaaaagtatgaatcaacacgatcaaagaaatggcatttgggtaacatatttccttttttttatatataaaaggcctagcaacatattttgatttaagattaattcaagttttaaaacaaactacaataattttcatctctaagctaaccgggtgcctaacaacatatataggtcaaaaaatgtgatccatttcatattaaaagggtaagttttttttccatgcattatgggctaacataatgcatggaagcagcagaacaaaacaaataattaaagcctaagttaattaaggaagcaccatcaatcttcacccactctgttgaagacaagtactgttccattgactctgctagtaaataaagccaatcgatagattaatttgcaccagatcttgaagagtcttgatgactacatatatatcgcacgcatctatatataactagctccaaacaaattctcttgttcatcatcaaaattttcaacatctcatagacttgttttagaagaaacacaaatatactaaattgtttccttttatttttgggttacttctcgtgattgaattaagttatgttttgacatcttgcaagatgccataccttgtcttattaaatattttaaaaattttcatgagtggtagaagcaccatcatagggagatcaaggcaaaaggtatacatccatagttttttttactgtgcttttgttggcagtattaattgtttttaattggcaccattacttaattgtattgtgtaccatctcatccattttttttttatttttgaaactccatcccatccaattttgaaaatgtaaatttgcacttctatattctgatttttgaaaatattaaaagttaacttgaaagttcagtttggaatttagtaaaaaaaatatcaaatctatatatggcaaagtctaggtgataaggaagtacacaagtctatgcatgcatggttgttgggccaactaatttgataattaagcccaacccaacagccagggcttagcataatacactgttggcttacttcagtgttcagatttgccggggagaatatatatataataaattcctctcatcaccttgttatcacgagtagg

SEQ ID NO: 10785 - DNA, 1501 bp, Oryza sativa
gattattccttccgtgtgtggggttagcttaaccttcatctggcgatctgatgtagtgatgtgcgtttgtgccccgacaataacacgctttaatctgttatgtgtattattcgacggcccagtgtgctctttgtagggctaatcgactcatccgatctgaattaacggttgttgacactggcagagcattcagggcttcaggccgtccagtgtccgctccatccaagggaccgagagcttctgtcatcagctaacgctaaatttagtttcagaagttgagtttggagtagaattctggcgctgcctaaacctagttttacctctctagtttattttgtgagagcgtttcacctttgcttcgctctcatttcacatagagttggagttgtgccaaacagaccctaaacccacctcacgcgaccatattcgaaaaaatatactccctccgtctcataatataagaaattttgagtttttgcttgcactgtttgaccactcgttttattcaaaaaattttgaaattattattattatttgtgacttactttattatctaaagtactataaacataacttttttaaaattttttttaaataagacgagtgatcaaacaaagaaaaaaaatcaaaatctagcaagtagaaacggcaaccagattatcagagatggccgggtcacccacagccacatatgggcaccagtaacactacaacacaagcagttagcattaaacgatgccaccgagttggaatcgacatgcacgtgcacgcgcccccagcggatgccgatcacatcgttatcaggcaaggcaacagcatatcacgtcgcgtgggcgtggtggtagcagcagcagtactcgcccaccggacaccaccccatgccgcgcggccgtgcggcgccccgcgcgcgcgcgacaccacccgagccgatcgatcgttcgagccgcgcgcccaagcgcaccgcgcaccgcgcagcggcgcgggcgcccatctgcttatggtccacacgcgccgcggcgccagttgcaggcttgcagcgcatggttcccgtctgcggctagcgagagccatgtgggcggggcccccgcacgcgcgccacttcaccaagcagttggtggctctgttacgtactacatgcgcgcgcgcgcgcgcgcgcccgcggccgcgccggtgcggggaggacactcgcatgtgcgcctgatttgtatgtattaactgccggtggccaccgtggccggccgtggtcactcgcaacagagctggctggctactactcctaccagttatacgagtagcttttttactttctctcaccaaatcggggggaaggaaaagatgtgcacggctccgagacgagagtatccaaccgccaccggcactagcttggcttttggcttgctggctataaataccttaggcctggagggccaacctcttcacactgccaagctccgcttcaagtgagctagtctagccagcgtttagacaccatcaccagcaa

SEQ ID NO: 10786 - DNA, 1183 bp, Oryza sativa
ttggcggcgcgcatggcgtgcggcaccttccccatcgtccccggcggcggcggcggcggcgagagtttgggaatcgaatggtgacagaaggagacgggaaggaggaggcttttggcccatgagatatattattgggctttcgtttagtgggccgtatttgggccaatggagtttgttgggctttgcattattgggccgtggtccctgcccatgtatgtcatgtcagccttgtactggttgggccagattgaatatttttggggggaggaggggtgagagtggaaaattgcaaagcgtgtggcgcgttgaccggttgaccccacgcaggtgggacacgggacgggagaggcgcgtgggaagaggggaagacgacgagaggcgagcaacacgatgacataattttataaaccactccacttgcacaccaccaaaagtgaccaaacataggcaacctttgtttcaaagttagtttatattttatctggattacatttatttatccaatctattgcactttcaaatttaatactccacacacacacatgaaaaaataagtacaactgtagatattcatatccaatatttgactatccatctttataattttttttaaaaaaattagtcacacataaaatattatttatgttttatcatttaataacaataaaaatgttaatcataaaataattcaaataaaacgaacgatcaaatgttaaatataaacagtgtaaaactatgatagaggaagtatagtagtactcctaattttcaagtattaattcacttgaattttgaaatgtgccctcgcactatcctcattctcctatttgagatgacaaatgattcccaaaatgaagggactaaaccgtaaaatcgccgcggctttctctttccttttgttccctcctccttggggtctcgcagcatatcaaccaatcaccaccggcggccaccaccaccaccaccaccaccatcgcctcgccgccagccagatcctccccctcccccgcgccaatcacatcgcctcctccgattcccaaggattcttcccgctctctttccttccttccccattcatccgcttcttcttcttcttcttattcttctttcttgttccgatcggggattcggatttggggattccgaggcagcggccgcggcggaggcggagagagggagagga

SEQ ID NO: 10787 - DNA, 1501 bp, Oryza sativa
gcgtggcaccctaacatgtagggctcacgtgtggcccacgctaagtcagctgccacgtcggacaaaaccggagtcaaaaccgccgagagatctattgtgaccggttttgattagttaagagacgccggatatctggttttgcggttgggggataattttgtaattcgatggcaagttgagggaccttcggtgcactttttccaccaaaaaactggatagagtcgtcctatctggttctttggttgagtcggcctactttttaagggtgtcaaagtagactttttccttggagtaaaattaaccggcccataagacccccctgcgtgggcaaaacaaggccgtcttgatagtagatggtgggtcgtatgcaacagttctcaaagctcgtagaaggaataaattggtcgccgagtctaaaatttgtccctaaaccaaataccgatataatgtgtccatcaattttataaaccggatcacacgatgttctaggcagtattatacccgattttagctaacgtggcaagctaagtcaacgtgtgaccacttgcctgacacagccgcctgtaagaatgccgctgacacagttgcaggagagggaggagaacccatcgtcgccattttcggtcggcatgttgtgcgtgcatgatctcggcaaaccgacgcgatttatagtagctcccagcctccgacccatcgtcatgtcgctagcatgagaacgccaggagcttgcacgcccatgccacaaggatgaggtttagggccgagttcaagcagaagaagatccattggaggagagcctcaaggtcacgcatggtccttgaatctgacgtcgccggcttgatgcgcgctccctccgatttttcacctttgtcccattcccacaccgctccgtgttcacggaacagaaccacagatgacacaaatctagcaagaaaaccctcgcaacgtatcatgccacataatgccacatagacaccatgtatcacacaagaataactatattgggactttattactattcgcttttaaaattaagggacacttcatacataactatatgactggtattgtggttcagaaaggaagttcggactggagtcgactagtggtccactcctgtcttccggctaaagttcggcacaacatgttccagaagttttttgacctcgccagctgtccattgatctgtccctggcagcgacgtgacgtcccagagtcaattaaggtcgctggtaacagccagtgctcggctcgctccatccctccgtcttccacggcgcgagactctctcgaccgcttcagacttcacatcaagaatagatgcgtgtgtgtgtccaaacctgtatgcttcgccataacacacgacaattgacaagcgaaacgccatgggaaatatccaaaaaaactctactacttgccctcgcttgcacgtcacccgtaaaacgcaccgcaccgagcatcattcccagctgctagtgctacccaacctgatctcgcctca

SEQ ID NO: 10788 - DNA, 1501 bp, Oryza sativa
tgaaatttgttggtgtttttggaacggttttaacgtgttggttctggacttctggtgcagggtaaactgaggtggaagcagcactttcggcccgcatgcatgtgggctcaggggagccatggcccgtgggccgtgaatgaataatcaacgtgcttgtatgtaccatgtcgtgtactcagcagttcacaagtgtgcttgtccgatcaatcaccaaattaaaggactcttatgactgtgcgcaattgtgcatcgtgctagcgaccactcaactcaactcatgcagtttcgtagttagtcgcgtaaggcacgtggcgaggtgcagtgaccgtgacaatgacatgatcacgctgtatgttctgaatcctctcatcttcgatgcctttagcgtcaggaagtgacgcacaaacgaaggaaataatgggcaaagcagaagacacaggatcgaacgcagcactgctcctatcctccttagcacacatgcactacaaaaaagagagagcataagctcgaccgcaaaacacacaaactctccaaaagagcatttcaggagccccggtcggcgtattcagcagctaacgcaaggctgttcgtggcaattggagtagattgcagagacaccgacacgtttttttttttttttttgcacttctttctcgtgaaaggaggcctgcgcttttgctgttctgcacaggggcggctcacggccgtcgaagtgacgacggaccaaccaagctaattaccgcggtgatccagacgaactccggcacgtacgacgtgtggaaaaatctaatatgttatattatgtggttttctgatctattacatcaaccctctcatgtggtatatataggagtacatatgggataaagacttggagtacaatataggtaagagttgatttatctctagaattttatctctaggactctatcttatctctctaggattctatctctagaatatattttatctctataatttgtatttgactcttatctctaacaaacacattcatacttctaacacgacggacggtagtcgccatcagaaccgagcacgcagcaaaagctcggctaagctaagctagctatggctgatgcttggctttgcctacaaagcaagcaaacaaccccccccccccccccaaaaaaaaaaaaaagtcgcatgggcactagcgccatggcgtggcgcgcgtccctatccctgtaacaacttcgcgccatgcgcaatggcgcaattcaacttgggggggagggggggggggtgatgagatgcccttttacaagtacgctcgcgcgccccgcggcatccatcgccaaagatgcgcgtcgcgatcgctcgttcgccgcgcgcgcgcggctgcgtcttcgtatatatctggcatggccgcgcgcgccaggggctaggctagctacctccatctatctacctggagttagtgtaggtgagaggttaggtcgatcatggcgagtggtgttgcggcgccggcgccgagcgtgtt

SEQ ID NO: 10789 - DNA, 1191 bp, Oryza sativa
tattagaacttagaagtttatattacatcacgttacatctagtagtactatctccgttccaaaacggaggtagtataaagagttttaggcttaaatacgggtgtgaagaaaataggtagaattaaatggaagaaaattatgattgattgagaaaaaaaagttagtggagaatttgaatggtgaaagattgtgattggttgaaaagagaagatatgtgaagaagttgtaatattctgagataaattttaaatgttaaaagttactatattttgatacggaaggtgtaataatcatcatcgcagcaaaatcatccactgagcagtgaccacccacctgattactctaacccaaccaaacatctctgtaccttcttttccagagataaaagaaaacatttgttcttttcttttcagttttcactgcacaagaccataaaccgactgacacgtgggccccaccacaccctggtcccactactcccacacctcgcccgcgccgacttctcgcctctctgacttaccgcatactttactccaccaccaccacccctccccctttgccaccgcgcccacccttcaaagccacccccaaccctcaccgacaggtggggcccaactcctcgtgggtcccgcccgccattgtcaccgtagcgggtcccacgcgcggggggcgatcacgattcgcgaaagcctttacggcgagaaacaaaaacaaaagctttcacaaggcagcgtgaggaggaggaggaggggagctcagctcacgcagaggcgacgacgacgcgcacgcgcaccgccctcctccctccccgcgatctcgccgtaggggatctcgtcggcggcgaggaagcaaaggccgagggggcagcggctggggaggggaggggaggggagagcggcattggttggagcttggaggaagttgggtgtgtgtgtctgggggtgagggtgagggatcggatcgaagcttctggaaggttccgggcgcggatccggctcggtgggttgctcgctcgtggctggaggtagcggcgcgctggtggtatcggcttttggtctaatgctttgcttcggtttggagtttggaggtgggggttttattgatgcttttggttgggtggatttgttgctgcagtttgagcggggggagcaactctgaggtttggttttcctgagatggaggacctgctgg

SEQ ID NO: 10790 - DNA, 1501 bp, Oryza sativa
tttggtgctttctaaactttttcgttccgattaaaaacattgcacgcacgtgtgccaatattggcatgaattgacaaagtttgccacgcgagtcacggagtgaatttttaacaaggacgcacccaatccattccaataagtcaaaatctcatgtttttctggttttttaactgttttttcttgttcaggttaaaaccattgcacccacgcgtgccaacgtaggccaatacctacattaattggcaaaaacaacggacccacgtgtgccaacataggccaatatttgctagctctttgaacatttcattccggttaaaaacatcgcacccacgtgtgtcaatatcagcattaattgacaaaaattggccgcgcgagtaacggagtaatttttcaacacggacgcacccaatccgatccatgatgtccaaaactcatgttttgctgctttttgaactttttcgttccggttgaaaacatcgcacccatgtgtgcaagtattggtattaattgacaaagtctgccgatgatgtgaccacgcctacgacggatacaaccattgatcatgtcaaatacccacaggtggtctcgtttcataacaagtgccaatttaatctaatcaagaatatgacactacctcataatgtatgcgtttatatgttcaggaccaattgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcgaaaaaaggcgatcctagcggggcttcagctccactccacaggcaaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaaatctccactgatcaacgctacaccacgttgaacaggcccaaccaacccacctgtactacagtgcattgggtcgatttattaagtgtgagactaatcacggtgaatctggtcgagcgcccataaccgcgggcacggctattcgaatagttttactctggccagaggtgcacaactgtacccacaagacacaacccaccgacatgtcaccgcgtcatcatgtgcccatgatgcacacgtcaccacgtcgagtgattgtgacgagacccttcgcataaccctcccctaaccatccacaccacgctaaggtttcacccccacccctaaaaaggcagtgggcggtcccctcttgcgccgcggtgaatccggc

SEQ ID NO: 10791 - DNA, 1501 bp, Oryza sativa
ggctgtatgagaaaacatcaaacaacaatccccatatacatgtacaggattgacctacatgaccttatcaccttgctaattcaagtaaataattaagagtaaagttaatgtcagtgcacatctaaccagattgctatataaatgcaatgccatacagctatgagaatttcatgattgatgcatcactactattgtttactttataactctgtaaatagagcacaaatgttgagcgcaatgcactgtttcggtgtatattgccattatcagatccttgctatcctcccaacaaatgaaaatattgtacccaaagattgaactttgctccactccattacagcagagctagcgaaggaacaagcaagcattcaactaattcttgttcaatcgatcacataggaaggaggaagaggaaacttacagggcgaactcaacttgtgaggtagagggtggccgtcctgaagtcgtccccgcagctatctccggcggatgcaagcggattgagggccggcgctcggcggcagtgactccgcgcggagaggtgcggacgcgcggtggacggcgcgggcggaggtgccccggcggttgcgaacgggaggagattgtgaagaggtggagggagtggggaaccggcgggcgcgcacgaggaggcggcaagaagcggcgggcgcgtagtagcggcggcaacgcggcccgcggctccgagcggcgtggagcggcggagacggcggccacacgcggatccgaggtggcggcggggttgggtgagtggcgtggccgcgtggggatggcggagggcggagggcggaggttagatgcgcttcttttttttttggcgttcttttttttatcggcgtttctttcgtggtccgcgcggatggtgcggtttgttttgagccggatgacaggtgggtcccaggcgactgtggatccaaaggatagattcttttggactgtagttttgcatgtcgaaccctgggatttctaaaacttacaaccaggttcaacttcttctccactcgtgcaggaagcagcgacagccatggctgagctcgatctcaagctcgccggcggcaaacgccggctctaatggggacgaggtcaaaagataaaatgtagagcaagacattgagattccattcctcaacttttcccccgccaatggtgactggaccgacgcaggcggcggctgcaatcggaagcgctcgggacgccatgcatgcacccgtgcgtcacggcggtgaacggctcgttctattgcatgcatgtcaataacatcacatgcaggatgtagaacaccacctaaggttgctactactgcaagaaatcgacaaatggctcaccggttgaatggaaatcgatgatataatcccatatcaactggattagggctataacctattaaggggcctgaaccagtataatccatgtcttttgtttgcttgatgtcgtactacgtagatcctcgtaccagcgtaccctaataccgtctatatccggt

SEQ ID NO: 10792 - DNA, 1501 bp, Oryza sativa
agagccatggaggatcatttgggacgtccaagtcaaggtggagggccaaaccaagttgacgtcgggtgcaattcggagtccagatctagtctgcactaaaacgggcgcccaggtcgcatacgtactcggattggggcgtctttatatggatggaaagctaagaagataacctttccaatggttttggtccgacgtccaaattctttccgagtcaatgggaattgaccgaacaagttgacgtctagaatctgtcccggtgctgcgttaccgtatttgggcctttggcccgtgtatcgtgttggaacccattagggttgcgtcgagaggggtttgcacgaccctaaactctatatatcagtacccgccgccatctttaggtttttggattttgcttagattaatctgtcgagaacagtttcgccgctagatcggtttgtaagaccccaactcgtgagcttaattattcatctgcaacattggttgtttttctatctcgttcttgtttgtgttcttcgattggcaaacaggaattagccttttcggcgaggtcatccccgtttcgacacaggtgataactagaggagacgtggtgctgcgattgcggggctcaagagcgtgtgtgttcaagaagccggatcgatttgtgtcgcgactccgtccaaatcgttgtttatcagaacctttcggaagatcagaaaccctagtgcacatcaggcaccctttgatccgctgccaagtggggcccgcttgccggcgccgccccccctttcgctgacatcagccctgggcaatattgcgcaataaagttattaaggacttttcatccgagctccgtttaagtccattcaagtctcagtaaattcataaaaatccctagaatccattaaaaatggttttgttctctgtttcagtagtcttatagtgtgttttgcttgtatgctttgtttgtcgcatagatctcggccatttcgtcgatccgcggttcctcgaagacgttgctgaggtctcatcagtgcgagagcaaggcaagtcatgcattagatttgatcatattgtactcaatttacaaatatcctacatttctattaaatgttgcattcttttacaatgtcatctgggatgggtcctattactcagccatatattgtttaccttataccattgataacttgggtatcaaaatgactagatgttggtttaggaaatgcttagctatgtctagctcaactagtacacaaatggggatcacattattacatagactttgactattagcatagctttggattggtgccaccgcgatggtgttagttaattaaaatacactgaacggtgggctgtgggtacatggttttactggtcgcacccatggcagttaaggaccggttcacgggaaaccctgggagacttaccatgcttaccacaagcgggagtgggtaactgcttgatctgaagtatagctcgaccctttcctaggaaccggtggcgagggtgggcatga

SEQ ID NO: 10793 - DNA, 1501 bp, Oryza sativa
cgttcgtgaagctgaggcccggcgcggcggcggcggcgaaggcgggggtggtggaggaggagctgatggcgtactgcagggcgaggctgccgaggtacatggcgccgcggacggtggtggtggtggaggaggggctgccgaagacggcgacggggaaggtgcagaagttcgagctgcgggcgcgcgccaaggccatgggcaccgtcccggcggcggcggcggcgaagtcgaagaggagcaagctctgaatgaatttgtttgcgtcagctgctgacgactgcaatgcaacttcgatgcagcatgcgtgtgtgtgcctgtggaatctcgagacaacaaccaaagaaaaaaaataaaaaaatcatgatttgttgtgatgattcgtgcgagaacaggttggtgtcctttggctgtcagtgtgccgtgcggttttgacagtatactgtcatcgtgtgggcttgccatatgatgtggtaacctcacacggtgatacattttcggtttttgtcggtaactatacaattagggccttcactgtgcgaatacgtggcgagttacttcgatacgccagctcggagattcgtagccacgtctatatcagtcggcccccttgtgaagagcggcggatctcaatgaagttctgtgttcctggtgctgtcaagattataatcgtgggccctgtgctgccaaagtctaattcaaggtcatactacctccgtccaaaaaaacaaaaaacgaatatggcatagtattttagcacagtgaatctggacagatgtatgtctagatttatattactagttttaggatatgtcacccagtactagttggttttttatgggacggagggagtactgcactatgactaatatgttgatcggttcttagattgaaaaggtggttcgacgcacgatgctttgactatggatggccttatcatgtattcgtattgaccgtgatagtgtttggtagtggttgtctgtactcaaccaaacttatcctatcaaccatttcattttgatttagacatggcatcagaacaacctgaatttcgcttatgtacatacgttgcttttaccactaaaaggccggtttgaacttaaacagagtagcttgtttatttgaaacatactctcttcttcctaaaacaatcaattttttatataattcgttcacgtataaagttgtctcttactcaaattcacgtataaaagttgaattttttttctgtaatagaggaagtatgattttatattagggttcttgtacagtttaagcaccgacaaccgctatctgtaactgcaaagggaggaaaatgagctagcttttatacatgcccagctcattgtttggcttatttaaaaaataaacccaacggtatatttgtaaacgaaaactaatttatgaataaaacttttatatacatgttcttaacaatctaaaagtaaagaccgaaaaataaactacgataaaaaaatctcaaaatcaactttaaatttaagat

SEQ ID NO: 10794 - DNA, 303 bp, Oryza sativa
ccttatactgtgtggcctgatccaatgggaatttaccgtttcatctaccccccttgtgacacgtggcgggctaggattgggtggaaggcgaagcgtcgcttcatcgggctacaaccacccctcccccccccccgacggatcgctttgacctttacacctctcacttttttaccacagttgctttcagtcaccctcactctcatgcatcttgtgcttttcgctctcgtgagtttgtccttctcccccattaagcctttcgcctttgtactcgcttggtgctttctccttcaccacggatgaaaa

SEQ ID NO: 10795 - DNA, 712 bp, Oryza sativa
tttgagataggggtttatcagtgtcaattaattcgttcataaatttgcatatgcacaattaatgatcaatatccgcttaatacatcctccgtcttaggttactatattttgaaacatgtggtagtgtgaagcttatacgtgtatacagtaccgtgtgttcatgttgtccatctgcttcccattcgcgtgtttcttccgaggccgggtacggcggtgatttgcttattagcatgggccctgaaaatcaggcatatatgggaggtgaggtgaggtgagaatgtttatcaagtactccctccatttaaaaatgtacgacgccgttaacttttcacataacgtttaactatttatcttattcaaaaatttagtataaatatgtaaatgtataagttaagattatattttatttgataataaaacaagtcataaagaaataaatgatatttatataaaaaaatttaataagacaaatagtcaaacgttgtgtgaaaagtcaacggcaccatgcatttttaaacgaaaggactacatgaaaatcctacataaagaaacagacagcatgcactgtcatttaattattagacattccgttatcgtcttaattactccctccgtccatagaaaagtttagttcaccggaacattaattgtagaacccagcaattaatgatacgtatatatgtatagcgcgatatatatagtgctatcgaga

SEQ ID NO: 10796 - DNA, 736 bp, Oryza sativa
tactggagtaaccaaatttggtcggtcgcccaaaaaccacaatagtcccggttcaaatagcaaccgggactaaagataattggagcctgcactcgacctgacaacttgttgaaccgagactaaaaataatctttagtcccggttcctatttgaaccgggactattgtggtttttgggcgaccgaccaaatatggtttctccagtagtggatctatttatttatttaccattcaacaaacatatttatggggtaaatttatcattcttgtcttgataaggtacatgaaggttttatatatttttaagtgtaaaatttggtacgtatgtatctctagttatatgattattttcgcggtatggaaaatttagttgtcttttgagatacattttaaaggatagtaaaatttctctccttttcttattatatgctaaaactctactcgtttattgacttattgtccatcatagattctaaactactcaaatcgcaaaagctggagaagaaggaggaaggctcggaaaaaaaaaatatatatggtcaaaacctcgtggtgcaatcgtaccaaacgtttcctcacatgcatactgaactttgaaaagtatgaaggaatcctctctcacaagtcaattaaacaactgcgaacaaattaattataaatgagctcgaattgtgttgtctctataaatactgaacgatgatggcaagcagcaggagctcatcattcatcccaatatc

SEQ ID NO: 10797 - DNA, 1501 bp, Oryza sativa
gtccaataatccttccatttccccttatacgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaagtctcgtttacttcagcacttagtccctcgccatcatccatgttcgtctgcacacctggatccttcgggtgaacaaacggaaccaaagctagaggccacccgcgttgcaatgcattttccaaataccatctccacactcgagagttttgaactggcattagttcccaataaaaaccctcagttgcccgacttactataacattgattgttatgtcacttgtctgtaaatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttaccgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttatcttctcctcccctctcttcttttttttttcactggaattgaggagagaagaatgagggctggggctgggcagcaggccttttataggcagcgaggcctgccgcccggccagagggcggcaaggggccgcctgcaaaatagccggccccgactggcttttttgcattcgggccccttgccgccccaccagagggcggcaagggttttcatgcaaaaaaaaccctccctccgtcaccgcccgttcctccccccgtttgccacgtcagcttgccaccccagaggtgggcggcagggtctatttttgtagtttttttttgccgatagattatttctgtaaa

SEQ ID NO: 10798 - DNA, 1501 bp, Oryza sativa
ccttttcttactcttgtatgcagagctagctgcaaataacacaatgaacatgttgcctcagctggtcggctatctcgtctaatggattagacttttctggctcatgcttttccattgctgtgtctttgcatcactttgagcttgatggaaaggcgatacaaaggataaatcatggcaaagaatacacacaagggtattcagtgttatgaaacatatcttattatggacgaattaaattataagtgggaagcttactgtagaagaaagcttacaccagaagtcagcttacagaggaaggcagcttatggcgcaagccagcttacagaggaagcaagcttataagagaagccagcttacgacgcaagccagaaggtccaaggcatacgacgtaagcctccaccctcctccgcctataaatagggcccagaaggtccaaggcgagaacaacggatctccggtctcctgcttctcctcttgtagcatgtacttaaatccagaagaaataaagcttccactcgttcatactttctgtgttccacaactctgtgtttggtttgcttgtgtgctgatcaatagaatagactggtttctcaacacgttatcagcacgagactctatcgagctaaaaaggtaaacatgtgagaaatcagtttctactgatcatcttgatctttatatgcaaatcattcttctgctatagttgaaataagcataagaacatggtacctaaagtaccatcccccgatatcctctcagcaatacacgataacatgatggcggctctgccgctattatcgttcaattgctagagttgatacatcctctcagcaacgcccggtaacatgatggcggctctgccgccgttaccgtccaaaggcttgagatggtacatccccttagcactatttgataacacaatggcggctctgccgccgttatcatctaaatgctagaggcgatgtaggtgcctgaagcaccggcatggcaacttaatggacggccctgaagtgtcgttatggatgtcctttgttttatggacatcacccatatgggcccttgatgccgctaaggtcggctctgtcgccatgaagcgtgggctcttagtggggaagtactatatggtttatcttacttttatacagtctgcacaatatgcatgaagtgcccatgtatgctcttcattttttttacatgcttactttgctatttgcatgactttcataacattaattttattgttatgaaattgatttcctagcatgattgataatagttaatcaagcaatctgtaatcctgaagattacttaagttaatttgctaggaaagattctatgggaaactgtgtgataatcctgaagattacgcatgaccaattcatgtcgaccctgcacatcgtatttacctgtcgtaaatactaaatgatgttgcagaacatgtcggacatagcaaagaaggaattcgccgagcttgccttggatggtagtaactacctcacttggg

SEQ ID NO: 10799 - DNA, 1501 bp, Oryza sativa
acaagcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagtaaagatttaagagtagtgaaacagtagagtaattaatcagaaattttaatcaacactgaacagcacacccatgctgctcaggcccaaccaaacctgaacaaccaaccccggtcgtacagatcaaacctccaaaccaggaatttaccattccaaaccaggagtcaaatttattatcacattattatcattaatgagtagtgtgggactaatcacgaaaaacattgctcaacccgcccatgaccgcgggcacggctattcgaatagttttactctggccagaggtataccactatacccacaagacacgattccacacatgttgccatgcctcgaagtaccaccacggcactgcaaagggggaaatcatgacaatacccttcgcacaacacaactcaccacagtgcaccattcttgaatcataatcaacccctctataaatataaccagaggcatggactccctagcgatccccacggacttctcaccgcttctcagtctggtgccccgtaatgaatcatgctatacaaaaggtaaagccgttgcccacgctggcttgtggttggcacggttaatgtctcacaacagtagctcgcgaaccggtccttaattgccataagcacgaccttcaaaaccatgtgctgacaacccaccattaattatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgtacagttgaaataaatagagaatttaaatataggatcaacatgctcaaaggattgtgtttaggatctgtgtgacttgccttgcaataatcgatcttcaattaatcttcttgaacacttccgacgcactcacgaaccttcgcaacgacggaaacgacaaagctagcacgcaaaacgaagaaaaagactaataaaaaccaaataaacagtacaaaaacaagcataaacagtatatgtggatatttttaacatgtagatcttgattttagaaaaatttagcaactagaaccagtcgaatccgagttacgacgatttagttatgaagttccgaagtttaatcgattttcatctaataaagaaaacctag

SEQ ID NO: 10800 - DNA, 1501 bp, Oryza sativa
ttggagctgcccgcctccttgggcaacgtgcatgatgtgttccatgtgtcgcaactcaagaaatgccttcgagtgccgtccgagcaggccgactcagagcagattgaagttcgcgaagacttgacctacatggagaggccagtgaaaatcctggacaccatggagcgcaggaccaggaactgggtaatccgtttttgcatggtccaatggagcaaccacgccgagctccggtccaccgccgtcttcgccccggaccgtttcccgccccggcgtcacctccttcggcttcgccgcaccgccgtcgaccccgtccaccacctcgccgagcccgccgaccgccggaacgccgtcgaccccgtcgacccgagccgcgccgccgccttcctccgctccggccgcctttttcgtcgtcaccgtcgacctagggtgagccgtagaccgccgcctcttttccccctttcctcccctctctcgaccgccgctccgccgcgccggtggtcgccggcggcgaccatcggggcgcgggggcgccgcctcccgccggccgcgccgagtggccgccttcgggcgtgccgagtggccgccacgtggggcccggccgtcagccgcccgtgccctcgggtgcggctgacgcgtggggcccacggcgccggccggtgcgagcccaggtgcgcctggtccactgtggaccgtgaggctgccacgtgggccccactcccgtggacccggtccgcacgcccctcccctcggctgacgcaataaactctttttaaattaaaatttaaatgaagaaattcgcaaatattcatttaaagagcatataaacttcaaatggccataacttggccatttaaactcagaattggaccgttcaagtctctaatttttccttaagaagtcaagaacccatttttgtgctttgttcctgcttgttatatagagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttagattcccacgttatctctgttttatttagccatgcctatttacctttgttatgaccttattattattgttattgttattattaccttgttcaccctagattaaacaaaaccccaactagtggacactctgctcatggtaccactagtatgaatttaggtagatgcttcgccgcttaattaggtaacattaggtggttttacaactctagactttgggatattcatatcacctggatactatggaatggttggattattgtggaattggattcacacctccccctctattcaaaatcctcaaaatggttttaggctgggctcggggtgcatggttttgatagtagcacctcggccatataaggaccggt

SEQ ID NO: 10801 - DNA, 616 bp, Oryza sativa
cgaacccctagctggcccagtccagcccatattcggtatgacgattgtactcctcatcccaatgatggttgtggccgtttctaccggtggaagccgtcatagagaggacacttgtcaagagaagataaagctagagggaatattctcataggatgcttggagcatctccactcccccaaggcaactctccacctataaatatccctctcctctccctcattcacacacaccaaagcatgagctgaattataagaggctctagtgtactttattgcatattagaatagggagagagtaaggtagaaggaatcggaggaatcccgaagttgtcggtaatctcctcctacttttgtatcttgttaattactctgctttaatagaaatatcattctgagtatttaagatttgcttagtcataattactttttggttagttcctaattagcatacaggatcattgttcactatagtccatttatttgtagtgattgctttagtgtttgatcggcactagagtagttattaattgcgtagacgtggtgtctgggtaattaatctctagtggttgctatgtatcccacagtacgtttgaggtgggtgtagaggtggtgatagc

SEQ ID NO: 10802 - DNA, 1080 bp, Oryza sativa
taggatcacacagagcccgagagctaactgtgcggcgtgctatggaggtcgagggaatagtgaagctccgaccgctgtacgcatcgaggcgtggggtgccaggagcagcacttcgaccttaggtttggttttgccgggctttacaaccaacggtccgacgtcggggccagtagaccgcgaacgtccccatggaaggcgtaaagttccaaccggcggctttttagtggctaatgggtatttttggggtaaaagaaaatatttgaaaaaggcaaatataaattcaaatgatatttgaataaattcaaataaaattataaaatagcaaattaggcatcaaaataaagcatttgaatttatatgaatttaggtccaggttttactgagatcggatctatggtttaggagatatgggcttctaaagattgggatttgaattaaataaagaaaatgtgaaatagtactgtgtaagggcccacctgtcagcctttcctttcctctttcttttctctttcttcttccttcttcctcctcccgttctcttcctcttttctgttgccgagtgagttgagaggaggagaggaggggcgctggctctccggtggatggaagactgcgacgccggtggcaatacatgttcccgagcgacgcgcatccggggagggtgatagtcggcagaggaagtgagagaggaagctggaacggcgcaggcaagagctctgctccggcggcaaaagaggaggttgtggtggcttgttttaaaggggaagggaaaggggaaaggggtgaaatggattcgcctcgatgagacgaagctagtggcgcgagggcttggccgacaacgctccggtgagggagatcgactagtggtggccatggcctaacatggccaggagagagagagaaaagctcggcttgtgtgggggagaaagggacttcaccgtatatttataggcttcggaggtcggttgctcaagtcggttcgcagaggaggagggcgacgaaggcacggctgcagcgacgtgaaggaaagaatgacggcaccggttctttcctcccattggacgttggagtcggttcggc

SEQ ID NO: 10803 - DNA, 1501 bp, Oryza sativa
ctagagggcagactatcttcttagcctcgtacgttgtctcgggcaatttgtttccctccggaagaatgttcttgacgagttttaataaatcgccaaataccttgtcactaacaccattttttgccttccattgcaagaactccagagtggtatccaactttttgtgcccgtgctcgcaacctgggtacaacgacgttctgtggtcctctaacatcttgtccaatttatgggcccccttttcactttcgcagtcctctttggcatcctgcaacatctgaccaagaacatccgcaacgtcgttataatcagcatctatgtcctcctcgcccgtttgatttccttcaaatccagcgtactgagcaaagtctggaatattgtcgtcttccacttcatcttcttccattttaaccccttgctctccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaataatgcacgccgtcaataaactctttggaccgccggtcagcgtacatccattgccgatccatctacatgaaatgtaaaaaaaatcgtagacaaataattattcgtccaataatgacagtcatacaataatgacatatcattattcatacaaaaattataaaatattccaccaaataattcttatttattattttttaagttttaaattcttttaattttcaatttagtttgttttcttttatttaagattaactttcactatattttcctactcaactattttataaaaccttatttagcaaataaacaaaatttctatatattctttcttttcccacacaaattttctctctcatcaacttacaacaaaattttggagacaaaaaagtgtgcaaaacatagctccaaatgtaatatgaccaaaaaaaaacattggaggatgaagttgctaaccttttaggcacctccgatttatatataatcaccaaagtaaattcactataaattttggaatgacctctcctctttttctaagaaattttgaagcttgctcgggctggaggaggaagaagacatatataaaggggtgggactttagtcccggttggtgttctttagtaccggttggtaacaccaaccgggactaaagatcccggggggcctgacaagccctgacagcatttgaaccgggactaggttggtgttaatatgcccgttacccttttgttgcaaccagtactatcgtggaattcggccgaccgaccaaagatggtttctccaccagtgatatcatctataaaagattaatagttcatccgtacattaattacctatatgttaataaatactagctaagacctcaactaataattatataatccgcttacagtaacttttagtacttgctctaatgtaaacttgtg

SEQ ID NO: 10804 - DNA, 1501 bp, Oryza sativa
gagaccaggggtatttttgtctgggattgcattatagcgtgtagcctctaattgaaagtggcaatttagtgaatccccttttcataatggcatttgggcgaaacctatttttaacaatggcataatatcaattttctcgtaataatgttacacgaagaaatatatataggatggtggggtgtactagctatcaagtggagaaggggtatgtatcacgcttcttctgcatgcggtgcatcgggcagttagcacatgagcccaagtgactttggtctgtgggaccaggtcggccgagtgtgctgcatgcaacttaattgttgtgttggcctgatggatattgaaaatttgccaggacaggggagacccaacgtatgtgtagctgtggggtgcatgaattgatgtatgtatatattttctttaacaaaaactcgtaacattttattaaacaagacagttcaggagagcaaacccccgtacatcgccatagatattagctgaaatcattcaaccatccttaggttcactgaactagggaaacaatcttcctaataaacataacagcagaattggagcagatcgacaggaagctccggcgatagatggctgcatatacgaagcgcgtgactatttatatgcatgcacaagtttacattagagcaagtactaaaagttactgtaagcggattatataattattagttgaggtcttagctagtatttattaacatataggtaattaatgtacggatgaactattaatcttttatagatgatatcactggtggagaaaccatctttggtcggtcggccgaattccacgatagtactggttgcaacaaaagggtaacgggcatattaacaccaacctagtcccggttcaaatgctgtcagggcttgtcaggccccccgggatctttagtcccggttggtgttaccaaccggtactaaagaacaccaaccgggactaaagtcccacccctttatatatgtcttcttcctcctccagcccgagcaagcttcaaaatttcttagaaaaagaggagaggtcattccaaaatttatagtgaatttactttggtgattatatataaatcggaggtgcctaaaaggttagcaacttcatcctccaatgtttttttttggtcatattacatttggagctatgttttgcacacttttttgtctccaaaattttgttgtaagttgatgagagagaaaatttgtgtgggaaaagaaagaatatatagaaattttgtttatttgctaaataaggttttataaaatagttgagtaggaaaatatagtgaaagttaatcttaaataaaagaaaacaaactaaattgaaaattaaaagaatttaaaacttaaaaaataataaataagaattatttggtggaatattttataatttttgtatgaataatgatatgtcattattgtatgactgtcattattggacgaataattatttgtctacgattttttttacatttcatgtaga

SEQ ID NO: 10805 - DNA, 1501 bp, Oryza sativa
aattttagacgtttattacagctttataaagaaccatatgttgtatataaatatcttaaaaaatgatataaccaaaaataagagaaatggaggatagtgtcatgggaaggcagagatgatgaaaacacatcaactcatgcaacactgtagatgatgataaataataataaaattatactacccgttgatatttcttgacgacattaagtagaggcaatggcaccagacatattagtcggtattttcttacgatcaaggatataatccgcaagtgcaaagatataccgttgttgcatttcaccttaaaatatttccaaggtgtcttatttttaatctcaagtgaagatatggtaagagtgtactatgttattaatgtacatcacacttaagtgatcgaaatctcatgcaagggttagtcaattatgaataagggtatgttgacacatatatggatcaatcaagctaactctctctaaatgacaatatagactaagcggagaagaatgagaactaaaattttgggaactaaaattttaggcatctctcggagaagggggtgtttttaggccaaattaggttttggctgtctcaatatagggtttttggcacggtcattttttctagttaaggctgtgtttagttcccttcaaactttcaaaaattccgttacatcaaatgtttcgacacatgtatggagcattaaatgtggacgaaaaaaatgctaatgacagattaattaggcttaataaatttgtctcgcagtttacaggcggaatctgtaatttattttgttattagtctacgtttaatacttgaaattttttttagaccaagggcattacgccctcatctccatttctagaaatgaaagtttaatatattttaaatgtgtatccgtatacgttaaaattttttttaaggagaaactaaacacggccgaagtgaaaaaaaaaatacgactccatagttttagccaatctgaataaaaaaccagccgaacacagccaaaacccacatctcggttcggcccggttcagtggtcggtcttgagcaaaatcaaatcatcttttttcccccaccctttggactctcgtcagtcgtcggaaaccctcgaccaatctcacaaccctctccatggccgcctccgtctcgcccgccgcctcccctccccgccgccaccgccaccgccacgacgactcccctccccgccgccgccgccgccacgacgacgactccccgcgccaccgcgacgaccgcaagcgccgcgcctccccgtccccgtccccgtccccctccccctccgaccgcgacgccgaccgccaccgcggcaaatctagggcttccccgccccgccgcccccgcgattccgaccccgccgagagcaacggaggaggagcacccaagcctggcggggacaacggcggcgaccgctccccccgccgcgctagggtgcccgatgcggaggaggagggtggtgaccgcaggaggaggccgtcccggg

SEQ ID NO: 10806 - DNA, 1501 bp, Oryza sativa
gtcgtcggctcaatactatggcggacaacctcgctgacctcggcgaaccgcagtccgaccgcatgctcatcaatggccttagcactaaatatggtcatgcaatttcttcttcctatgcagcatcccttccctagcttcatccaagccaggtcgcagctgttgttggaggagatcacaaagggacaccggccggccaccgattctaccactgcctttgttgtggccactgcaacctcaggcaacaccaccaccagcgcccgcaccggcaacaactcccaaggcggcggcggctccggtggcaactcccacaatcgtcgtcgcaaacgcggcggtggcaacggcggcaatagcagaggtggcggcagacagcacgtcacctagccggaccagtccacccccctcgtgtttgcccatcagtggccgacgccctacaacccgtgggtcggcacaacacaaatgtggccaggccaggcccacggtccaggcatattcggccggcctcctttcgcgggagtcgttgggccgcctgtctatgtcgccaacaccgcggcccatggagctcctcagcacgccgggctagcgccgctccctccccgacggctacgccatctccacatgcttgggctggcccctcccagtgggacccgcaggcactcgcgagctccttcagcacctccacgttgatgcccctgacaaccaacgagtggtacatggattcaggtgcatcttcccacatgacttctaataccggtatccttagtgcgtctcatgctccccccccgccccgcccccaattttccttcacacattgttgctggcaacggatcacttattcccattacctccgctggcacaacttacttgcattactcgcatcgctcctttgttcttaacgatattctcttgtctctttccattattgaagacataatatatgcacgccggtttgctcgtgataattggtgttctatttgccttgaatctttttgcctctctgtgaaggattaccaaaccaggatcgagatcgctaggtgcaatagttccagtgacctgtaccccctattggcggactctctaccctcaaccacctccgtccagccttttgttgcttccaccatcgacaccaacctctggcatcaccgacttggacatcttggtcatgaagctctctctcgcttagctcaggcgtccgtcattcctcctccgaagagtgctacccattatgtcatgcttgccaacttaggagtcacactcatcttccttttactagcagttttactagggctacgaccagctttgagcttcttcattgtgatttgtggacatcccctatacctagtgtgtctggttttaaatactatttggtcattttagatgatttctcacattatgtatggacctttccgctttgttttaaacccgacacctttgccaatttatcacggtttttttgcctttgtgaagactctatttgcagctagcattcggagcattcagtgtg

SEQ ID NO: 10807 - DNA, 1501 bp, Oryza sativa
tacaaatgccccaagatagagattttatactcaataatttagtgtttgtattatttaaacttactgcaattcaagagaaagtaaccaactcgcggggcatgtgcgcttgtgtgcatgctgtcattgaatagttgaacagatacctaattttatgtgtttttttggcaattcttttgtatgtgtgggtagatcaatcaactttatacttgatatggaagaaatggttgaactcagtcaaattggagactgagtatatgtgtttgggattgatttcttatcgatgccctttgttagaacaaatacgctgtctggtcaagaatgttgcatttgacttttttttaattttttaaaaaaggtactataaataaataataaattacatagtttgaaaagattaaaattggaatgtataatttgtcatgaaaaatactttcataatatcataaatctattagattatataaattttcataaaggtccttctaaaacacaagcagtgggcatggtataacgtatcacacgccctactagcagattaatttacgtacccagtacatgaatacacatatcaagtaaatatatcactctcactttgttctggtctgttgtataaggtatataatgtactgggtgtgctatagtagttctaacttttataacaaaaagttataataagaagttatggataaagttttactccctctatttctcaatacatgacgatgattacatttggatatgtcagccaccttattcataattttagtgcaaatatgcaaagttattgttataatacctttaatggtaaataaagtaactacaatatttacattctgcctttgtttcatattacaagccgttttgactttttctaagtcaaactacactaagtttgatgaaattgatagatatagtagcatttacaacatcaaaatagtttcattaaatctaatattgattatattataatagtatgtttattttgtgtcgaaaatattgttacgtttctctataaatgactttgaaaaaagttaaaaggacttataatatgaaacagagagaatagttttttaataaacgctgtgtccaaaaatcaacagtatcatatttaaaatgaagtatcttcaacaacataaaaaagtcgtacctcataatttcttttactagatgatctgttaattacttaagcccaaattgagttggtctattaagtggattattgctgcgcattatgtgcttgatagtgataaattaaatatttttaaaagtaaatttaccatatagcttaaataattggtataaataatatagaagaaaaatgtttttagaaaaaaacgtatttttgaaacattaaaaaaatagtccggtgaataagcaaaaaaacacggccttaggcaattcttgatacactttgttcatatgttctgaaatttaacattaattggtctgatactcaccactcatgtatcctctgttattgtccaacatgtatcttaatgac

SEQ ID NO: 10808 - DNA, 1501 bp, Oryza sativa
ccgtcacggacgaacagggagcagtcgcgcgaagcgcttccgaaaaaccttattgccgccttctcccggtgcaggacgtcgaatccagaggttctggagacctgctctcccgatcgccggtgcacgccgacgagcgggatggagtagtctacgagcgacggcgcagcacagagtaggaggcaaaccctagattgatttcgcgtatgttgtgtgaaggcggcggctcggtttatatagagataggtcgcttgatcagggcgcccgcagcaccagatttttcggaatgtttccaaaacaaaacaaatccgaatttccgcagcaaaacaaaactgcaaaaggaggctgcatctgcgcaagggtgaggagccaattttgcggaccattcaacgcgtacgtcgtgcacgcgcgccgcctgccaggcaaggcaagcgagcgcgcgcgtgtgatccccctcttctctccaccacacatgcttcaaggggctaggagggcatcctctcttttaaggaggtccccctctcctagaataaacaaggtggtactaaactccatatgcatgtcaacttatgaggtgggcttttgtgattttccaacgaattaatcttcgaatgggccttagcccgcctattaattccaacactggtttgggtgaaagcaacatgtgggctgggttgggtggggtttaaaaaatgattatgtggaatggtttggattgggtaaactaggtcgattgctttgggttggggtgaatgagggctagatttcaatccattggcagccttagttgtaaccaatcaaaacctatcgtttgattagcacatagaaaaatcgtagaaattttagacactaaaagagaaaaacatgaggtgatgagacctcatgcttattttctttcaaaattgtcctagcaaggttcattcctcgggaatttcaaaagaattgataggaaacaataaacaaaggattatataataaaatcctctagattttctatggtttttactttgtttcaaataggggtctaagggctcattctaaattactgttaccttctcgtcgcttccaagggctcaccgacagttgctgcctcactttcctcgggcaagctagcgagctttgccctcgtccaaggaaggaggggcttgtggtggaggtgggagggaaggagggccttgtggtggaggtgggagggtatttttggatgttgcatctctaaaacaaatcacaaagtagttagaatttttgagcgataaaatattctttctagtagtgaatatttttacatatatttttatcaggaactactccatggactatggtacctttatggaacagaaaatacgcgtgatattcacaatatctccataaacttgcatatccacaaaacgcccttgatatccgtgccagttgctaccacaaaacaggttatactgccatgtaaacaccgattatgttgccgtaaaacttcaacgctgccaccatgataaaccaatgatttttc

SEQ ID NO: 10809 - DNA, 1501 bp, Oryza sativa
caaacagtgctagaaaccttgactagaattcaggccagacatcactccaacatggcataaaactaaccaaggtcttccatactagttatgtttgagccagtagcagtatcttacattacatgtcaagctgaaaaggagaattgaggaaagttaccttgtcatttcgcttatatgccctcttgagctgaagcacaacacgaacaagaagcaggcggccaatctcagggaacttggtatttacaaccgcgacaagtgcagcaaacacatctgtgaagccaggcgaagccatctgcgacttgatgcacgattggcagaagagcccccttccacgaaccaggttctcggcgaacagctcgggcactatattctttatgttggtggcattcaccttgttcaccagaccattgatactcttcttgagagcatcccagctgagacgctggtactcgggactcgacttgtcctctacctccctcatcatctgcgccatgcggaaaggcgggatgtagattcctcctgtgcggccgggtatcaactccggcaagagcggcggtggcgggggcagcggcggagtcggctccttcctatcagggctcctgcgtcgctcctcgcgaccgcccctgtcccggcgcctctcatctctctgccgcctggagctctcgtcacgacggtggcgacggctacggccaccatcagaggactccgagctggggctccggcggcggtggcgcctccggtggcggtcgcctctctcgtcgtcggagtcggtggagcgcctcctccggcggcggccgccctccttgtcgtcgtcggaaacccgggacggcctcctcctgcggtcaccaccctcctcctccgcatcgggcaccctagcgcggcggggggagcggtcgccgccgttgtccccgccaggcttgggtgctcctcctccgttgctctcggcggggtcggaatcgcgggggcggcggggcggggaagccctagatttgccgcggtggcggtcggcgtcgcggtcggagggggagggggacggggacggggacggggaggcgcggcgcttgcggtcgtcgcggtggcgcggggagtcgtcgtcgtggcggcggcggcggcggggaggggagtcgtcgtggcggtggcggtggcggcggggaggggaggcggcgggcgagacggaggcggccatggagagggttgtgagattggtcgagggtttccgacgactgacgagagtccaaagggtgggggaaaaaagatgatttgattttgctcaagaccgaccactgaaccgggccgaaccgagatgtgggttttggctgtgttcggctggttttttattcagattggctaaaactatggagtcgtattttttttttcacttcggccgtgtttagtttctccttaaaaaaaattttaacgtatacggatacacatttaaaatatattaaactttcatttctagaaatggagatgagggcgtaatgcccttggtctaaaaaaaatt

SEQ ID NO: 10810 - DNA, 1501 bp, Oryza sativa
gccgtacaacacagagttagttcaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaattaatacatacaactgtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaaatttcattacgtaacgatttcttgtttaattactaatcaatttcatacattcatatagtttattcgtatgagggataacctgacaacacacaaggaatttatcgcagcggttcaagaacaactcatgggattcatcaacgaagaaatccttgatcccaagggtgaattctactacgacggaaacacaattcaccggtccttagcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatacatatatatatgtatgcatatatatgtattgaaacatatatatgcatgggttttatatatatatatatatatatatatatatatatatatatatatatatatatatatatatatataaaccatgcagcaacagggccattcaaaaaaaaaaaggtcagctcgatctttagtcccggattggtactcccggtttggaaaccgggactaaaggggggttacgaaccgggactacaaagggtttctccaccagtgcattagcgttaaagggaagtttttttgcggccgccatacacgttggacaactctccacagtttccccacccgcatgtcgttagcaacagatttggtcactccctcctttatgatgccattagttgatctctctaaacacaaagcatatatgcttcgtttcatatcaggagggtagtgccttctcttcctgatatttatacctg

SEQ ID NO: 10811 - DNA, 1501 bp, Oryza sativa
ttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcatatatgaaacaacctgatcgtcagatcaatacacactcggcggattcaaatccctaaacacgagtagggtattacctctcattgagagggcctgaacctgtctaaatcctttgtcttcacatccttccacttttaaggtctctgcgctacccccgtttattattggccaaatcatgtttcgacaccccctcccctgggcccttgccccacaaaggtgatcagttggaaaacatcacccgtcccaacccccgtaggctgcaagggacccaccctcccctcaagctccggccgcgatgtggtcctcggatttgaaggttgcaacccccgcttccttctagctcccgcagtagcgcgcctgttggattttgaggttgtaacccgcactcccccctagctccacctttctccgccgggtggtgagctcgaccccgtcgctggatttgcaccgagactgcggctgccaccatcgccgtctcttacccaagcccctctcttctctctttatctctccgctagtccaatgcgcgccgccgcatgcctcctttgcctcgctcgctggagttggttgcgcggggattagcgttggattcaatcagtacaaaaacgcacgtgctcaccctatgaacacttactttgaaatgaaggatgaaaaaaaagcataaatgagaaaaaaaatacacaagattttgaaagaaatgtaactgcataacacataaaaatgcaaaaggagaaaagatcatagaccgttggaaaaatataggaagcacatgattgaggtaaactttgaaaaaaataatccaagagattagtagcctcattttttttattacgcttatgcttatcaatgaaaatttaaattttcaaccttaaatttgatgttaattttgggatttttttcaataaagtttatttttcagcatttacttttgaatcgctaagaacacgttatttataaattatttttagtttgtaaatatgccgtttggcttatttcctaaataagccaaacgatggggccatagagcttttcctagaaattttccataaaggatttaaaatcctccaagaatcatatgttttttctaccaagaaaaggtagcctaacaaaagttcttatgaaaatctatcaatatgtttttttaagctaaatatttgagaattattagtgatcaaggtttcaaaattttgcatgaattattcaatagcgccatatgtttaagggatttgctatgtattactggtgtgattttttttttagtttgcaattgaatttgtgatattgataaatgtgatgataacaacaaaatctaacac

SEQ ID NO: 10812 - DNA, 1501 bp, Oryza sativa
taaaagggaaaccgtagaaaacaaagaacgtggcttatgtattctagtggattttactcctagcctacatgtaagttagatttcgcgggtaaacgggtaaagcgggcatgggtagtgattacccatacccatgcccatttacccatcgggcatagtttttgaaccaataagatacccatgggtataaaatggagaacaaacccaaccctaatagggtttttacccgcgggtaaacgggcaaacgggcacaattgccatccctagctgtcatggtcggtatcgtctacgaaagccggcgtggacagcggagcgcggaagccggcgcaagtcgttttgccggacagctacagtccggggatatattcagtttggattagatttgttatttcctcttttcactcataatttgttagacatttcagttaagatttgtaagcctatttagaggccaactttgggagaaatcaattaagtcagttcagatctcctttctctgtttctcatcctctgctcgtcgctaaattaccatatcctattcgatcttacgccggggctcataacacctgctgaatttggtgatgtgtagtgtaaatatgggcaatggttgtttcgatggagattgttgttactagaagtaagaatcatataacgaaggtatattggggtgtacggcgcagcaaaatggttgtataataaattaacagaacatgttgcggctcattttgctcacaaatggtaacagcataattttaaatttactcatgttccaagctccggcggtatgactccagtaagtttgctcaagataagaaaacaatctcagggaaaaagcaagtctatccgatgatactaacagttttggcaatctaggatagatcgcccagtattgaagaaatactccctccatctcaaaatatttgacgtcggtgacttttttaaaaatgtttgaccgttcgttttattcaaaaaattttaagtaattattaattctttttctattatttgatttattgttaaatatacttttaagtatacatatagttttacacattttacaaaagtttttgaataagacgaacggtcaaacatgtttaaaaaagtcaacggcatcagatatttagggaaggagggagtagaacctaccagctcgttctcactcaggtctctgagaatcaaaatttgaatataagaattcattatctaatcatacagaaactactgaacctatggattaaaatgttgtggtctactcatagaacagcaagaacccgcataaggccaatcacatctggaatttttccggtcattctatttcttgaagtgacctatgtaacacgaatagaaagcgcacaacatagaggctgtaagtaagcatctataacattgagaagatacgaacgaaaaatcacataacaagctagaagatttgcaataactaaggaattcttatagtgtggctactcgaagaaagacttttgtaaggtatttctccagagttttg

SEQ ID NO: 10813 - DNA, 1501 bp, Oryza sativa
tagtgtggtagaacagataccactacctctaacattacatttatttaatgtaacataggttgttgttgactttatttaataagacttttaaaatttttaccatcaataattctcaaatatttagcttgcagaaataaaaataaaaagtagaatttttatagttacttttacaatatacctcttgaaatttttttcattcaattcatacattttccctatgttttatacaactgtatttctatgaaaatattttcttttacaattgcgtgtttcaaaagaaacctttatcattgtgttagattttgttgttatcatcacatttatcaatatcacaaattcaattgcaaactaaaaaaaaaatcacaccagtaatacatagcaaatcccttaaacatatggcgctattgaataattcatgcaaaattttgaaaccttgatcactaataattctcaaatatttagcttaaaaaaacatattgatagattttcataagaacttttgttaggctaccttttcttggtagaaaaaacatatgattcttggaggattttaaatcctttatggaaaatttctaggaaaagctctatggccccatcgtttggcttatttaggaaataagccaaacggcatatttacaaactaaaaataatttataaataacgtgttcttagcgattcaaaagtaaatgctgaaaaataaactttattgaaaaaaatcccaaaattaacatcaaatttaaggttgaaaatttaaattttcattgataagcataagcgtaataaaaaaaatgaggctactaatctcttggattatttttttcaaagtttacctcaatcatgtgcttcctatatttttccaacggtctatgatcttttctccttttgcatttttatgtgttatgcagttacatttctttcaaaatcttgtgtattttttttctcatttatgcttttttttcatccttcatttcaaagtaagtgttcatagggtgagcacgtgcgtttttgtactgattgaatccaacgctaatccccgcgcaaccaactccagcgagcgaggcaaaggaggcatgcggcggcgcgcattggactagcggagagataaagagagaagagaggggcttgggtaagagacggcgatggtggcagccgcagtctcggtgcaaatccagcgacggggtcgagctcaccacccggcggagaaaggtggagctaggggggagtgcgggttacaacctcaaaatccaacaggcgcgctactgcgggagctagaaggaagcgggggttgcaaccttcaaatccgaggaccacatcgcggccggagcttgaggggagggtgggtcccttgcagcctacgggggttgggacgggtgatgttttccaactgatcacctttgtggggcaagggcccaggggagggggtgtcgaaacatgatttggccaataataaacgggggtagcgcagagaccttaaaagtggaaggatgtgaagacaaaggat

SEQ ID NO: 10814 - DNA, 1382 bp, Oryza sativa
ctgcaccccatacttatgtccttgaccaacatcgtatctcccataaatacgaatctctacattatcctcggtccattcaagaactttcacttaggaccttagttcatctagagtcgggcgggtggaaaacaaaatggtcttcaatgacatatcctcaaactcaacatgtgcaccaacataaggttccaccactctaccaccatagcaaacacgaacaagtctatccatctacacaaaaaaataaaacatgactttacaacaaaaattacatcatccttgctaaacgtagtccaaaccgataaattataacaaaatcataatttaaattgtcccaaagctactacttcacaaaaaatatttaatccacatccaaaggtaccaactagattactagtgtattaaacatctaagtattacaaatactccgtcatacaacatatcctaattctaattaactttaataaatttctataatgctaccaaattcgtctcctccctcatataattcatacctaaaaaaaatctttcatgtctcaagtcaatttttccatccatcaatccaaccaaacaacctaaaaatccaaattaccacatatatagttcaaaaaagagtggcaccaatgagtacattgcacacatgtagcactataatcagcaaatccccaaattgaatgctgaaaatcacaaatttgggcaaaagagggttgtagggttaccctccgatttacaaatttcaccatttaaaacggaaaaaaagaggggggaatggaggagtataccttgctcttcgatttccacaaaaaatcccgtgaaaaaagcctccaatttgagtggctttgaggaggagaggtgaggggggagagagatggagagcgcactgctctggcttgggctgggaagagttgcaaatggctggggggaggagaaaggggtggggcccgcgtgggttaagggcacggcccacccagtgggagcgcgccaggacgactggagcccccctcctgccacgtcagccggctcgcctacagggtgtcaccgcggcacgggcacgacgccagtgtacctggcacgccatgttggagggcagcgccagcctctctagcgcaccaaaaaggaccattcctgaaatatgtttttctagaggtctatttctacaataagttttccataaggagcaaaatataaaaaattcagtccatctcttatccatagctgatatttgcaatgaaatttcacatgtcacctaaattactctgtgttttagtggtgctttctgcatgccaagtaaaagtactcactattgtgctcatgagaaaaggattttatatatatatatatatatatatatatatatatatatatatatatatatatatatagga

SEQ ID NO: 10815 - DNA, 1501 bp, Oryza sativa
ctgccccaaggccatcggccttctcctttgtctccacgccgtgtcgccgcttccgccgccgcataacgtcgccgtgagtgcgccgccggtgaccatcgggtcccgcgtcaccgcgtgcgcgtcgcaacaccataccggttcggctaagcccgagcccgcgcacccttcgctcttctcgcgcgcggccacgtcggcgtgccggcgagattggccaccgccgccggccgtcgtcgcgcgtcctcttcctgatccgagccgtggaatgagttccccttctccttctcctgccgccagtgctagccgccccttccggctcgccgccgttcgccggatcccgccgcgcgccgtgggccgtccgatgagctgcccggcctcctctcccttccccatccgacgtgacgtccacgttcgcgccacctcagccatcggccccacttgaccgggtcaagccggcgcccagtcagtcgccccactcctccccctctctcccgtgcttgtgggcttggcccatcagcgcaccttcccctcggccccttaaagcaaacaaaagtccacatatactcccttcgcccaagcccagtatccatcactcataaactaaaagtccaaatttgctccctctcaattttattctctattaccttcttgttgaccccacttgtcaatgagtcaaagatattcttgagaatgtcttttccaatattccacaaatatttctcttttctataaattcaataaatcatttttccctctttcagaaatcaattccttattccaaaattccatgaatcattttccttggtcagtgactgtcaataatattcttgagaatattatttccataaattctgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttcttttggtcctttgtttaggttttcgattgtttgcgtatagttgcggttatcgaattttcgtcgatcgcgggttttctcgaagattcgtgaagcttcgtgaagaccttgagcaaggcaagtcacccttgatcaattgcccctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcgctccacccttgtggtacctcggtaatcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattc

SEQ ID NO: 10816 - DNA, 1501 bp, Oryza sativa
agattatcatatacaatctcgtgctgcatcggttaagttcgacctactagattgttgttgataatataaatcttgttaagccgataggttcatgctagtgttttatcggggtgctagccgataagttatctggacgttgcatcggcttataaggattacatacaagttgggtttagccgatcgtaacaaaggtttcactgtttaatctaatcttgtggattttatgacatcggacctccagccgatatatactttaaccttcggatcaatgcttatctgtcatatcattattagccgattggtttctattggattatattattgttatattttattatcatcagtcgattgtcttcatatcattatctacattgaacatatagcctattgctcaaaaccctatcgacattgactggaatcggcatcggctattatcggctatcggctggaactactctatcggcttatcagccaatcggctcattgatctactgtttacatatcttgtcagttgaaggatcaaactgactggcacgcccgcacctcactaagatttggacctgcacaggagctaagcagatctcccaggccagtgtgtgtttttcgcgttaacaataacacaaaagcttcaagcattacctcgtggattcaaaaccttagaatactttagggtaaaaactgaagcggtttccacaaaattgtgaaatatttcttgttgggcgtaagaaccaccaacattagggtaataaattctttaattctatcagattaattgtccatggatttcgagggttggtacctcttataattaatattcacagctcaaggaggggaaacaattcattgcagtacaaatcataagttgatttgtacatttattatgtagattttatatctatttccattaatgagtacctcttataactctttctatataatggagttccatatagagatacgatgctcctacatttcaagatgtctaagcataacctaggattatctatccatgttatctatatcatgtttgctgctcaccaaatcctgggtggaggatttcatctgaccaaccaagatgtgaatatggtaggcctatgtttattttactttttagtattttccattatgaactttgatcgttttgttttgacatgagcataattgcaaactcatgcccttttgatgatagaggaagtcaaattggaaagtgcaatttgtttcgatgtatcgatacatatatggcttccttttctaaatcttctactcctaccatatgtggtttatgatgaaatttaaccaagtgctaataagagtagtttgcttacttcatgctataaatgccttttcatcttcagacaaggtttggaaaatctttgcaatcaaaagttggtgatgccacaaagtcatatgtaagtatatatgcacaaccattgtgttttattttatccttatagaaattattttccatgattttttctctctatttcttttgcttgtttct

SEQ ID NO: 10817 - DNA, 1501 bp, Oryza sativa
ttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacagctgttttactgctttcaactactgtttttaaatgctagctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagccgctcgctgctgaagtcaagcttcccggtttagctcgcttttatcttttccgctgcatttgtaatcttttctatttttgtaagacgtggatctggatgtcaacaattatcgtttgtgtaccctggctggtcctggacagggatttaatgcacattcagcttagaaattctggtttgagaatttctgggcgtgacaagttggtatcagagccgaccttgaccgtaggacaagccaactggaaaccctaagagccctctgaacccctttttcatctgcatatgcctttttgctcctggaattgttttgggaaaatttggagttttgcctctttggtttgcgggaaaaatcttggtcgttcattcggatcggatttttttttttaaaaaaatattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgggttcatgaaaaatgttctatgcataaaaatcatcatgttcagttattcgtttgagtcatttgttgcttcgtttaatttggatttgagcatgaattggttcctatcccttgtctactttagatgtcagtcctactcgattgcaagcgccgccccgagcttcagagtcgcctcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 10818 - DNA, 1501 bp, Oryza sativa
ctaacaaaatagaaaaaaatctatatgcatacaagaattaaaataacagcttagtttagattaagaaataatttaacacaaagactacacaactataattatctcttttagaaaaactaaaaattgaaacattcttaacacttttggactttggacagatggtgtggttctatacagttactaatcctagttgatatctttcaataaaaatacatcaatattcaaacttgtttcctgaatcagactcaaaaatccaaactcttgatccaaaattaaaagcttgttactgccacgtgtgggcgtggctggtcaaatcacacgtgagcagaagctttggcgcaagaagcagagtaaaagtggtaatcctaatcaatttctcctcaaataaaagaacaccaaaattaaaactgtcttttgtaaatcagactcaaaacgggaaacattttaagcaaagatttgagagttttggatcacttacggttgaaccagatgttggaggcgagctcctcggccttgcggctccaggtgttgaagaagtcgaggatgtgctccatcgggctgtcccctctctccggccgcccccgcggcggcgccgccgccgcctcgcccatgatgacgtagggcgggagctcctggtcgcccctcgccgccgtccaccgcgccgcctgctggttctccgggtgcgccccgggcgccgccggcgggcccatctgcctcgtcccccacttcgccgcctccggctgctgctgctgctgctgcggcggcggcggcggcgcgttccccgtcgtctgaggctctgccgccggcgccggagccggagccggagccggggcaggggcgggggtggtggtggagtccttgccgtccatggctgggtgagtagctgtagctacgagagatcgatgaggaagaagggaccgagagagagatggatgatgctggaattgtttggaaattggaaagagcagagatgaattggatgagcggtgtgatgggtttttatagcgtgggccgtgctgtcggtttggatgattgggatgtggattttcagtatgttccttattgcttgcatttttatctaaatatttataaaaaaattaatttttaataaagatagattaatataaaatatgtcactacataaacgtatagtcaaaattaatttctacaagttgaaaaaaataaaattggaaataattatcggatatttgtagttatattttttttacaacttgtaaaagttgaatttgtgttagcatatttgtgtaatgatatattttatattaatttatcttgtggctttttaatattttatctataactattaacatatacaaaacgagaggacatataatcgagggatgaaatcacttttccggatgattggcttatttgtggagaggcctcctgtttacctctgtacagaatccgttgtctaaatttaaattttgaaatttagttgtacaactgattttaaagtattttttatcaaaatttattt

SEQ ID NO: 10819 - DNA, 1501 bp, Oryza sativa
ttctaacagatatatgcattgcaagcatcacttgttctcctctattttggtaatattgacggtcgaaactgatcgataacgaccgtcaacaattatttacatgtgtgatgcgagcaagatttcttttatgtatactatgtacttagtatactcttcaaccaatggagaaacaaatattttctatcttaatttaagagaacattgtaccaaaaaagatatataaaactacaatattttccctatgacattggaaaaatattgtggtgacttgtacgctaaagcacaatatcatcttggatacctttccaacactatctcgtcttccatgttgtattgcctacttactgcttccgtagggtcccctctacttgacatgcaaggccttgcgatttgagatacattacacatacttggttttgtattatctgaagcaagtttcatcttcacttgcaagttttcaagtgtcatttacacttctctcattggctggtcttgacggttaaaacagcaggagaggctcctactgcgcaaatatattaaaaagagaacggcaaaatacaagggaaactgtacagagggaatacaacaggggggaagaaagaaagaagaaaagaccgcctgaaacgcaagctagttaataaatgctattaatccatgattgccacaatggtttttctgtctcctttactctatgcaaatgcagagtaaactcatccttgaaatcagccttccatttgccaaattttgcttggataccattgaagatcaggtcatttcgcctactccagagatgccagcaacaaattgccaaaacttccataaagaagggatgagggaagttcctatatgctgcaatgatcatgttcatgaaattcagatttagatcccagattatgccgaggaaatgccaacattgttgggcaaaggggcaggcaaagaagagatgaagaaagtcttctgtggtcgagttgttgcatgtaacacatgaagctcccccttgggtattgaaatgtcttcgttgcatcagctctttagtgtttaatctgtccaataaaagtagccaaagaaacactttcaacttgagtgtgcatttgcttttccagatgagagtcaagggaatttcaggttgaatatgggtgaaaaacaggtcatagactcttttcggttgataatggggagagttccaaatgtatgtccattggtcttccatatgatttgagtttaaagtttgaagagtgatagaaagaaggtggcattcctgaattgcttggatggggagaggagtataaaagatctcatctaagtgattccgagatttgaaacctttgatagatatgtccttatttttggcaaatgagaatagggtgctcagataatcctctaaaaaacgccctgaccaattatccttccaaaaaggtgttgtgtcaccatgttaacgactaaatttggtaatatatggactaggtttaacattggaatcaaggcggattcggcaaggaga

SEQ ID NO: 10820 - DNA, 1501 bp, Oryza sativa
  unsure (1)..(1501): unsure at all n locations
gatgctagacttactatttttttaagagataaacttgatgggaggggaggggacgatgatgctctggttactccctctcccccggaaggttggaattgactatggcaaggctctcgaatcccaaattctggattttttcagttctcctattcatttctctccccacttaggctctacccctttcaagttggtggttgattttgtgaggttcaattttcgtctcaccactaaattggtggccattgctctttaatcctgccttggtggcactcctcacagttttgaggttcatcatctcaagggtaacagtttatccttcctggtttgcaacaaaagggtggggcttcatatctattctcttcgtaattttattggcaaggattttcatgtcagatttttcttatggagcaatggtggtccgaattggcgcaaggaattcttatcttggcaattagaagaagcaaatcaatggaccttggtttccaagcacaagcgtccttctgggtttcagcaatcttatgcctcnnnnnnnnnnnnnnnnnnnnnnnntcatgtgggcaaaccctcagtgttcaagagactgcttcttgctaatggtgcttcgtttgatcgtatgaaagattgctcttcctcaggtctctctagcaccaattgtcgatccaccttccgctgtaaggcctgccacaattatggacatttggcccactcttgcctttcgcgggttaggaaggtttggaggaaaaaggcctcggaaactttcacggagaaatcaaaggacctcattccttattcagtcgcttcgccttccgttctctctcccactacctcccctgccaaacagtgtcatctccctccctccgccacagaaaaccatctcctgcttccttctccatctcccatggcgaacctccctgatgccgagttccggccggagctgtttcttccccacggcaccaacatcgaaatcccctggaatggccgctcgcctcgggccgacttcacctttcaaggtactgtgcacaggacacatgaaaattttgctgccgtagtcactgatccctagccccctgtgcattttctcggtcagttgatccatgaagttgcaaatattattgagcattagcatcgtatgcatgttgttaggatccaaaggtacccactagctctctgcattgtgcaactctcctccgccctggctagggatgttctagttgctagtgagcctgttctcttgggtaattggttccatgcttggttcgtaaaacatgatcagttagcaaactggcataatttccctttcactagagaaggttggctaatgtttcttgggattccgcttcatatgaaaactcgacaaatcattgttcaagccactaaccttttggggaattcatagactggcattatcaagacagggttctcgggagggttttggtgaaagccaggtataagattgtcagtgatatgcctcgtaaactggttatgagtgacgccatggctt

SEQ ID NO: 10821 - DNA, 1501 bp, Oryza sativa
ttttttatgtgtttatcacctacgagaggaaccaaactgcatagcaaaatgacaaaatctacttggagggcatattatgatatggactaacatgcaagattattgcagttgcaggagctaatccgatcaatcgcaaacaacaaaacattagataaacacccagcacagctaaacatatttgtcacactaccaagcaacatcatgttattccactaataacaaagcatgtggctacttcacctaatccaattaagatgcatctccaaacacttgcaaaagcattgcagttaccatttcgatctcatctttccacattcacaaatactaccactccacggagagaattcgacaacattaaaacagggcagttagcatttccatttcacctctttgcatttgtacacaacactagtgacactaccatgggcattgggccaacactaccatttccacagggaagcacagatcaaaccttcctccccatctattttacactttttacacctcctaaatctattcggcacggtgacacccacgcatcctaagtttccgacgaagttagggccgagctaagctactaccaacaccacaggaagaacggttttcacctccgtggcggcggcgggggaggcggaggcagagcgggaggagggggcagcctctggatggcgcagtagagcttgcggcgggccccgacggcgccgatgcccatgtcgcggaggtcgtccatggtgaggcagggcagcaccttcccgtccacctcgtgcgcctcgaacgccgccgcgtaccttcccatcccgatcccccacagccactcgaccacgtccaccaccttccctttagccgcggctttcttctcctccgccgccgccgcggcggccgcaacgctctctccctgcacggcctccagggacctcggcttgcgggggaaggcggcggcgaggacgaggtcgtcggcgtcggcgtcggcggaggcggggttggaggggttgtggtcgttgtcgtcttcctcgtgctcgggcttggggtggtggggttggaggtggaggggtttgcgggagcgggaggcgggggtgatgggaatgcggcgagggtgggggaggtgggaggggagggggatggagccggagaggcggacgctggggcggcgctggcgcttgccgccggggtccggctgcggcggcggcggcgaggcggaggaggaggaggggaggcggtggtggtggtggggcccagcggcggcggcggcggagtcggccatgttggggggggattggattgggacggaatgttgggggaaatggggacaggtggtggcgttcgtgtcgtcttgtgcggttgcctcccctttccacggccacagctactaccacgacatgtgcgagggcaaccgccagtccgccacgagcagatttgcatatcccaattcccaaacacacaaaaaaaatcaaggaaaataaattattgttgtattattttattaccataaaaaggttaatct

SEQ ID NO: 10822 - DNA, 1501 bp, Oryza sativa
tcatcatttatttgccatcaaatttgacatatccttggacgtgctagctatatatagctagctagctggtcctcctcacacatcatgctacagtacgccgcgattcgctgttcaccaatcgcagccagctatattatagcttgacgaagaaattagtaccatatatatacaactaattatatatggtccctatatattagtattattttgatactatacgatcgcctaagagtgtgttagcgaagaagtagcgtcgctgtgtcgcattctgccttaattacgtagggagcgaaatgatgggatgagagatcgttgtagtacttgtatattccccaccgacacagcagcctccctcattggtgacactgtgcatggggcagcgaccctgtaggaaattaatcaattaattcaattagctggtactacctccatacttataaaggaagtcgtttaggacagcgacatggtctccaaaacataactttgacttcttatttttataaaaatatttattgaaaagtgatatatgtatactattatgaaagtattttcaagacaaatctatacatataatttttacattttcaaactcatcgacttaagagttattaatgatgtatattcctaagatttgacttaaacattgtcctaaacgacttcctttatgagtatggagggagtatatgtaggggtattgtattagcttgctagatatatatatatagagagatgattgaacaactaacaattgtgtttagaaaaagtactaattaacacctgtaatttataaggatttatactattggatattttggagtaaaatgaagtttatatgcatctaattattttcttaattaatctgtagtgccttttggtttcttgtcattttgcgagtttttattgacagtcctatgagctgtaaatggtgtaattaataattagttatatagcttcttatgaattaaatgtcaggaattctttaactattttttaaatatcttctcttaattaagagaatatatgatgcatgtactagctcgatatacatcacactcacgcaattaaaattattggagacatcaaatatctagctatatatgtgagtgcaaaattgcaaatacacaattgctttctaagcatgcataaatatgtctaggacttgaatatcttaattacaggttgtgtgcaccctgcacgctgttagccgctagctagaacatcacacaaaccggccagcttctagtgccactcaattctttagttgccccattgcttgcaaattatctcacaagcaccctttccaaatatgactgtataattaactaaccctaatatacctttttagggtccctaactattaaccgtatgttttacttcctccgttttgcaatgtccttactccgtttcacaatgtaagtcatttttagcattttccacattcatattgatgttaatgaatccacacacacacacacacacatatatatatatatatatagga

SEQ ID NO: 10823 - DNA, 1501 bp, Oryza sativa
tttttattataaatgtttacatttagattatattttcaaaatagatcttcactctattttaaacatgttttagttaatatctggttatgacatattacatgaaaccatacaaccctaaatttatgacaatgacatgaatttatgagaacaacatgtgtcacgataataaaacaataatggaataatggagttttttttatttctatttgtactatatgtgattttcttacctgaataaagtgttttttaaaatactaccacgataaaatctccaaaggaccatattgttggttatattttgacaaatatatataattttgcatatcgtatttttcaacgcctttcataatcacataagatacctttactaattaatttagagaatgaatctattttcccaaacttatttataataactaattgattgaagtataattcatagtcacatcaatagagtgcatgacatacattcatcaaattatgtctgataagttggaattcctcaactataaaaaaaatatatcatgagtagtttattgcgcatgttaattgattgttcatttgttatcaaaactatttgacaaagagaaaaacatacatatatgaccataaatcctatgatggactaaatggttatattatagcaagatcactggcttgaaatatttttcataattattttttacatttatgtaacatttaggttgcccacttatcatatactattgaaatagttctaacaattaaaaaaaagatgagaatcttaatctcagacatattaaaactaaatcatatctgcttaaaaatacacaactaaattgtgttgttttcaattattttacatatagagctttaagttagcattatatagtcatcaagtgttatttgacacctagaatatgatgtaaaattatttgaaataggaaaagtacaagttaccccctaactattacggtcgactgaattaccccataaacccgaaaccagacatctttcaccctcaattattaataaaagatgaattaacccacccctccccccaaaaaaaactcaacctggagtaattttagccctacatggtagtccagtctgtatttaaaaaaaaaataggtggggccatatgtgacactctgtaccctctctacccctctcctctctcacctctctgcctctcttcctgaatcccattccccagcctctctcttctccctcccattgctactggaccggccgggtaggcacactgtcaccccgccgctcttctcctcctccttcgtctattcccctacgcttgcttgcttgattgatccgcctcgttgtctcatcgggagagaggcattggtgatggggatcgattaaaaaccgtggtgggacgacatgctatggtagacatagctgcggccgtatttgttggccaagttctagatggcaggggtgtagcagaacctggccattgaggaccagcgcaggttctcgcctccggcacctgcaactctcatca

SEQ ID NO: 10824 - DNA, 517 bp, Oryza sativa
gtcaaaatttgttcaaattcagtcagaatatgttaaaaattaaaataatttcagacaacggacccagaaatcataaattttttaaattttcggtaaccaccgaaattttggtggcaaccaaaattgcaaaccttggaaagtagtagtagttgggacagttgaaaattgggtggaacattccatctcttagctgaaactgagtactcactctgtaatctactctataattcaccaactcattttactcatctctcaaccttacactcttacaccttaacggctcatattcatatcaaacggtcccgatcttctctgtgcaatcccaccccatcgcggtcccgcacccacgccccagcggagagccgcgccccctccatctcctcgctccctgcctccccactcctgcgacgcgccaacgcctcctctcccacgcccttctgcccaaaccctaatcttcctgccgcacgggagcaggttccctctgctgccaccagctggtgcctccctccaccacagc

SEQ ID NO: 10825 - DNA, 778 bp, Oryza sativa
tttggagttaattttgtggttttttatcctaatttattttacaacatttgcttttgaatcgtatataaaagttttacccaaaaaatatttttttgattaataaaaagctgtccggatatgcataagcataagcgaaaccatagggttgtaatattgattgccgttaaatacaaggtgctcttttattttgagtattgtagagatttagtgctatgcatgggacagcgggtcatttttgttctggattcacccctgaaggcaactaagattaacagaaggatttgatgccaatagtaattctatttctaacaaataacattaagacaaacaaaatcatcacttcatactgggttctggacctcttggcatcctcatcccctctaagatttcagacatcatcacattcctttgtgtacatatgtaagcacaaaacacatgtcgtagagcttccaactgtcacttgcattagaaaccagtcgcttcatcctagatcacaccgctctaacttaatcttagctaaagtattaacaacagaagatatgatccagtgaaatgtgcaatactattcaggaataatttaataattcagcagacttttcaagttattatagatgaaatggtcctctttctgtttctaattgccatcggtttactatcaaaatgttcttttgcaggttaaacctatgattttaactattccagttgtccctcaccttcaaaagaatccatccaatcagaacctgatctaattagtattaccaacacaaagttaggaagt

SEQ ID NO: 10826 - DNA, 1262 bp, Oryza sativa
cccggcaagctcgccacgtatacgcgtactgcccagattcccccaatccagtccccccaccaaacccaagcccggaaaccctctcccgcccgacacgtgctccccccgccaacccgtggtgcacgcttccgagcggatatttccgcccccgcctcggctgcacgtgtcggtctcctcgcccggcacctggcgcaccgtgaaaagcccagaatccggcacaaaaccgcggataaaaaaatttgtcgccgcagcagcacgcgcgggcggggccggcacgacgggggaggagacggatgcgcgacgcgcgtcgcccccgaaccgcccgactcgcgcgcggcgagcgacacgcggccggctgcgcgggcgccgtcccgaggcgggtgggggcgcgcgggcgcgggcgtttttttccctctccgggattcggcactgacacgtgtgtacctccgccgagtcggtctccccgcccatgaaaatggcctgtttcccggctcgtctaccgtctccccgctcttggggcgcctcacgagtcaagccggcagcacagcacgcccagctgctgtcgattaggaaaggtggcgatggagttaagtaatgtgacgtctgacagcggaggctcgtgtaaacaatgcgtgcgatgcttgattgatgcgtgggacgacatggacacccagaaatagagaagcaaatgcgtgtagaaatggcaactgccgggtcgtgtgacccggattttgtcaggtcgtgacgaacagtacccagattgggtatggattaggtggtatgattgagatgccacactgccttactagtgctgatgagatacatccttacgtttaatgaaagagctaatacttgattttgttgaagcaaggagattagagacgggggatatttggacgcagaaaaagttgctgctcgatgggttatgactttagctttggtcgtatctacgatccatctagcccgaggatggatatagggatcttgaagctcgagtggtccatttgtcaagcgcgcgaccgtgacacggctgcctgggcggtccgccctgccgcgacaccacgcctttcggggagcacgagaagcccccgccacggctgtatatataccgcccctcctggcgtctccgcctccgccgcgttgcgagctgcacattccgctgcttgcttggcctacgtgcgtgcgaaccgacccaagtacccaaccccaagatacctgtgcgcgcggcgctgtggcgtgacgctcgcgagggtgtgaagcga

SEQ ID NO: 10827 - DNA, 1501 bp, Oryza sativa
actccaagtgtgaaactaaacttttacagaaacttccatgaaaaaattttatgtgtgtttttgaattatcatgctttttttttctcttttgaattatggttacagactacacaattctttctcttcaacaataatccgatctcattgggagagacgatattggctttgtcttccgatctcattgggagagacgatattggctttgtcttttgagatgtgtaatttgagagtttggtcatcggcggtctattctaaggctgagtttgaacctccgagttcacaacatttctctctagcatgaaaaatggagtggctaattagcatgcgattaattaagtattagctataaaaaacttaaaaaatatattaatatatttttttaaagtaactttcctatagttttttataaaaaaaagcattgtttggcggttgcacatgaaaactagagtaaaattaggaaatggagaaaataacacaccctgagtcactggtaatggtggcagcatgggcgttgattggtttttagtgtgcactgctactaagtatatttcctcatttatttaaaacttaggttattccgccattttacgaaagatatggtcatcatacattaacagaatattgggtggttaatttgttttaacgagatggtcagtgtgaacggggccatgtacaagtacattcatatacttaattgttactgatatagtgtgatttggtgcacataaaacaaatcaaatctctttagctagcttttattttggatgattcataatgcatgacaggacaagagaacggtatatgataggcttgaccttacctgcaattctatcaacccttttgagcaggggttagtgcaactgtttcattgtataaacacaatttttgcactaaaataatgaacacaagtttgagagatcatctgtattgtgccgggacccaaacccattcagctcttgtagagctccttgcaaatttttcgatcctagtcggttaaggtgctatgccattttatattttatgtattacatcatgttttaaatattatataaaattatatcaataagagttaatcttgattggttgaatgtagtgtatttaatgatagtcatttatttcacaaataaataaagagatacttattaaaagataattattgtaacaagatcttaaatatcttagatgatgataaaatgaattggagggagagatcaactgcattgatagtggcaaccgacacgtccattcgggaggcagctgctcctcgcgcgccacgcggccccttgttccacccttcacctgaccacgtgtgctccacccggcgcaccggcccacagccaggacagccagcttcatttcccccactggccagtggccaccgctacccgttgtcacgcaaggatccaatgtctgaaccactccactgggaagcacgtcgaggaatgcgcgagccgacaacgccgccgtggggagcacttcccatcgtggtgcccttcctaga

SEQ ID NO: 10828 - DNA, 1032 bp, Oryza sativa
ttcaggtcaccagagtctgatggttaattttcgttggacaaagacgtgatcgacatcacgataatcttttttagaaggaagataatttaggttaattaagaaaatacagcaaactgaaatatatgtagctaggctagctacacctaaaaaacacacacatgataatgcaaaatgccacataaaatcaccaacttttctgagcgagaatttgtatatatcaattaatataattagtggaatgcagtttatctaaattctagcagcctaaaggtcaaattaaataatctgtccaaataatgcaccacttcaacctaaatgtaaagaaagataactaatggtagaggttttatttgaaaggcgagctgatatcgatcgaagttccattggaattgttagagcatggccaacaattctccaaaactcctctcaatcccaaaattaggtgattttagttgaaaacatgggtccaacagcctaaccacctgtccaaaaattgaaaatcccttccagctcgtccaagtcgctctacacaagttgactcgcactcatttccaatctgcaatctgtgtggtatcgcttgagagaaagagcgagcaagactagcgctgagggaggcaaatcgtgcgcgggatttataggtggccacatttttttatcttagagagtcaaatttaggctatatatgggaaagaagtatattttttaatccttaaatcatcgttacagaattcaaaaggagatttaggggggggggggagatttttaagcattcttggccatactcttaggtgagcatcttataaaaaaaatctgtaataaagatggtttgatcatgtattcatgtgatgccctgtaggaaccgtgcatgggtaaacatgcacacaggggggcagcattgatgcccaaatgctcatccttcagcatgatctcatgatgcttgcctcatcagtagtacaacacaacacatcaatgcaataaatccatatatatgaatgtggtacaaagcatatgcatagatgcattggcatttaa

SEQ ID NO: 10829 - DNA, 1257 bp, Oryza sativa
tcaacggcgtcaaatatttagaaacggagggagtatatactatacataaattcatttctcactcatcctacgtctatgtataccaatacaaaaccaaaaaaattaaaatacctccactttatcaaatcctaaattaattattttttcttatatattctcaatatatttattatctactttcacaaactatgatataataattactttaaaagataaaattattctataaaagatggaaggggcttaaaattaactattcttagacagaggaagtaataaatatcaccaaaagttttgaattttttatatgtacttataaaaattgtacatgtgcatagattactgggaaagtattgtagtgaaaacctggatatcgtatagtgaaaaactattttcacacggtcaggagaacgctctcgcttgaccagatcaccagatagcgaggaggctatcttcaaaatttcgaacccgtgatacggtatcattcggccgaaaattttaattttccatgaattttggcaatatatattcaaatttgataaaattttgtttaaaattcggaccggtaacaaataccggcaccctccgatacaaatacctgagttgggagcgacatgtgtggctgtcaagtcagtgaaggggaaggacgacacgagttaattatagctccaccaaaataagcatgcattgggagttaaaaaaaaggattaacagactaatgctttaatttttaacccgatttaattgcactggatttaatacttaggggtcaaatatcggcattgtgattcacatatatgaatcagatacagccactaattaagggacacaaagtggacttatttccaatagttttatagcttctgagcctcttgatgggcctagcctacccccggcccacgcaaactgcagaggctgggtggtagccgttggccgccgccgccgccgccgccgcgtggaggggacgagaccggcggtggaagcaaagctttgcctccctcttccgctagctttccttccaccgccaccgtactcgccgcatcgcgctaggctggagccatggaatccagccgccgccgccggcaagcaacccggggcagtcacgctcacgccgcggggatggccgcgccgcgccaccacgattccttccgtgtcgccgcctccgcctccgcccccctttaacccgcggagctgcacgctgcgtgcggatggtccggaggaggggcgacgacgacgccgcggcgcgcgagctgaggg

SEQ ID NO: 10830 - DNA, 1501 bp, Oryza sativa
agtactagtactactctactaccgagtaccgacaaacatacgctccgtaggaatgccaccggaagtactcctacgccctaactttacgtataccgtatcttgtcagagaaaaaaacggacggcccagatgcactgcacgcgccacaccggtcccaaaccttcccaacgcgcgcggcgcatcggacggccaggattcgccgcggatggaccaccgtccgatcttactccccaccctgtcgctgtgtgcctctctctctctctctcccgtgtctctcgccgcggcgtcctccggccaccaccccgcgccgcgccgccgtctacggatccccgctcctcgctcgagcgagcacgaaagccctagcgcgccgccccctgcaccgggtgggttccccaggtgagcactccattcgcgccgcggcgccctctctctctctcgttttgttcccacggatttctgcgggggatctcgttcttgggtggaaatgggaggagggggttggggttctagttcgtttcaaggtggttgttgacttgtggtggcgaattgggtgggttttgggagggttttgtgtaggattggggggggggtgaggtgaggttaggttggtggcgattcttgatttgttcttgcgcggcggcgatcgggctgggttgcgtctgtcctctcctaggttttttttttctctttttcgctcgtgtagttggattctttggtgggttcttagcggaagtttactgttttttgacggagcggtccgcaggaatgggggccaatgttttgattttggggtatctctgcacgccctaaaaacaaaagagatttgaagggagagacttccctccaaacatttttttaagaagaaattgtgagcgttgttggggattgaacacatctttgtagcgagatgtcggcttttatgttgaaagtctgaatggtacatttttttgtatgagcatacatggtttattgtggggaagtataagtgtgtttctagtatatgtttcttttttatttcaccattctgatttaggtggtatggtggatggatttttttgctacccttatagggtcttaaatgactattccgtagaagaaagttaagttttttttttccatatacttttgtttgtctctttatttaggttttttttttggggggtgggggggggctctactagggagtttagttcatataactgttggtgcactagttcctcatttatgaaggaactgctgaatttcatcctttcaggtgtgggcacctatatgtgcgttatattttactttatcgcaatttatttatcaaccagcattgactttgattcagagatcatgtcggctttgcaggtttacttgtttttatttttaaaaataatccaagggttttcagaatataaataattgaatacggtcaaatgtgcagctaactaattatcatgaaatgccatcaatatgtttaaagacttacatagttacgtttagcaggttgttgagctagaa

SEQ ID NO: 10831 - DNA, 1501 bp, Oryza sativa
cactatacggtattaattaaaatttgaaaaaaaaaatctgacattagaaaaagaaaaaatatttcaattaggaatacaatttataaataacaaaaattgatgataaaaaataaaaactattgaaaaaaaagaccatctaaaacacatgacgagataaattaagtaacaggcctataaaagagtaaaatggtggctgtcatggttatggatactacatacctaatagtagttgactaaatctcggtaagacccaccacatatcatgtcctatacggaaacaaccttcggatataggaggagttccgataagaaaagacaaccagagttctacatggaaacgacaaggactactcggattgtatccatattggtttacctagttctacttggacaaggggacacttatgggtataaatacaagccccccttaggaggagaggggcgaatccacagacacccaccagggagaaccaacacaatcaacatacacccaccatgggacacgatcaacacgatcaccacgatcgagacccaccacaatcaacaaccaccacaatatacggaacaacagaagccaatacaagcctacatacgccaagacaagacgccagatatcgacttcagggataggcatagctattcccctacggtgtctccggataccgtcaggagagacgaaagcgctatctctgatctcgccggacacggattcgaggaagaaggctaccctgttgtcgactacgagtcagcccttcagaccgccatgtcgacaacagttagataggctaccccacatattgtactggtgtgattatggtgaataaagagcaacaccggctccggccaacaggatgtagggttattacctgacacttcaggggcccgaacctgtataaaaatccctgtctccgtctcttttacctcagtctcgctatatcctagtaccaacgatccccatactatgcaaataacagaattgcgacatcaaacgtcgacagtggcagttgatacgacatataaaaactgttaataacacacaaaatagaatcctaatgatgattaaaaggagggacgacaagcaggccgtgaagcaaacggacaaggcgattgccgggacttctagaaagtaaaaaaaaaacccattgataatcatattcgatttttaaaatttcaatgacaataaaaaggagaagcagcgtgcggagtatataggagtacagttgtagagccgccgacggttggcgggacttctagaaaataaaaataaataaattccaacaatagttatgtttgatttttagaatcccaatgacaataaagaataggcggcggatggccgtagaggagtacagtggcatcgtttgatgggacttataaaagttataaaaataaaacctaacaagacaataaactctaaaaaatataaggttcaatttttaaaggttcagaacttctaaaaagtaaaaaaaaatgataatcatgttggagtttaaaatctcaa

SEQ ID NO: 10832 - DNA, 1248 bp, Oryza sativa
catacttgcattatctttatgatctatattcctttgttagaaagagtcaagaaaatacaatggagctaaattcatgtttgcctataggttattatctatttctaaatggaaacaagtgatggttaagtagttgaaagaaatgtactgctagcctatgcaagaaaggttgataggatattccaagacgtatgttaggatcttattgttacagggagctagcatgacatggatcgtgctgaccaaaatgtcatagaattgtgtgttcttaataatgtagggtcaagtacaaaggcatggattctcaatggattatgatctgacaacacctatattaacgggccattattgaaaaagtaccggaagtatcacattttataaaatttggtaccttcaagtatttgttatataccttgaggtaccaaaatttttagtgtaaaatcttggtaccttcaggtattttcttaaggacttctttattaacatttcagatgagtatgttaatatctatgattaattactttattatccacgttatatacaaatgaatgtcataattcaattattcatgaatgtgcccttttaaatgatggaatttattactaaaatttattaactttacatagagttttaaaaatcaataatatatatagatttccatttataagaacatactgcagttccatccctatatatatatatatatatatatatatatatgacgcggttgacttttctcataatatttgacccttcgttttatttaaagaatttaatataaacatctaaaagtataagttaagattataatttctttgatgataaaacaagtcataataaaataaatgatatttatataatttttttgaataatgcgaattgtcaaatgttatgtgaaaagtcaacagcgttatacattttggaatggcgagagtatttcaataatcaaagagactatgcattattttaaatttgatagaatcatgcatcattctccgatctgattctgtatatattttcagtcctgtcaataaaaacgttcctgcctaaaatcaaaatattaacagcctacgtacatggcttgatggttagcatacacttcccgtagtagtattaccgaactagaatgtgtgtcaggtataaaatgtgagagagagaggagagagaagggggggggggggggagagagagagttacacttgtttctaccttgattgaagcaggccggcctatgcaacaagctaattaaga

SEQ ID NO: 10833 - DNA, 1501 bp, Oryza sativa
cttgggattaaacttttactactaataaattctcgcgatctaaaaacatatcattcttctattcaatgaaattggcggcctcgtcgattcgtcaaaaaaaaacatctcatccgattgaaataataaggggtggattagtttctgggatgatgatcggagagaactgaaaatttttttttggaacaattacacgaacacagcatgatcgaactatgcacgtacgaggagcgaggattggggccatacctaagacggatgcgcctcgccgagcccgcgccttcagcgcggcgggaggagcgatcccgatccagccatcggatcgcgaactccccggcggcggaggcggaggcggaggttttcccggcggcaaaacagagggcggcgcggaggggcactgtgcggcggacaggtgggtcccacacgatgagcgtgaaccgatggttgtgttgtgttttgggccttgttctatggtggcattggaataagttcactttgggtccctctatttgtcgctcagtccgattttcatcctgaaccacgaaaacgggtatgacccgtcccccaacttacgaaaaccggacaggtccctcggcagtatagagggcggttttggccgacgcgacgcctatgtgactaatttgactcagtcttcatctgacgtggcattgacatggcaattcgatgtagaaaaatattaatccacatgggacccacatgttagtttaacgcacaaattaataaaaatgatggggcccacgtaggccccacatgtcattctcacccttctcttcttcctcctccctccctctccacggcgtcacaaggaggtccggcagtggtggccgacgacgcgacaacgacgacacgggagaaggctgggtgtcggcggcgggagcgctggggggaggggctccgcgtggggggcgccgcccgcccctagaagctactcctcgtcttcgtccgcggcgccggcgcagaccccgcgcggagttcagagccgtgcacgtgggcggaggggtgcagcagtagttcggcgccacgcggtggcgccagagatgtcgccactcgccggcgggaggcagcggcgggcggatctccatggcagaagcggcatcgcccatcaacagccggctcgccgcgggccgtcggcggcggcgccgccatggctaaattctcgtcggcgaaatgctgcatgaaatctcggcggccaccagaagcaacctggtgattttggttagctctgttaattaattaccggctaaataaacacatacttttccacttttttccttaaccatcgttcacgagcacggtgacagcccggccacctcagcctaccaccaacggcctcggcggaggagcgcacctcgcctccgcacgccggctgccgggctcttcgcaccggcgcggactccagcgtcatcagagcagctcactgaatgggcgcggagctgcgcgaagggggagcaggcaggcggtgaggtcgtggcgatggtggagg

SEQ ID NO: 10834 - DNA, 1308 bp, Oryza sativa
ctccaccacgctccgctgccacgctcgtccgccgcctccgctcgtccgccgcctccgctgccacgctcctccgccgcctccgctcgtccgccgcctccgctgccacgctcctccgccgtctccgctcctctgctgccttcgctcctccgccacgctcctccgccgcgctttgccgccacgctccttggccgcctccaccgcctccgctcgtccgccgcctccgctctggcgccacgctcctccgccgtgctccgccgccacgctccgccccccgcgcttgtcctcgccgtgcgcgctgcgcgagagaaaagggtagagagagaatagagagagagtatttagtgtatgacatgcgggtcccacaattttttaattaaaaaaacgctgattggactgccacgtgtacgccacgtagaccaaaaccaccgtggattgggtcaaggggggtaattcgtccggtttgcataattgggggtgaagaatgtccggttttgtggttcagggggggtaattcagacgatcgcgatggttcgttgggggggggttaattcatactttttcctttatgatatcctatatacttatatagttcatcctcacttagtgcttaaatgattaatctatggtccaaattatctttctccttttttcctctaattaagtcatatcacatcgctgtaaaaaaaagtcatatcacatcaattgtttttagcctttagatgattaatctacggtccaaactatctccctacttttcttcttctataaagtcataccacattactttttacgaatcaccattctacatactatttaaatttaaattatcataaaccacattaatttacttaatttgatgttatctagctatcttacacgttatatttttattgttatcatactaaattcccgcagcaatgcgtgaggtttcacctaattagtttagtttttgggctctctgagactagtgaaatcgtcattaaaacagacaaaatggcatagattgtgttgagattatgatcacactctgctacaaaatataaatattgctgcacgtttccgaaataaaatgtttatattttaaaacggaaatataagtatttctgcacgttttccgaaataaaaatgcttatatattttaaaacagaaacggaaggagtactataacagaagccagttaaaagagcgatagagtttaagaaaaagatgggcgattcatttggtgtgagccaaacattgatatactaacaatttgcttgtattagcttaccgattactaatagacaattagcttgagaatcaggatgg

SEQ ID NO: 10835 - DNA, 794 bp, Oryza sativa
ccaaccgggagtaaaaataattggtataaacaattatttttgtggcgcgcggataatatctggcgcgcggttcggggtactctttactcctgtttggtataaataaccgggactaaagatctgtttttagtcctggttgtttataccaaccgagagtaaaaataatcgggatctgtcttgaacccctcaacttcttgaaccgggactaaaaatgaactttagtctcggttggtaacaccaaccgggtctaaagatgctttttagtcccggtttttattagaaccgggactattgtgaaatttggccgaccgatcaaagatggtttctccaccagtgattggtgggtttttttttgttcttttgttttgtacgatccaattaatctagaacaactccatcattgttacgtttttattcccaaataatcatgttttgttttcttccatttggctgcccactctgaaagaccagggatatggtcttatgattttttttcctgctatatcatataaaatcacgcaatctcttacgtggctcgtttttattttttttaagaaaagaaggaaagtgtcatcataccttcgtacgtatgcacacgtaactacatgttagagaagatgattaagacatcttcattgatgcctaattaactaattagtcttgtgtagttgtgtggcaccttcggagaaacgactcaagatttgcctctacgtcatcttcattgaccaaatcatttcccttttctctttcgaatgatcattctacgttgtggagtagaagtctactttacacta

SEQ ID NO: 10836 - DNA, 801 bp, Oryza sativa
ctgcagccctctgctctctatagtttgacttagtatgggtttgagcttaccgagttcgggcctagggaggttggagtcatcaaccaatcaatttagttcgattactaggacggcaactactctcctccacgtgaaacatcattaatcgctacaacaccaagttctactgccaccgatatgaagaaagatgcgatgcatcaatcttcgtaacccgcgcgctagaatcaagaaaattactcgagcttggacatcttctcaatagttcattggactattgtcactgatgtcaccgcaggcacctttcccattggtacaaccttcatctctggccaactattgccaaccatgttctttgcttcgggatgagtgacttcgtcttcaccaccggctgcctgctgccaccaacttgtgacctcgccttcacggttggcctactccacgccgcttatgggagacttcgtctccaccaccaattgactctattgccccactgactggtggctttgcctccacgccggttgactccatcgctccactaatgggtgacctcgccttcgccacacaaggtcaacctcaaccgtgacagaaggacaagcgacatgctctggggctcaccagctcaaacatgaggatcacacattcaatcttgacttgttctagatacgtgcaatagtaattcatacccatgagcctatttcctatgcttaaggtatggaccagtcattacaccccacgagggccaccgactgagtacttgtgccagttgagactcagataccacctttatttcactatgcccca

SEQ ID NO: 10837 - DNA, 1310 bp, Oryza sativa
cctttgggacaaatgattgggtctttggaattcctttgaaattcctattggaatggcatgtttcatgggaatcgtggaggactcctagcatgagctccaagctcttggaatttttttctcaatgtctacctctctcttctgaatcctatgtttttcctatgctccatccaaagcggttttattgtgtagttttctcatgtttttcattccttagctacgatgacatttaaatcctgcattttcctattcccgtgtttagagaatcctatgtttcaaaggagccctaaattgaatttcaaatattctaaaccttaggaatttttcctacatgtgttgttaggaacaaaggatttgagcatgcaaaattcctatggattgctatccaatgcaccaattccataggaaattttaccgtgagttcatcattcttaaatccgtgtcattcaactgtgcatatgaattaattgtagcttaatgacttttcaataactttcatttataggagaggggggggggttgatgtactacatactattcaaatgtgtgaagctctacattgattagtgtaaacaatccgagataaatttcataaccctaacaactaatggcccctttgaatcaaatgattgagaaaatggaggaatataaaaaacatagaattctgattgaattctactgcaaaacagaggaatgttaaatgcagaaaaaaatacaggaatgattatttgattgagacacaggaaaaacttaggaattaaatgagaaagataggctcataggaaactttctatgagggtagatctcatgttaaaaatcctccaaaacttgtatggattgaggcatttcttaggaatttcataggattcaataatttttaatcctttgttacaaacggctatataggaaaaaattaaataggatcagaatcctacaaaatttctatgtttttcctttaaagcgaaggccctaactcttgtatatatatgtaaacaaagagacttcaaacacaccatacatttaggaaaaggcagttagtcctaaaactatatatatatagactacgggagatttgacagtgaaataacatacatatattttatttgacttaagtcagtcaaaataaagtagaaacagtaatatcttttccatagcaacttaggccctgtttgtttcagcttaagattattgtaatctaaattattaagccagattaatataagctggattataaaaagccgacatagaataagttgttaactgtttgtttctctagattattagttgtatgttagccgttagccacccaatat

SEQ ID NO: 10838 - DNA, 1501 bp, Oryza sativa
taaacctgaacaaatcatggacctgggcaacatctcaaacatctcaaaattttttagaaaacatcgtcagaagttactgatttattcattcattcattcaaattacagcatatatgagtcatacaaccaaatcaatctcaatcaaagattacagaatcaatttgcttctaatctcacaaagccaaacaataacaattcactttcaatcaggactctgcatcatcccagacggcaggtcatttccacaaacacctcgcgggcacaggaaaaggtgcgtcgttctccacaaactcaaccaccagtgactcctaccttggacgaagccgggcggcggtgtcacctctcgccggcgacgaagtgggcggccgactggtgcgggctctggatgcgggctcggacgctgaaatccatcgtggagttgaggccgccgaaatcgggacgtgtggcgcggcaggagcagcgcggcctcctccacgcgccgggctcgggctgcgcggctgcccgcctgcaccaccgcgccgtcaggcccggcggccggccgcctccacgcgcccccggtcgcggcggcagggcagggcagcctggtgcctctccggtcgcagcgacgcgcctcccagctgactcgcggcggcggccggacgagggcgagatgaagcgccggcgtacgcggacctgagggcgaggcgaagttgagtccgtctcaggctgcgccggtgtacgcggacgagggcgaggttaagcgcgtcctgtgcgcgtgcgggcttcctgttaggccgaaacggagatttttttttgcctgcgtgcgggaccaagcgccatctccattggattcgttttggacggccgagatacatggtatgtcacgctgtgacttgccttagctaagtcactgaagcggagtccgttggttatcctctcattattctatcctcttcggctggagcaagcttgactccaggtctcccacccgttgacccgagctcccctactctcgccgccggccgcttccaccacggcatcgatcgatcgcgggcgacgtggctgagtggcggcggacccgattcgcggcgcagcaagggcggggcggagcggagcggagccagcgacggcgcgaccgcatccactgtcccgatcgacctccgattccggtacggcccggttgatccagatgctgattttctccatgtgtgtttgggcgtcgttgcttggtccttcctgttactagtataccgtacagcgttgagaggtcgctatcttgcgctgctcacggtgatgagctttgcttggatcgattaggtgatgcagcacacggttgttacctcaatctagtctcgatttgacatgctacatagcagcttaattattcagatgtcgtttttctccatgtttttgcggttgcttgatcattcctgaatcctgatacatactaataaactcaagaggctcatttaagtgcatctgtgtgtacccgtgcaggcattcaacatcagataggccaaga

SEQ ID NO: 10839 - DNA, 425 bp, Oryza sativa
gccagtccgttcatcgccacatcgtgtggaaggcatttcttcttccccgtagctgaaattcagatttaaaaatacatagtctatatataaatacaatttaaaaatagctgaaattaggatttaaatatatggaatataggagcagggagcatttttacccgtggttcaatcgatatggtgcttggtgcaggtggaaaaagttttttttttttcgtatgcacaagactcactcagatcatgtgcttgtgggagttggcttcaagaggagaggaatgacatctcaaaagcgtgtttcgttaaaatgccaatatgaagcgcgtgatcacagccattttgccattttcaattccatatttgctgcaatgtggcttgatgagaccaaattacccctgctcacccagttgctgctgcttcgtcaccacagc

SEQ ID NO: 10840 - DNA, 1501 bp, Oryza sativa
ggaaggaccaagcaacgacgcccaaacacacatggagaaaatcagcatctggatcaaccgggccgtaccggaatcggaggtcgatcgggacagtggatgcggtcgcgccgtcgctggctccgctccgctccgccccgcccttgctgcgccgcgaatcgggtccgccgccactcagccacgtcgcccgcgatcgatcgatgccgtggtggaagcggccggcggcgagagtaggggagctcgggtcaacgggtgggagacctggagtcaagcttgctccagccgaagaggatagaataatgagaggataaccaacggactccgcttcagtgacttagctaaggcaagtcacagcgtgacataccatgtatctcggccgtccaaaacgaatccaatggagatggcgcttggtcccgcacgcaggcaaaaaaaaatctccgtttcggcctaacaggaagcccgcacgcgcacaggacgcgcttaacctcgccctcgtccgcgtacaccggcgcagcctgagacggactcaacttcgcctcgccctcaggtccgcgtacgccggcgcttcatctcgccctcgtccggccgccgccgcgagtcagctgggaggcgcgtcgctgcgaccggagaggcaccaggctgccctgccctgccgccgcgaccgggggcgcgtggaggcggccggccgccgggcctgacggcgcggtggtgcaggcgggcagccgcgcagcccgagcccggcgcgtggaggaggccgcgctgctcctgccgcgccacacgtcccgatttcggcggcctcaactccacgatggatttcagcgtccgagcccgcatccagagcccgcaccagtcggccgcccacttcgtcgccggcgagaggtgacaccgccgcccggcttcgtccaaggtaggagtcactggtggttgagtttgtggagaacgacgcaccttttcctgtgcccgcgaggtgtttgtggaaatgacctgccgtctgggatgatgcagagtcctgattgaaagtgaattgttattgtttggctttgtgagattagaagcaaattgattctgtaatctttgattgagattgatttggttgtatgactcatatatgctgtaatttgaatgaatgaatgaataaatcagtaacttctgacgatgttttctaaaaaattttgagatgtttgagatgttgcccaggtccatgatttgttcaggtttaaagtctggaatggacttatagtattgtctggtttatactggacatgagttgtgctgccatttcctccttttcgctatctctgctgtaaatttttagttcatgctaggtgggaggttccatgtcttgttatgatcagttgtcctatgcagcaatgttgctctgaatctctctctctgaagatgctgaatggagtgccgtcgttactgtagtgctatcgtgaaatttcatggtcagtagttcctgtgcatggtcgccctgatcaatagtgggtaggacatctttgga

SEQ ID NO: 10841 - DNA, 1501 bp, Oryza sativa
tgtacactgtagtacgtgtacttccatctcacgcatgacaagtggacaacaaaatctttggagaatcacaaccatacatgtatactagctagtactatctacacctacttgtaaagttgcaagctagctctacataatccatatgcatgcatgtatagctttatcatcttttgctttctaatttcaacgattttaactaaattcttttctccatgagagagagtagagtagaggagagagagaggagatagagagaggggccagcatgccagacgtacactccatgcaaaggcttccacgcatgcaagttttgcagcttactgcagcagcttccatccatcgatcgatctgttattgcatgcagcatacaatagggactgttttgatatgtgcccctggctagctctctctgtgtgtgtggatgaatgatgatgatgatgatttttgatggcatttggaagctgtgtgagagggacatgaaaagagagagaagaaaaattaaaggagagagagagatttatagctagatgatgggccaggattatgtgaactccaagcaattatgtgacctatagctaatagctctctctattgtctatgcttcattgcaaaacaaccccacaggggcatgtatgtatatgcacatatctctgtcccctcaactgatctccctgcccctcaggtggccatgataaccttctggctcaagggaagtgagaaatggaaaaggacaacaagagctggagtcaaagacaagaagactagagctctatctctctctcatatctctccttgaaagagcatggaaaatggttggttcacacataccagctacaccgtagtacaatgatgtatatactaaattgtggggttattatacgtacattgaagccgtacaaactgtagcagcgaataatttgtatgtataagtagttgctttcaatatgtagaatttatgcgtagacgcctattctcatgatttatatgaacacaaaccaatggccacatttatttattgatccaagcatgtcactacatacaaccttttagtgcattagtttcaatgcaacagatatactcagttgccttaagcgcttccttaggatggtgtattgctaaattatagtgtaaattttggttcctcgtccacaagaaaatatatacctcttggtatcgactccctatgtcaagtactataaaattcctcttgctaaaaacattaactttctcatatagaaaatccacgaatcacacattcgagaacaaagaaataaaaacgcaatggcttacacataaaggggcatcctataattaagctacatatatagaagccacatgcctagatgacctatgcgtgtgaacctagcattttacaacccttcttttatttcctctcttgtttgctctccatctacttgtccagtttctaagcaaagcacacacacgcacccatcgccatcaccatcatatcatcccctctcctcctctccttcttcctccc

SEQ ID NO: 10842 - DNA, 930 bp, Oryza sativa
  unsure (1)..(930): unsure at all n locations
caaaccggtaaagagaaaaagggcatccttcctagtgcaagaaaaggtgatgttaaaatgattgggtcgcagctcaaatgataagaacaaagagaagcgtttggaagcggcacaagtatgcaaaactaaattattaatagcttaatatgccgcctgatagcgacatcatgatgtgctagtttcttttgatctgttgcgtatattattgtttttttatctctctatctcttttcattttattatattagtgtaaccgcacagaagagaggaaaaaaaaaacctgtaaagttgcggcgattccagggaccttttccagtgcagcacggctgaaacaaataaaaagataggaaaataattaaaaaaaagggttccctccaacgtcgggatgagctctgnnnnnnnnnnnnnntgnaagtcnagagggacgcnaagtgcaatgctgacaagnttatatatgcttgcatggctgctgtgtgcaccaagaatttaccaaaagaagcctcaccaacgtgtatttcanattaccctttnagggcctgccgcagggatacctgggacttttttaatatcccaaatgttaaaaaaactctaattactacttattatgtaaaaaaatatcaagttaaagctgattgcatagttcaactggaccatatacctagctattgtgataaaaaaattctagagtagattatattacaacatgttgtatataaatttgcgaataattaggaaaacaaagcacctgatggattacctgaacaattctttttagccaggggtgtgaccatttctttaagaaaattaaataatgtgagctctgtcaaccaatgaaagggtttaataaggcaaaccttgtctggcatgactaatcaaaccagttaaacagggagatgcgtccaaatggccccttgctatatatgtgaacca

SEQ ID NO: 10843 - DNA, 1491 bp, Oryza sativa
tcaaattcgttgtattaggagaaaaagttatattttcttttaagttattttttgttttgggaccgagggagtagagctagagctacgaagggcagcaaggtgaacgagcgcgcgccctgcaacctccacgttctcccataatttaaacaggaggcatcaatcccacagctccattctttttaaccttttatggcagacacatcaccccacacttcaaccgtttttatacggatccccagccacagccaagccagcctgaccccaaaactaattttgtatgcttgccaaaggatcagccatactcactatagctaggcaaccccccccccccccctgctggctctaactccgaggcatccaagcctaaaactacagtggtagggtatctcacgtactaggagcacaattttaattacaggactagtgctactgggagtagtatacagtagcatagtgtgtataaaagtgtggtttaagtagcaagaatttgtgcaagtgataattaatcaagtgtcactttgtagcacatgctctcttagctagcactcgaagttgtcatgatagggcgatctacacaagatccttctactagttgattttgtgctggcaatttaagttgatcaagatcataccgaattttatcttttgatctacctaaatttttgcaggcattttttttatttacatgcatgcatgcatatgacaacataccgtgacatctagcttggatgctacctagttattttaatgagtttacctcggttataatttgataattacttgctttaaattttataccctatatatcaagccttccttgtgctatactaatctttggcatgtgagggctatctccccatgcttatactaatcgtggcatagcaatttatattaatatttgaaagatcgagatcgatccttatgggatctaaaactaaaaagtttacaataaattaagcattggatcctagagtataaccagagctgcacatgtaatttaaatcgttgcatctgcctctaatccttcttttctctaaaaataaataaagtagacaaagagcatcacacttatttagaaagaatgctggtataagaatagcaagaatgtaacatataatatgtcgcgagtatacactgtaaaacttcggtaacaacagtttgggaaaggaagaaaaaaaaactcaggtaatacataatggacagtttaggtaattagaaaaaacaaaacaaaacatataaaagaaggagagaaaagagaaaaaaaagagaaatgggaaaaattccggcatacaccagcaccagctctcttgctttttcactgccacttcacttgatgagcacatctttaatttttcaccttcgatttttttttcaccgcgcccttgcaacatgccacagtagatcgagcagtagtacacatagccaaacaaatttttaccgaggtgtaataatttgtaacaaccacaaccaccgcaacattttgcatatata

SEQ ID NO: 10844 - DNA, 1501 bp, Oryza sativa
atataaccttgattgatagtatatttgtcttgtgttggaaatgttattgtgtttctttataaatttgatcaaacctaaaaactttgactaaagccgtgtttagttccaaaataattcttcaaactttcaacttttccatcactcaaaactttcctacacacacaaattttcaacttttccgtcacatcgttccaatttcaaccaaacttttaattttggtgtgaactaaacacagcctaagaaaaaaaaacttatattatgaaattgagggagtatgtgccagtgtgttgcaacgggaacaagagataaaaaaacttgtaatttagtttcttttatatcggatttggaaataaaaatgaaattcggttttgtttatgctggtttttcacgggcttttctggagctgtttttctagggaaagagtagaacgactgtgcttttaaagtagttaagaaatgaagtcaggctgtttgaaccaataagcggtagaaacacggaaaaattagcataaaattatttataggtaaatattgtatatttatattgttctcagtttaaaagtcactgctgggaaataaatttcaatgagaagtccccaaattcaactgtaaaattgcgttttagattttatttatttatttttatagtcgcacatttttttagtttgctaatacatggaaatcgtcaaatgaattgggcaagtctgatggaatgcaggggaaatataatcagattagagtaggtagcagattatcaaatgtttgcaagttctttcgattttggcccgaaggtaaccagtacgtactagaggagtacaaatgtagaatacggttgtttgacttggagatacttcagcattatggagtagaatactgctcctactatagctggtcagagggcagcgaagactgagttgtcagtgagaaaagggaagcgaatatatgcgttcagttcagactttcagagacgctctttgaaatcctgggcgccatgatccaatcaattattagcactcttcggtacagcggaataaagttgtgttttaagttcataatgctgtatttattcttgatcatggactatacttaccagatttattgtttagtacatctaaactcttattactgaaccctgctgtcaatagtagtagcagtacagaatcaagttgaacatagaatatatacatagttttctggaatcccaactctggtcgaaatctaaatcaatcatcaacaatatgaacagaaacaggaggcactcggtgaactttacacgaacaaacgaaagaataaaaaccaaaatctctttggaatcgtaaaatggacgatccattttcataatcacctcaccctcccaaatcgctgccattttttttttgcaccacaatgtgatcgaaattcctccattagcacacacaaaccccaccttttgatgctccaaatcttttccaaatcataccactactactttttttctcctttttttgattcttttttttttg

SEQ ID NO: 10845 - DNA, 1501 bp, Oryza sativa
ctcgatctggaccttcctccagccttaggctggacaacggagctggtcagccagctaatcaatgtctggagtgcggtacacaacgtacatttcacagaaaatgaggaggacaagatagtgtggaagctcactggccatggtgaatatacggtgacgtcggcctacaaagcgcagctcttaggtactacagccaccaacttcaacatcataatatggaagccgtgggcaccacgcaagtgcaagacctttgcctagttgattatccaaaatagagtttggacctccgacagactggcaaccagaggttggcagaacgattatttctgccccttatgtagacacacccaagaaactgctctccaccttcttgcagaatgcagatacaccaagaaaatctgggcggcgttatctgattggactgggtgtggtcaactaaatcccggtcaatggcaactagctcaatcggtgttagagtggtgggaggccaccgccaacttgaaggaagccccaaagaaagcacttcacacgttaacacttctggtcaactgggaaatctggaatgagagaaatcgtagaatttttcagcacaaagagttatctaccggaagtctgttggccaaaattaaaaaggaggccaaaacatggtctcgggcgggggcgaggcatcttggtagctggcttgcttcttatttttagctcagtaggaccgaaggtcctgggcctggtttttcttacttgtaaagtttactctttctctattcaatgaaattggcagcttaccgattcgttcaaaattttttttttactcacctctggctacgtctatgcatacttgcatttacagctatatctgttatttttttctgtgtgaaattgtgaagtggcaaccagctgaggaacaacagatgaacagatcgattctgcgcatgcatcaggtgggtcccatattggcgttgcatattctgatccttggaggattccatgggataaaggccactctgctccggagatgcggcgccgaggttatctccttaattaatctcacatgacttcctcttatatcatgctactagtagtactatattttcagagttcacagctgatattgtcaacgcttgctgcccccttatcgctcgtaacgtaataatcgtataatcacataattaaaaatccactcttgttaattcagcaataaacttcagagttcagagaacgtgtccaggtctgtcgatattatcaggtgagagaacggagacgatgaggccattttgcaccagcacgaatcttaaggcaaatgccataaggatggcgccaacgagagcgtgccaattcccgcgcacctgaagctctataaatagctgggcgatgcgtgatcccaactcccaagccaccagcaaagccagcaattgcatccgagctcacctagcttctctcttgcaaccagcgattcgatcgattccatctccaagaagcagcggctagcagcagctagtagttgcca

SEQ ID NO: 10846 - DNA, 1501 bp, Oryza sativa
atcctcgcgcctctccatctcttcttccccggccgcgccgccccgccgtcgcgtccgcctcgccacgactccatccgcgccgccgacaccgtttctctcgtcggtgagctccccactgaaccccttttcccctgtcgcacgctgcgccgcgcccgccgccattcgtcacatctcgccgcgcgcccttgctctgtcccgggcgtcgctcgccgtcgccggcctctctcggcgtcgcccgtgccctctcgaccgatggaatgagctcgcgacctcgcgtagatgctccagctccaacgaatcgaacccccgttgccctggtgaagttttccccctttgctcgccgccgacgatcgccgtcaaaatccgccgccgtcggctcccctcttgtcaatccctctcgccaccacgctcccggggatccccttgatctcccccttgttgccccatggccgccggcctcccctctcgctctcgcgccgtgccgccccttccgccaccgcttagcgccgccgcctgtgcgtcgccggtgaccttcgggtcccgcgtcaccgtgtgcgcgtcgcaaccccctttccgcgacagctgagcccgagaccgcgcgcccttcgctctttccacgcgcggccacatcagcgtgtcggcgagattggccaccgccgtcggccgccgtcgttcttcccccggctaatccgctccgttgaatcgattccccttggcctcctctctcttccggtgctaaccccccaatccacctcgccgccgttcgccggtttgcgtcgctcgtcgccggccatcggatcagcctgcccggcctcctctacctccccatccgacgtggcttccacgtggacgccacctcagccctgggcccgcttgaccgagtcaagccggcgcccagtcagcccccctcctccctctccccgctcgtgggcttggcccatcaaccatccccccttctcggcctaggggaaaatgaaaagtctacttttactccctctgtccaagcccagtgcccacacacatgaacaaaagtccacttaatcccccccatgtacagtacacccttggccccgcacgtcagtgactgtcaataatattcttgagaatattatttctataaattccataaaccatttctcgtcttccagaaattctaattgaacttccaaaattcatatcttcccaaccgctcttctgattgactccgttcaacttccagtaattccgtaaaattgagatctatttaatggcactattatttagtctaaatagggtttttttcttggtcttttgtttaggtttttgtttgtttgcgtatagttgtggttaccggattttcgccgatcgcgggttttctcgaagattcgtgaagctccgtgaagaccttgagcaaggcaagtcaccctttgatcaattgcccctataattggaaaatcattattattttgtttgcaacttgcattattagaatcacacataacttgcttggcctcgatttgcg

SEQ ID NO: 10847 - DNA, 1501 bp, Oryza sativa
attgaaagaggattccatataagaccccaatccaagaataattaaaatttcgaattaaaaaaataaaataatatccaaaattagaaaaattaaaagagaatttaagtaggaataccaattttcaaacaactgaaattgaaaataaaaataaaaccattaaaggaacccaatacgggtattaactattttttttaaaaaaaataaattctgaaattagaaaaagaaaaataagatttcaattagaaatacaatttataaataactaaaatttgtgataaaaataaagactattgaaagaaaagaccatctacaacacatgacgagataaattaagtaacagcctagaaaggagtagagtggtggcggttgatacgacatataaaaattattaataaaacaccaaatataatcctaatgacgattaaaaggagggacatcagacaggccgtgaagcaaacaagtaaggcggttgccgggacttctagaaagtataaaaaataaaccccattgataatcatattcgatttttaaaatgttaatgacaataaaaaggagaagcagcgggcggggtgtataagagtatagttgctgagccgccgacgattgacgggacttctagaaaataaaaaatgaattccaacgatagttatgtttgatttttagaatcacaacgacaataaagagtaggcggcggacgggctgtaaaggggcatagtggcatcgtttgatgggacttctaaaaattataaaaataataaaactacaagtctaattttttaaggttcggaacttccaaaaagtaaaaaagaaacaatgataatcatgttctattttaaaatctcaatgacaataaagaacggaggctgcgggtgagctgtagaggagtacaatggcaaagccgctgacggtttggcgggacttctagaaagtaaaaataaacccaaatgataattatctttgatttttaaaatttcaatgacaataaaaagaagaaacagtggacgggcggtagaggagtataatgacaacgtttgacgagacatctacaaattataaaaacgaaacccaatgtgacaataaactctaaaaactataaaattcaatttttaaaggttccaagaagaataaatagaaatagtggtagatcgagcaaacaaataaagaagaagatgacataaggggtagcaactgatgtgacttttaaaaactatataattagaaacacgaggatgataaggtttggtctttcaaagtcttaagacaatgagatagctatttaataaattttaagtaaaatcatattaaaaaatatatgattttatttggatgctagccgcgcaattgcgcgggccacccagctagttttattaaaagaataagattaacatattacatcccatagtactgagtctactgctactgacttgagccgaagacctataaaatgtatgggtacacaacagtttagcctcgtccgacaaccaacgcaagcgaaaacagc

SEQ ID NO: 10848 - DNA, 1501 bp, Oryza sativa
atgatcttgctgttgaacatggtgctcatccagtactggcatgacacgaaggtggcgagggagaagccgatgaggaagcgcacggcgatgtaccccgcggcggagtcgatgagcgacatgcagaagacggtgggcgcggcgagcatgatgaggaaggcgcagccgtagcgcgggccgagcatgtcgcagatggcgcccatggcgagcctggagaagatggagccggagacggaggcgacgccggcgttgccgatgtcggccttggtgaggttgaggttgtcgcggatgatggggacgagaggggcggcggcgaaggtggagacgaagcaggagaagaaggagatccatgataggtggaacgtcctcatatgcgggttcgcgaacgacagcaacctgatcgtcttcgccttgtgctccgagtccaccggcaagtcgaacttgctcgccgccgccgcgtcctcgccgcccacctccgtcgagaacgcgaacgccggctcgcgccccgtcacgccgtgcagcgagctccccggagcgcccaccgtcgacgagtccatggcaactactagctgctgctagccgctgcttcttggagatggaatcgatcgaatcgctggttgcaagagagaagctaggtgagctcggatgcaattgctggctttgctggtggcttgggagttgggatcacgcatcgcccagctatttatagagcttcaggtgcgcgggaattggcacgctctcgttggcgccatccttatggcatttgccttaagattcgtgctggtgcaaaatggcctcatcgtctccgttctctcacctgataatatcgacagacctggacacgttctctgaactctgaagtttattgctgaattaacaagagtggatttttaattatgtgattatacgattattacgttacgagcgataagggggcagcaagcgttgacaatatcagctgtgaactctgaaaatatagtactactagtagcatgatataagaggaagtcatgtgagattaattaaggagataacctcggcgccgcatctccggagcagagtggcctttatcccatggaatcctccaaggatcagaatatgcaacgccaatatgggacccacctgatgcatgcgcagaatcgatctgttcatctgttgttcctcagctggttgccacttcacaatttcacacagaaaaaaataacagatatagctgtaaatgcaagtatgcatagacgtagccagaggtgagtaaaaaaaaaattttgaacgaatcggtaagctgccaatttcattgaatagagaaagagtaaactttacaagtaagaaaaaccaggcccaggaccttcggtcctactgagctaaaaataagaagcaagccagctaccaagatgcctcgcccccgcccgagaccatgttttggcctcctttttaattttggccaacagacttccggtagataactctttgtgctgaaaaattctacgatttctctcattccaga

SEQ ID NO: 10849 - DNA, 1501 bp, Oryza sativa
ttgcagtctttagttgtggaaaagaacgagcccaaggtgttgagatcaattctaaataaaattccagccacagcacgaatgtaaacctaagttctgacagtcaaaaagaaaaactaaacaggaaggctgcttaaaacatgcatcatatgctagttagcaaaaccgtatgtacagaacatgttctaaaatctattatattattaagacagctcgaaaagaagacaccacgttcgctgtggaggctagaaattcccacattaatcggagaaaaagaaaaaaaaagaaagggagagtccaagtaggaatcactctaaaaagagctgaaattcggaattaaaaataagtaatattaaagagaagagtccatataagaacccaatacgaaattaattaaaattggaataaaaataaaataaaatccaaaattagaaaaggaaaggagagtccacgtaggaatataatttaaaaatacctgaaattcggaattaaaaataaggaatattaaagagaagagtccatataagaacccaatatgagattaattaaaattcgaattaaaataaaataaatccaaagttagcaaaagaaaataaaagaagagttaaagtaggaatccatttgaaaattagttaaaattcggattaaaaaataagcaatattgaaagaggattccatataagaccccaatccaagaataattaaaatttcgaattaaaaaaataaaataatatccaaaattagaaaaattaaaagagaatttaagtaggaataccaattttcaaacaactgaaattgaaaataaaaataaaaccattaaaggaacccaatacgggtattaactattttttttaaaaaaaataaattctgaaattagaaaaagaaaaataagatttcaattagaaatacaatttataaataactaaaatttgtgataaaaataaagactattgaaagaaaagaccatctacaacacatgacgagataaattaagtaacagcctagaaaggagtagagtggtggcggttgatacgacatataaaaattattaataaaacaccaaatataatcctaatgacgattaaaaggagggacatcagacaggccgtgaagcaaacaagtaaggcggttgccgggacttctagaaagtataaaaaataaaccccattgataatcatattcgatttttaaaatgttaatgacaataaaaaggagaagcagcgggcggggtgtataagagtatagttgctgagccgccgacgattgacgggacttctagaaaataaaaaatgaattccaacgatagttatgtttgatttttagaatcacaacgacaataaagagtaggcggcggacgggctgtaaaggggcatagtggcatcgtttgatgggacttctaaaaattataaaaataataaaactacaagtctaattttttaaggttcggaacttccaaaaagtaaaaaagaaacaatgataatcatgttctattttaaaatctcaa

SEQ ID NO: 10850 - DNA, 1460 bp, Oryza sativa
  unsure (1)..(1460): unsure at all n locations
ccgcccgctccctccctatactactagatacactcctcccctactacagtacaccacacaaaaatttaaaaaaaataaagagttagaaaaatttatgtatagaaatactatatataaaaaatttaaattcaaattcaaatttgaattgggtatgtaaactttttgacttataaactttgggtctataaaatttaggtgtataaactttatatgtatagaaatacaatatatagaaaatatttgaattcaaattcaaatttgaatcagatataattcaaatccaaatttgaatcgggtatgtaaacttttgacttataaactttgggtctataaactttaggtgtataaactttagatgcatagaaataccatatatagaaaatatttgaattcaaatttaaatttgaatcgatataattcaaattcaaatttgaaacaggtaaatttgaatcggatataattcaaatataaatttgaaacatgtatctaaactttagatgtgtaaacttgaggtgtataaactttaggtctataaactaactttaggtgtataaactttagatgtatataaatactatatataaaaagatatttgaattcaaattcaaatttgaatcggatatataaacttttgacttataaactttgggtctctaaactttaaatgtgtaaacttgaggtgtataaacgtgaggggaatgagtttggtaaataggggntcgggtgnaggagggagggggaggggggtannnnnattnnntcgcnaccccccattggcgggcgatcgatagcccattagggctgcccgccatgtggtgctggacaaggtcttaatcccacgtgtgataacacatttacatccatgagtgttcagcagaaagtggattcggcgaacacaacttttgttagagaatagttttttttatccagcatctacatccaaatggatatatgcaacaatttaaattgagaacttagcactgcaaataactcaatttgaaattcgctcatatgaagattttaactcagaaccttagggtgttactcaggtcactgcaaccactaggctacatcccccctttttcagatgtgcgaacacaattgctattccatataagctcaatcttctatctcccattgctatgcgcttgaaacaccaattcgcttggatagctaacacaacctgacacagagaaaaatggattagcctcaaacggtaatatttttacaatacacatcgtttaacggttcgagaagcatgctaatgaaaaagaactaagttgcagtctttagttgtggaaaagaacgagcccaaggtgttgagatcaattctaaataaaattccagccacagcacgaatgtaaacctaagttctgacagtcaaaaagaaaaactaaacaggaaggctgcttaaaacatgcatcatatgctagttagcaaaaccgtatgtacagaacatg

SEQ ID NO: 10851 - DNA, 1501 bp, Oryza sativa
agtacactgcacacttagctctcccgccccactaccatccatggttgtcagaataacacatccacctcacaacctgcaccaaccttccaatcctctggccattatgctatttgtcagcaccggttagagaagtctcccatgtaggctagaaattaataaactaaatcctagccgctatacttgccaaccttactatcgctaatctaaagctaaaccctagctaattataatcctagccatgctaatacccctataaataaataaaccaatcctaaactccaacctttggttattattgcttttctctttatcctatgctattaagatgtccatgcggtatactggataaaaacaatttcaattgtcatgtatagtcgtatgtgattttgcagtgtcttgcgcataaagcgtagtgcaccttgttgcctcgtcttgacacttgtgctgtcatcacgcacagacacaatgaagcaaactcactatctagagagctcactcaaaagagcacacactatctaaataaattcaaaaagaaaatcaagaaaataaactcaaacaggctgggccatatcaaaatcctttaatgcacatatcagggaaagcgtcaggaaaaagagagagagagagagagagagagagaaatctcaagtttgatttggccctacctacataaaaccgttcttttgcaactctcaccaaacaaaatcgatgggaacatcgaacagatgatccgaactttgaaccccaaataacccaagttcagagcatcccctgagaacccaaatcatgaacacagagcaaagccatctacacaaaccagagagctccacaccggtcagccgctcacctttgacgctgcccatgcctactgcctcctcctattgctagctgctctctagccttgaagaaatctggacacgaagagctccgatgaagaacaggccgcagcagcaagaagcaaaaaagcaggcagccacccctctcttaccggtcttcttcttcttcttacttggtgtggctagtacgtgatcgactatactccctaggcatggacgtcagggcgctctcagtcttggaacctgtctggggacagcagaaacaacgaacgctcgtgcgggcgttgggacgcggacgcacagacgaagctcacgggattgcgaatgacggacgaagagcccggtgtacgatgacggacaaatgaaggtggatgcgacgctggctgcggcctgcggccacgtgaaatcccgtgatcgtgaattgaaacaaaatcgggaagcgatcttatgtgttgtgcctccattttcaccggaagacctaagaaacacttacaaaaaacgattttcgcgaacacacactgtgttttttttttagccaactaaatgagcgtccatatgtaaaaatatttaggcggccaactaaatgagcattcatatgtaaaaatatttaggcggtgtccagcaaaaatccacctgtgatacgaaaatttattatcgcaggtgga

SEQ ID NO: 10852 - DNA, 1501 bp, Oryza sativa
gatcttcttcttgaggtgtgtgtgggaatgaatgagaggaggggtatttataagtggagaggtgccttgggagtgtggagatgctccaagcatcctatgagcatctttgctctcctcttgacatgtggcatgatgaagcatcctaggagcatctttctccctccttgtgacatgtgtccacggcggttatttcaggtagaaccgatcacaaccaccatgggatgtggataacttccagctgatgaagaattgggctgatcgggctggctgctggttcggccgaaccagggggttcggcagaaccctggccgagcccaatcagcccaccatttggcatgtgtttctcccaatggatcctcagcttagtggtatgaattatggccttgtttgctcatgttaattctgtattattagcccatctatccacaagtctgcttctcgacagcgtctgattgatcattcgtctattttctgtcgattctcctccatttatatgtgcttcttctgcatacatgttagtagcatagtatatagtggaagtagatattttatttggaatttatgcattgcaagcatagctagtctgcattaattgggtaatattgacggtcgaaactggtcgataacgaccgtcaacagcttttatcttgttcttgcttgtttcttcgatttgcttgaaggaataaggttgatctgcaccggcaagatcaacaacccactgagagatgtatcgatcgctaaggtgcaacacaacaacgtctagtacggttgtagtcgggtcatcaacgtttctcccaaatcgtacttatcatcaactcaccgaaagatcaggccaacaatagccttgagtgtctcgagtggagctcagggttcatcatcatgacacttggggatttattttgaaaataaaacttcttttgggacttacttctcagttggtttcatcattttacctaccaaggcaatacaccaatatatattatcaaaccatttatatatgtgtatgactacttgttattatattgagctttgctaaattatcgtgactcgtgttagatatctctcatgctctcgtgatcaaggttgcacaattaccacattatccctataaaaaaatgctaagcttctactctggaagttggtaatataaatttccatcaccatccaaaaataaactctccatccagtttatgcctgcttcacctagagactccttgaaaaaaaaatagagaaaaggagggaaatgtatggctatgaagaaataaaactttgctcttccaaaatatggagcaacattgaaaagaaaaaaaagagagatattgtagccatgcaacctccaaaatattgaaaggagaaaattggagaaggtatacacaaaaggagaaacattttctttatttctttttcccatccaccactacaatattcattccacacaagttgtgcaatccttgatttgagagtatgattgactatcttcttgagtccaagtatttggctt

SEQ ID NO: 10853 - DNA, 1501 bp, Oryza sativa
atattcctgacctagaacttctccaaccttcaatcggtggcaaggaacagatcaacaatagggttggcaacggggcgggtcgggtgcggcacccatttcccgttgtccctctactgcagacgaaggcggatgagctagcggtggacgagctcctccctcacttcgactccttcggcgggccgggtgcaggcgaagacaatggagccaccgacgatgcaagaaagggcaaccacaacttggatggcgacctcccaagagtactccttggggacgaggaagatgatggtgaggccggcgcgagaagctggagcgcgaggccaagcagcgtgccgggggtgccggggttggtcgccgccgtcgccgacgaggacgagcggcgcggactcgtcggaggccgcctctccccatctgccgccggcgtcagaagagaagactagagaagagaagagaagcgaagagaagaaagaaaagagaaaggaagaagatgatgctagcacgtgggcctcgcatttttccttctcacttacatgtgggcctcatattttgtttttttatttttttgccgactaggttgccacctcagcgaaaaccatgcatctatactgcctcgggaccttttttttttttgaccgttttacatagttcagggatacacatttagtattgcggttaggggacatcagatatactcggcgtacagagtgagggacgtcaagtgaacttattcctcacgacgaaggctgtaccacacggcccatgtttgcacgacccatgatggaccgagtcccagcacgagacggcaaagcagatgtgacggtacgagtgcgaggaatttttttcggttttagatttttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 10854 - DNA, 1501 bp, Oryza sativa
agccgatccggactccaaccgattcctgctctgtttccgaactcgatctccgcctccaactccgctttgaccaaatcctttttcctgatacaaatgctaccaaatttggttgttaacatggtcagaccgccggttgagggccggtcaaaccggcggtgtgtggccggtctgaccggtaggaccgagtccgattgtgtttcgtcgggtctcgaggtttccttgctcgggaaggcatgtttcgggtttccttaagtttctaccccgagttggacgtggaggagggcctgtagagggcaagaccaacccctatataagggacatggccggttcattgtaaaaaaaaaacaatctactatcaatcaatcgaatcgtttttcatattgcttttagttttctcttagtttgtccatttttgtcggtttgcgccgtaaaccgttcgccgccgctgcgagagtacgacatctctttgtaggtttgtcctgaaaaccttccattttacccacgagacgggtagttatctagaaatcggctccgctagccggtttagttatcaaaacccatctatgtttagctctttgctagatcaaggtggttggcgactctaggatcaccgcaatacttaaggtgctgcgatggcgcttatcaacttgtaacaaaaagttgccaacagtatattcctgacctagaacttctccaaccttcaatcggtggcaaggaacagatcaacaatagggttggcaacggggcgggtcgggtgcggcacccatttcccgttgtccctctactgcagacgaaggcggatgagctagcggtggacgagctcctccctcacttcgactccttcggcgggccgggtgcaggcgaagacaatggagccaccgacgatgcaagaaagggcaaccacaacttggatggcgacctcccaagagtactccttggggacgaggaagatgatggtgaggccggcgcgagaagctggagcgcgaggccaagcagcgtgccgggggtgccggggttggtcgccgccgtcgccgacgaggacgagcggcgcggactcgtcggaggccgcctctccccatctgccgccggcgtcagaagagaagactagagaagagaagagaagcgaagagaagaaagaaaagagaaaggaagaagatgatgctagcacgtgggcctcgcatttttccttctcacttacatgtgggcctcatattttgtttttttatttttttgccgactaggttgccacctcagcgaaaaccatgcatctatactgcctcgggaccttttttttttttgaccgttttacatagttcagggatacacatttagtattgcggttaggggacatcagatatactcggcgtacagagtgagggacgtcaagtgaacttattcctcacgacgaaggctgtaccacacggcccatgtttgcacgacccatgatggaccgagtcccagcacgagacggcaaagcagatgtgacggtacgagtgcgagg

SEQ ID NO: 10855 - DNA, 1501 bp, Oryza sativa
tggattcatttggaaaccctcccctaatcccgccggcgccattgatggagccccagagcgccgcgccggtttccttcccctccggccgccctctcccccttccaaccctatataaaccctccccgcgcttctcccgtccgtttccgcctctcgccgcccttcctcctcgccggaatcgagctcgcgccgtcgttctctctctccaccgtcgccgccgagctccggtccgccgccgtcgtcgccccagaccacctcccacctcggcaccgcctccttcggcttcgccgcatcgtcgccgacctcgtccacccctccgtttcgctcgccgaccgccggaactccgtcgaccccgtcgacccgagccgcaccgccgcctccctcaactccggccgcctcctccgtcgccgccgtcgccccggggtgagccgtggaccattgcctcctttcccctttccctcccctctctcggccgccgctccgccgcgccggtggtcgccggcggcgaccatcggggcgcgggcgcgccgcctcccgccgaccgcgccggcgtggccgccctcgggagcgccaagtggctgccgcgtggggcccggccgtcagccgcccgcgtcctcgggtgcggctgacgcgtggggcccactgcgccggccggtgtgagcccgggtgcacccggtccaccgtggaccgtgaggctgccgcgtgggccccactcccatggacccggtccgcgcgccccctcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagacgctgcagctttggaagatccgctttcgtggaggttgaagccgatgtttgggaaagcgagcaaggcaagtcacatcatccttgagcatattgaatcctagtttataaaattattttgatttaaattaatacattatcgctttatttaaattcccgcgttatcactgttttatttagccatgcctatttacctttgttaagacattattattgctattgttattattaccttgttcaccctagaataaacaaaaccccaactagtgggtactctattcatggttccactaatatgaatttaggtagatgcttcgctgattaataggacaacattaggtggtttttataactttagactttgggaatattcatatctcttggatactatggaatggttggcttatggtggaattggacatacccctctcttcctctttcaaagcccctaaaacctgtttttcggtggggtttgggtgcatgccagttgtgggaagtagcaccccggccaatataaggactaa

SEQ ID NO: 10856 - DNA, 1501 bp, Oryza sativa
atagaataacggtatatatttgaccagaacatcgaaaacgaaacagggaaatgtacaaaattggaaagaaaaagggtgaaataacttatggaacataccaaaggttgggggtgttgacatatccacacaaattaaactataatctgaagacctccaactccaagttgtcaagacaaataaccgagcacgcgagcgcggttcatatgatgtgtatgggaattgggatgctgaaaacaaatgcaactggacacatatctgcaacttgtaaataacttttatttcttttaatggaaaaaatgtgcctctcgcgtattccggaaaagaacattctgtcctatacatgacatcctgatatgttgtaaacatgataaataactggtaagttgcctgaaatctctatcaaggttaaagtcggccgaagaattgcagggagacagatgaactgatgagtaagagacagcaaagacctgatgaacacaagagggtcatatgtccccttgctgtcagtgtcagggttggcatatttgcaagccggtgtgcaaagtcagattgataacgcatgcaatggccgttggatcgctgcaaaagatgtaggttagatagaaccgaagccgtgaacatgatactagtagctaacaacaacttttgttgttgatcctgacacgccgttgctttgcttcaggccgtcatgaaaaaaaaccagtgcatatctcatggcaagaagaagtgcaggttgtgaactgaaactgcaaacatgaagagaaaatacagaagtttatgaagaagctcccatcaatccaagcaaagttttttttttcttgttatttaatagaacaaagttacaatgccagagtaaacagtgctgagccacaattcttggaatctcattttactctgaacactgaaggattctgtggacagatacagaacataacataacagaacagaacagaaaaggaagagaaattaattaatcggcaagcaacagatcgattctgcgcacgcatctgatgggatattctgatccttggtggatcccatgggataaagggcagtcttctccggagatgcggcgccgaggttatctcctttatcaattcatttcagcttaatttaaacggttctttgctttcctgtaatatacatgcaatgtagtttcagagatcagagtcgagactgtcaacgctagctagctgcctctaattttgttgttttaaattcagaccaataatgcacccattgttaattcagaaagaaatcggtaagcccagagagttcagacttcagagagctgacagcgtgttcaggccgttcgattttggtgaggccattgcaccagcacgaatcacgaggcagatattacaacttgagctctctataaatagccccagcgatgcgcgatccaaagcaagcaacagcagcagaagtgcacttttgcattctatttccaatcaatccaagaggctagagctagcggccaagatcatcgtcaccggcggca

SEQ ID NO: 10857 - DNA, 1501 bp, Oryza sativa
cccgatttttcccaaaaacttgggcgttgtttcacccttttcgcccgatttttccccaaaaactcgggcgttgtttcaccttttatgaaaacaatgttttaccacttagcgaatgaatatttcagtttataaaaaaaatgtgaaacacggtgagatcgctagatgaaacaatttggttcaacatatactacaaaatgatttaagccattgaaacacttaaaccttgtgtacatcaaaacaagccacctgtacatcaagatgaaaaatattaaacactatctaaaatccactgtaaaaaatgatccacacacaaagaaatatcacgagtacactagcggaaacattgcttttgaaccattgaaacatcaacaaaccccgtgtgtcgaaaatagaaatatggaacactatcgaaatatccactgcaacatttaatcaaacattttctataaattcaatcaaacataaataagtttgactagtaatgacttattatatggaacggagagagcaatattgatatgtgtcccaacccacctgcacgcaccgtccttacctctgttcgattgagatgatcaagcgattttgttcatggcttatttgagaagacactcaattagcgtaaaactaataagtattaactattacaaacttgaaaaaattgatttgtttgaatttttgaagaactttcatatatgaagctatctttaaaattcacaccatttaatcaacatttaaaaattgtgtccatgataattagaagccagtggttgaaatggacagtgtaaggtgtgggtaaaagtttattttttagattatggatgcacatctttacagtttggaaatccctatgctctcctctcctcgaaatcggcaatacaaatcaatcaaatcacaaacttcctctgcctccggcctctcagggacctcaccgcatgtgctaatagaatacatatatagacattcagacacagtagtctagctaagataatgtaaaatcaacaattgggaaaaggcatgtaaattaaccgtcggagatgatgaagggaattaatgtgggaatttgaatttgctatacagaaataagagagtgtttaattaggagggaattcatatcctttgtttggtggaaacttgatgttggaagggtatattattaggaataaacaattattattgtaaaagttgtaagtaatatttattttagacaataacaataatatgaatatatgaaagatatcacaaaacatcacgtttcaaaggtttattcgagcctgattttgagtgaaattaagtggaattgtattaagagttggatttcaatcacgtattataccttctttctttgtaagctaccgtgtcgatcttttgcaaagttgcaacaaagatcaacaacaacgtcccgccgcatctcctgctccggcgccggccgccgtctctcgatccgtccagtccacactgccagccatgtcattggcggcggcgggccgtatcgtgcgcaccg

SEQ ID NO: 10858 - DNA, 1501 bp, Oryza sativa
cttttgttgttgaatgacaactgtgttcgtcgaaaaaacgtggttcactcttatagtggaaatgtaaaacaatatgtattaatgatggaattttttatcccctattacatgccttaattaggggactatttatagtcttagtacaagctcatgcacgctacggttaacaggtaagagaaatttacatggatacccttatgattggagcatttatgagggcaaaaaaggttctattttgcctaggttgatgtttcacttttttttcagtttgtgaaaaaaaagtgaaacatggtgacatcgctagatgaaacaatttggttcaacgtatgctacgaagacgatttaagctatagaaacacttaaacctcgtgtacatcgaaacaagccacctttgaaccattgaaacatcaacaaaccccgtgtgtcgaaaatagaaatatggaacactatcgaaatatccactgcaacatttaatcaaacattttctataaatttaatcaaacaactagtaatgacttattatatggaacggagagagcaatgttaatatgtgtcccaacccacctgcacgcactgtccttacctctgttcgattgagatcaaacgattttgttcatgacttatttgagaaggcactcaattagcgtaaaactaataagtattaactattacaaacttgaaaaaaataatttgtttgaatttttgaagaactttcatatatgaagctatctttaaaattcagaccatttaatcaacatttaaaaattgtgtccatgataattagaagccagtggttgaaacgcacagtggaaggtgtgagaagggtaaaagttatattttttagattatggatgcacatctttacagtttggaaatccctatgctctcctctcctcgaaatcggcaatacaaatcaaatcacaaacttcctctgcctccggcctctcagggacctcaccgcatgtgctactaggatacatatatagacatacagacacagtagtctagctaagataatctaaaatataatcaacaattgggaaaaggcatggaaattaaccgtcggagatgatggagggaattaatgtgggaatttcattttgctatacagaaataagagagtgtttaattaggagggagttcatatcctttgtttggtgcgtgggaatttgatgttggaagggtatattattaggaataaacaattattgtaaaagtggtaagtaataattattttagacaataataataatatgaatatatgaaagatatcacaaaacagcacgtttcaaaggtttattaattcgagcatgattttgagtcaaattaagtggaattgtattaagagttggatttcatcacgcataatactttctctgtttgtaagctaccgtatctcctatcttttgcatagttgcaacaaagatcaacgccccgccgcatctcctgctccggcgccggccgccgtatctcgatccgtccagtccacactgccagccat

SEQ ID NO: 10859 - DNA, 1501 bp, Oryza sativa
aaccactggcttctaattatcatggacacaatttttaaatgttgattaaatggtctgaattttaaagatagcttcatatatgaaagttcttcaaaaattcaaacaaattatttttttcaagtttgtaatagttaatacttattagttttacgctaattgagtgccttctcaaataagtcatgaacaaaatcgtttgatctcaatcgaacagaggtaaggacagtgcgtgcaggtgggttgggacacatattaacattgctctctccgttccatataataagtcattactagttgtttgattaaatttatagaaaatgtttgattaaatgttgcagtggatatttcgatagtgttccatatttctattttcgacacacggggtttgttgatgtttcaatggttcaaaggtggcttgtttcgatgtacacgaggtttaagtgtttctatagcttaaatcgtcttcgtagcatacgttgaaccaaattgtttcatctagcgatgtcaccatgtttcacttttttttcacaaactgaaaaaaaagtgaaacatcaacctaggcaaaatagaaccttttttgccctcataaatgctccaatcataagggtatccatgtaaatttctcttacctgttaaccgtagcgtgcatgagcttgtactaagactataaatagtcccctaattaaggcatgtaataggggataaaaaattccatcattaatacatattgttttacatttccactataagagtgaaccacgttttttcgacgaacacagttgtcattcaacaacaaaagatgggtttcctttattatatcaagtttattttttcttcatgatttcattgtatgattcccttttgtcatttaatgtgaagcaattttcatgatcggatgaatcgagtgctgacgtgatagctagcacgtgaggtaacatcaattcataatatccaaataatacaagtgcaccatattatatatataatcctaagtagttaatttcattatgacgcagtgactgtatagtatctatctactctttataaaatggagtagagtggtgacggatctgccaccaccccaactgtcaactcccaactttttgttaaacaaaaaaaaagacatatgagactaaaggacccacatatcaactactcccactaactctatttttttatgaaaatatattaatatcagtccaaaaagttccacaaatgattaataacaaatatgcacatgccaacaacatattaatgatatttttttaattaaaattccattgcaatgcatggataaaacgctgctacctccatatttcaatgtatgacgccgttgactttttgtccaacgtttgaccattcgtcttatttaaaaaatttatgtaattatcatttattttatcgtgaaatgctcttttaagcatgacataaatatttttatatatatttgtaaaaaaaataaataaaacgaatggtcaaacattcgtaaaaaagtgaacagcgt

SEQ ID NO: 10860 - DNA, 1501 bp, Oryza sativa
tgcaattagtattttttatctatatttaatgcttaatgcatgtgtacaaagattcgatgtgatgtttttgaggaaaaaattggaaactaaaccagacctaaatattaagaccctgtttagatgggactaaaacttttaagtccctatcacatcggatgtttggacactaattataaatattaaacatagactattaataaaaacccatccataatcttggactaattcgcgagacgaatctattgagcctaattaatccataattagcctatgtgatgctacagtaaacattatctaattatagattaattaggcttaaaaaatttgtctcgtgaattagctttcatttctgtaattagttttataagtagcctatatttaatactctaaattagtgtttaaatacagggactagagttaagtcactagatccaaacaccacctaaatactggtgttccattctgaactttctgacagtacagacagtaccgatgagcagcagatcaccagcaacatttgtcaaatctcagaagttgcatcgatccaaagcaagctagttcgatcaacttgcttatgctgatcacaagtactaattagcaatgtaattcattagcacatgggcaattctactgtccttaagaaggtaccatgaggtaccaaaaaattagtgtaaaatttggtatctcatagtacctaggtaccaagagataccaaatttacaatagaaaaaatggtatttcatggtaacttctcaagtaccataaaattgctcttaacacatacttagtatagtgtatagttaattgatcgtgcatgtgagatcagtcaagaaacaagcccgaggtacttaatttgccgtacgttctccatgctttgcttgcaaaaccatatcgttttgcttaagagatatatatcgttttgcagtcaccatacgttctgcgtgctttgcttgcttagtatatcgttttgcagtcaccatatgttttttacgccatagagcaatatacacacatactccctctccctctgtcctataaaatatcaatctagtatgagatgtgtgtccagattcattatattagaaaatgtcacatcctatcttagatttgttttttattggacggatggagtaatgcattgcttgcacaagtaggacagaacatctccattgagccatatataattggaaaaaaaaagttgtttcttctatcacggaagctgaaatcataactgtggataacaccacgtaatgttctcctaagtgattatagttagcacattggaatgatgtaccggcccatgtatagatatccgagtgatgtcgaagcagagctatctatcaattcacacatgacggtcttaatagccacatctctcatcattagttacacaataccaaattttactgaaacaattgagccctttatttctttttgcataatgcataaaacaagtacaagtaaatgaaaaacaaatcctacttcataaatatgaccccag

SEQ ID NO: 10861 - DNA, 1501 bp, Oryza sativa
ttgcttgagaagtccgcttgtaaaaataagcttatttttactagcgtagattttcgctggcggttccttaaaaagtccgcttgtaaaaaataactctatttttactggcgggcctcttaactaaccgccaacgaaaatccattttcgctggcgggtactaagagcaccgcccttaaaagaaattcacgcacactaaaaaattcaccgcgcgcccaccaattacaaataatcgccgcccatcggccactccttatccactccactccagattaaaaatctcctccagatccaccaaccagcatcctctcctcctcccttcccatgcaaagggaggcggcggtggcggtggctcagtggtgacggtggctcacgcaggtggtggcgacggctctggcggcggccatggcccaccacccatccgccctagatctggcggctgcagcagcatggaaggggcggcggccggctgcggcaaagagtagagaaggtgaagaggagaggtggtggcaggccgagccgggcgacgacgacgacgagggagagcgtggtcactgggaaggggtcagcagcagtggcacgggagaggggggcggtgaggagcggatccggccccagcgagtctcgggaggttgatccgccgccgccgggcctcgggagcatcgcgtctggcggtggacggagcgtaaggtggtggtgtccgcgtcgtctgcgagaagccctgccggcaccacgcagaagttcctcggcctcctctagaggaactcaaattgaaaatctgtgagcaaatctatgatggaatttatagaatttgtgctgtgatgtgaatgtggaatttttgtgctatatgatcatgatcaaaccattttgtgaattatttgtgttcgttgtggatttggaattcggggatatggatttgggaatgcagggcagcagcatgcggcatattcattttcgcttttcatctttttttcatctttgctagcgggtagaggacagctgcatggcgtattttcaattttttttgcccccaaaacgattatcgctggcgggtggcttaaaaccactatcagcgaaaacgaataatcgctggcggtccacgtaacacaactgccagcgaaaacaattatcgcaagcggacctcttaagggtccacttaagaggtccgcctgcaaaaatcgagcggattgcaaccgccagcgaaaatcttagatttttactggcctttgctttgtggcggcaccaaatgccgccagcgaagattcaaaatggccaccatgaaagatggttttcgtagtagtgtttctaaacataataaataataataatacgatattgtgattctctgcatgcgtaacattatttcctcaagtaaaccatctatttgttgtagctatgtaacaccaacttgacatatatataatttcctacggaggttttgccaaatcaaaaggcaaagtggatcttttaagataagtaactagtgctgcaaatggtctcatca

SEQ ID NO: 10862 - DNA, 1501 bp, Oryza sativa
tggatctggtagtggtatgggctctggttctagtagcgctgctacttactggaaaggaccatatgcaagtgcatatggcaatggcaatggtggcggtaacggccagggccaatacggtggcagtggcgttggtgcaggttctgggtctgggtttggcgatgctagcccttaatttccttcaaataggaaatttggaaattaatggagcccaacctggggtcatatttatgaagtaggatttgtttttcatttacttgtacttgttttatgcattatgcaaaaagaaataaagggctcaattgtttcagtaaaatttggtattgtgtaactaatgatgagagatgtggctattaagaccgtcatgtgtgaattgatagatagctctgcttcgacatcactcggatatctatacatgggccggtacatcattccaatgtgctaactataatcacttaggagaacattacgtggtgttatccacagttatgatttcagcttccgtgatagaagaaacaactttttttttccaattatatatggctcaatggagatgttctgtcctacttgtgcaagcaatgcattactccatccgtccaataaaaaacaaatctaagataggatgtgacattttctaatataatgaatctggacacacatctcatactagattgatattttataggacagagggagagggagtatgtgtgtatattgctctatggcgtaaaaaacatatggtgactgcaaaacgatatactaagcaagcaaagcacgcagaacgtatggtgactgcaaaacgatatatatctcttaagcaaaacgatatggttttgcaagcaaagcatggagaacgtacggcaaattaagtacctcgggcttgtttcttgactgatctcacatgcacgatcaattaactatacactatactaagtatgtgttaagagcaattttatggtacttgagaagttaccatgaaataccattttttctattgtaaatttggtatctcttggtacctaggtactatgagataccaaattttacactaattttttggtacctcatggtaccttcttaaggacagtagaattgcccatgtgctaatgaattacattgctaattagtacttgtgatcagcataagcaagttgatcgaactagcttgctttggatcgatgcaacttctgagatttgacaaatgttgctggtgatctgctgctcatcggtactgtctgtactgtcagaaagttcagaatggaacaccagtatttaggtggtgtttggatctagtgacttaactctagtccctgtatttaaacactaatttagagtattaaatataggctacttataaaactaattacagaaatgaaagctaattcacgagacaaattttttaagcctaattaatctataattagataatgtttactgtagcatcacataggctaattatggattaattaggctcaatagattcgtctcgcgaattagtccaagat

SEQ ID NO: 10863 - DNA, 1501 bp, Oryza sativa
ttaagtaatttcttaggaaattaaatcctctaaaattcttatagcaattctctatttcaaatgggccctaaagattaatttcacaaaaaatttcttggttttcgtcaatgaacctgtcagccacttcggtacaatattgctgtccacggccaaactggtcaatgtggtgggtggggccttctgcctacacaccttaaccatctgacatttttttttctattctttccagtgaaccatctcacttgattggctgataaagatcgctcaacaaattctcggtgccatcctctctttacaaatcatctgtcctgtgatgcatatcgtgctatgatatcatgctcttcctccctttctatgaacaaaaaaagctgggctattttatttccctttgacacctagatctcgtcattttcgaaacaaaaatgaaaagtgtacagtttcatcaacaattggccggccaagcgaaactaaactaagatcatgaatagaatccggacaatgggtcaggacccatggaccctttcacaatcctctcatcttaaatatttttttttaaaaaaatctactaaagtttagctcaacctttttatccaaccctcatattttgtatgtcaaaagtttgagcccattaccacctctcctataagaccgcattaagtgtttttttttcctgaaaaaaaatccagagcgcaacttattcatagtcaagcttgtatataattaattaaattgtgtcctttctcttcggttgccatattctttttaatagatgcaattttttcttacatataagtcacgacaaacgggctataacctgcttcatgcattgacatagcatgccatgatagtgcatgtatgttagtagctaggacctatgtgtcagtcacataaaaaaattaaaaattaaacacgtcttattaacctgccttcctttaaaattgaaaagtactcctctctacctaagaggagaaaaaaatgtttttaatatttatgtgctaccgtggtatactatgtcaacacacggagcaggttgaaaccgtttagacttgtatgatacccaagataagttcatagatccagaatatattttgatagttcagggatctggatgacatatttacacaagtttagagactccctatatacttcactctttttaaaactactcgctcaattcaaaatatagctattttataaaaaaaaatatagttgtattttgacataaagggagtatcatggagtttagttcaccttgatttaaaacagttctataaaaataatatgtatgcatttttttgaaaaagaatcacaatgttgataaatggaatagtttcattcttcagaaagaacgcccctactgctccaaattgaaaatctgagaggcggcaacccgtacgtaataaaacacgacctcagagtagtcaaacgcaatcttaccagtactgaagataacaattaacagatgcaatcatgcaattgcaagtgtactttgcgcacatat

SEQ ID NO: 10864 - DNA, 1501 bp, Oryza sativa
tcgtaaattttttgagtcaaaaactttgatatgtaactatagtataattgaagtataattacattgtaactacactgtaattgtattagtaactacgatataacttatataaaacttgtattcaactatgatttggttagacgtgacatgtgtgaaaaattagttgtaacaattttttttcttcatacacaaatctcgaggcgatccgatggtgacaaatctgaaagttttaggggcaaaaaatttgtggaagttttctaacaaatccgatcatttatatatgttaaaatttaattaggtaattagatctataataattgggactatgacttgcatttttaaatgcatatcgtttgtaataattatatatgttagaatttaattaggtaattacagctattggaactactatatttaagttttgccaaagagtgagatttacaggtattatatactaaagatatacgctgtgataatattaggagttagagtaccatgttgttagtggaagatatttaaatgttgttaggtgggcaaagaatacgatgatttattttgagttattatagtgctctttttactattatttagtagcttttattttaattaagtttaactgtggtgtttctttatttctcttacttaacggtaccccatgaatggatttttattacttttgtcttttctgtttcatctctccgatggaagtctcctgactcttccaacgatcttcattattaatccaaccgttcacaccaaattcaaaggttcatgctatataagtatacgtggctcaatgatggaaggaataaacatttttcgttcattaaaagagatatccatgaaattcgactttttcttttattttgggctatatccgtgatgccctatatatcgcgctggacacatgggcttttaatattggcggaccttcggatattgccgtggtggattcacgagtcttccagttgacttccgaagtcccttgaccatgctttttcttttggttattttgagaataaacggctgttgttcaatatctggctgcatccaacggttctaattttcccatgacgtggcacatctaggtgatgaacacctttagttttttcattactttagattataaccccacgcaacccccgagtgacaactgacaaaccggacccacatgccaggcagccagccaatcaaactgcgacgctcaccggtgaccggtcaccactaacccactagccgaagcggacagttgcggtgcacgtgccccgcaggcagcgcccctcctccactctcgtgccgccccgcttataaaaaccccacgccccgtgtggccgcgttgcaaattccgcgcggtcaaacgaagcgagagaaaaaaaaatttcttaaaaacaaaacaaaaaaaaaaaaatcctcgagacaccgagcgagtgagcgagcggcggcgaggcggccaccgacgacgaccgccggagccggagcccggcggagatggagatggagt

SEQ ID NO: 10865 - DNA, 1501 bp, Oryza sativa
tcttcacttcacttctcttctcttcttttttttctcttttcttcttctcttttctctactctttccttttgtctcctctcttctcttcttcagcgagattggcagggcgggggcaggcagaaggcgaagcaggcaggggcagcgggcgagtgcagcggcgagcggcgcagtgagcaaagcaagaagggggcggggcgcatcacctgtggcccgtgcgacaaccatggcgcaatccagtgcggccgctcccactacacgaaggccatcctcgccgtgcaatccctcaagcgcctcacctcctctgaccgctcctcggccgcctcctcaagagcgacctcctcgccacatggccgagctccagcgtcatggctactggtccatcgtgccgaaccttggtaccacgccgacctggccatctatgccacgttcgtgtcctcctcgccgataatcgaggacggcgccgccgcccctgtggatgcgctcgtggaggcgttcctggaggagaatgagcaaggcggcaggttcgtggagggggaggaggacttgtacaagctgacgcgttggtggtgaaggggagggcgcatgcgacgtggagggtgtatgaggcggtggtaaggataggaggctacgaggtggacgagtacatgtaagggggatgaaaagctgggcttcaagacagaggcggcggaggtataggtggacttctaggagttggaggctaggatctcgccgctagccagaaacatgcttgatgaaattcacgcaagagagaagagcagcacaactgcggcttaaatgtgaatctaattatcgtttagaaacctgaggattattaaatttactgttgtttcttttgtactcatagtcatagccgcgccgccccctgcctgctttgcccgctggcctctcagtcttggtgaagtagagaagagaggagatgaaagaaaagaggagagaaaagagaagaagaagaagaagaagaagaagaaaaagaagagaagagaatagaggacgctaaattgtggggtccacgtaatgccacgtcagcgcaacctaggaaaaactgagtcaataatgtctcaggacctttttttttttttttgcacggtttgtgatagttgaggggtatagatttctgatattgtggactggggatatcagctagactcgacgtaaagttgagggacgtcatgtgaacttattcaaaaaaaagaagcgaaattccggcccatgaaagcccacaacaacagaccgcaattcccgggccaccccagtcaacgggccatccgacaccgcccatcgccggcgaccaccgcaagcaaccgcggccacattccccagtaaaaaaacaccaacactggagtaagccgcacgcaccctcgccttgtcggcgactcctcccactcccagatccccacctcgctctcactcccccactcttcccccctcgccgcggcggccagatccgggcggcggaatgctgggccgggcgggggcgctg

SEQ ID NO: 10866 - DNA, 1501 bp, Oryza sativa
tcctagaagtccacctatacctccgccgcctctgtcttgaagcccagcttttcatcccccttacatgtactcgtccacctcgtagcctcctatccttaccaccgcctcatacaccctccacgtcgcatgcgccctccccttcaccaccaacgcgtcagcttgtacaagtcctcctccccctccacgaacctgccgccttgctcattctcctccaggaacgcctccacgagcgcatccacaggggcggcggcgccgtcctcgattatcggcgaggaggacacgaacgtggcatagatggccaggtcggcgtggtaccaaggttcggcacgatggaccagtagccatgacgctggagctcggccatgtggcgaggaggtcgctcttgaggaggcggccgaggagcggtcagaggaggtgaggcgcttgagggattgcacggcgaggatggccttcgtgtagtgggagcggccgcactggattgcgccatggttgtcgcacgggccacaggtgatgcgccccgcccccttcttgctttgctcactgcgccgctcgccgctgcactcgcccgctgcccctgcctgcttcgccttctgcctgcccccgccctgccaatctcgctgaagaagagaagagaggagacaaaaggaaagagtagagaaaagagaagaagaaaagagaaaaaaaagaagagaagagaagtgaagtgaagatatgacactgacatatggtgcccactatatgccacgtctgtgaaaccgaggaaaaattgagtcaatattatctcgggaccttttttttttcacacggcttgtaatagtataggagtagagatttatggtattgcggattccaaatttgatcaccgtcatagccatcatagtcgatccaacggaaacataaacatcgaggacacttcaccaatatgaaacatccagtgtgagccaccaagtaaatcgtgactcatcttaccaatcaacgactcatcttaccaatcaaataaaaagttaacttatcttgtacatacaactatttttctttataaacgacctcgtgctaaaaacatactacctcctttcttaatatacgacgctaacgctgttgactttttacatactactcatactattaaaaaaattaagtaaatatttttttcttgatttatcactaaagtaactttgagcattacttataatttttaagatttatataaattttttaataaaacaaatgatcaaagattgtgaaaaaaatcagcagtatcttgctccctccgtcccataaaaaataaatctatgaccggatgtgatatatatgtattgctagatttatagtattaggttggtattttatgggacggagggagtaaatgactatatcggaccttccaattggattttacccaaccgagagagttactgtgaaatttaccccggcgagaaactgtggaggctgaaggggcaatcagccaaacaagtaggcagttggcagagtggacgggaga

SEQ ID NO: 10867 - DNA, 1501 bp, Oryza sativa
gcgtacccataatctccacacccaggctatagccaatggaaactatagccacaagaaaaggaggatgccaactggaatgaaaccatatttatttctgtaattgaaatggagcatcaggctttgtcaaatttttgcgcgtgaaataactgaagtttagccgattggactgtgccatatgcagttgagcccaatagtgcaaggctgaaactttcatctgggctggggtattagcacaaagaaaggcccaaatagcccaaacaacccctaaatgactatcggatttcaaaagggagtagctatatttatggcgccatatttttcagcaaaaaaatagtcagcgtgtatttacattgtaagtccataaattacatactccctccgtcctaaaaaagacaaatcctgatttccgtgtctaacgtttgaccgtccgtcttatttgaaaaaattatgaaaaaaattaaaaagacaagtcacgcataaaatattaatcatgttttatcatctaacaacatgaaaatacgaattataaaacaatttcatataagacggacagtcaaagttggacacggaaattcagggtttgtcttttttttttggacggagggagtatgtaaatttagtgtatttataatgtaagtcctaaaattacatatgtaagtgttacgtaagtgggatgtaagtggtgtgtaattaactttgttagtcatctctaataattacacttaattaacacattacctagctagaaaagatgtgcacatataggtctgtagtgttagttttaggggcctctttctctctcatttgatgtttgagcgattatctgctctcgatcaataatacatcgatgatagattgcaggtagctagcgcggatcgcaaaccacacatactcaaatcataatattcagcactaatctaaagcaaatcggagggtcgaagaatcaactgtaatcgatgagattttgtggaaaatcgatgaaaaatgggtgctctaaagaaaaaagaataatggggattatccttcgtttcaagaaagataaagtcttgcctttaattaaaaacattttttttggatcaatgaaaaaacatctaacattttgtataaataaaaaatatcgcaatattcgttaaggataatgcaagcatatttgtgggtctcaggcttgtagcccctgtcaacctagcgagagggtcttccgaactccttccttcgtctctaacgtcctcatcaccacgggaaaagagaatcaatttcttccgttagcaactaagggggtgtttggattcagagacttaactttagtctctatatttagacactaatttagagtattaaatatagactacttacaaaactaattacacaaatgaaagctaatttgcgaaacaattttttaagcctaattaatctataattagagaatgtttactgtagcatcacatttgctaatcatggattaattaagctcaatagattcgtctcgtgaattagtccaaga

SEQ ID NO: 10868 - DNA, 1501 bp, Oryza sativa
cccgtcgtccttgccggcgttgtccactggctaatggatgcctcccgcagtagccactacatcctgacgtacgacattgcgacggcggaggaggggaagatggatctccccaccgattattgtggttgcaaggaaatacggttgggatcgtcgccggaggggaggctgaggctgctcgtccttcatcagcacctctcgttgtccgtgtggctgttctccggctccggctccggctggacaaggcacatcatgatcgagacggagagtaggctacggtgtgtgtacccgtcgtggagcgtggacttggagttgccgtggtcgtgcaagtgggagaggagcgacacggtgttgctgcgtcccatggactactccgggtccgggtggacaagatgcccactagggttgctggtcttggacgtcaccatgggggaaatgcgtactgttaataatcggagcgaccaacttgttctctacgcagtcgatctcccctctcgcatctcagcaatgaaaacctactagctctttttttcttttcgagtatacatgcatgtcggacacaccctcatatacttgcaactagcgagtattatcttctcatgcatcaaataataatccagatacatgattaattaaagcatttatacttgaaagacatagccccacgacatgtttctgtgggctggtataccaccacggtaccccggaaaggtactgtaacaggacccttcacataaccctctctaaccaatcgcaccacacctcaggtttcgcccccactcctcaaccagacaccccatggacagcccccctctcgtgccatggtgaattcggcggccgatcaaccagacaccccagccgacccaactccatcacgcccaccctagcctgggtacgtcagctagaggaaagatccactacaagcccagttgttgcccacgctggctcgtggtatgcatggtaattcttctagggtttcccgtgaaccagtccttaattgccatgggtacgactagcaaaaccattcacacacagcccaccattaagccatattttagttgaataattacgaccaataaaacatggccagatgtctcgagctcgtatagctcaacaatatactaaagtaaaataatgtaattatcccattatgtgagctagtggtaattaagcacggctaagcatatcatgattctagcaagatcaacagaagtgacacaaggtagttagattatcacccaaagtttcacaaatgacggaccacaactaagtataactaagtatagcacaagcgagcagaaaggtaatcccataatccagtgtagttagtaaaacatgcaatttatttgtaaacggtaaaaaaattgtaaattaggttcaacatgctcaaggggaatgtgtgagtgccttggttcttcaatcaatctttaaactcttttccttgtgatcgcgatcttctgaaacgatggattttatgcgccggcacgcaaaatgaggaaaaatc

SEQ ID NO: 10869 - DNA, 1501 bp, Oryza sativa
tttcttaacaaccatttgcattaaatttgaagaaaaatatacacgatggggtattccctcgagagattagaatccacttaagcgtactccatctttttttagaaagtaggatgttctggagtgacatgtgtacagtacacgattttgacagattgaccactatatttcttttacaaaatatggatatgaaaaagaagacaactactatatcaatgaaacttttcatgaaaaattaatagggtcaaaattaagaggaaaactgggttcatggtatcccaattagtatactcccttcatttcatactataaagtattttgactttctttttaagtttgaataagttcataaaaaatggtaacatttttaagataaaacaaatatattattaaaatctatccaatgctcgatttaataatacaaaattggtgttatatttaatttttaataaacttgattaaatttaaaaagtaaacggagtacatttctgtgttagcagtattttcaatatcggttctctacttatatttttttttcacaacaacagcaacatacaggaaaaataattgccccaagggattaacccggtgacacagatctgcaaccaaaacaaatgcaacactaaacaccaaatgcaacatttgtcacacaagtcccatggttgcctttggtctgatttttgcttgttatatttaattggaaatgtaacctatgaagatgcacaaaaccatcgactataggatataggatatggctcggggtaatactgaatagtggtccatcctttttttttttgaaagtaggatgccctggacatgggtactatgccaatacatggttttgatatattgatcgcccatatatttcatggtatatgcatatgaaaataaaaacaaactattatagaagggagatatttcataaaaaaatttgtaccattgttcttttatacatcaccggtaaagtaagaagaaaattggttgtatagttcctcaaatgttgtacatttctgcacggagagagtattttcaatacgaatgcttacatttttattcacaacataaacatgaaaataataaattactctggtgagttaacccatagaccagtgcattggtgtcacgggaaaccatagacgcgctgtaatttctactgcaaatcactgtttacatcttgtttataagtggtgacgatcgatggtatatataatagagaggacaccaatgatcttatatttgtgaccaaaacaaatacaattacctttttttgaaaaaaaaacaaatggaactaaaagtaaacaccaaaacgagacaggaagatagaaatgcaacatttgtcacacagggcacactcccctctcctaaaaccaaggtcagcccatgctaatgcagggcagggaaagaacaagtccctgaccactcatggacaccatatgcatgcagcggtgagaagcgtagtataaaaccccatccaacccctccccatttctgcctcaaccactac

SEQ ID NO: 10870 - DNA, 1501 bp, Oryza sativa
actgaaattgtgaaaaagcgagtcccgttgggtagagacgggtggtgtgtgtggaaagcgcggggcggggcaggggcaaaggcaaagaaaaaggctgctccaattggccctgccaccgaggcacgtggcctcttctgtccttgcccctctgcgctgcgcctcactcccggcctccctccctccccacccaaatcttcctcccccttccccttcaaggcctgggcctgggtgcttctccggggcggcactctggacggcggcggctgcgaagcgggagtgtggaagggtaacttcactgctgcctcgctctcctgcgggtttgttttttttttctcgttttttttcttgggcggcgacttcagggtggtatgttggtttcgtcggtgagacgaagattgagggtttttttttgggggttgtttttgaggtggatgttgtcgtcggtgcgtcgatttgaagctggggaggcttggagtggcaatgcggccgcctacgagtagtcctcgcgcttcattgcggtggtgtattttggtctgtgtgcttgtgcgtgtgtttttttctgggtttgtgcagatttgggattattgctgcttgtctcgcagtttttaggttttgtttggggggtttagggatgccatgtcttgcccagtgcgcggtgctttccctgttgctgcaacctcgatctagtgccggtggttcaatttgctggtttatggcttcgctaccgccgcatacttttaatttttacttgttctcttggagttcatctcaggccttcattgcctgcaatgagtggtaccttttgatcattgaaccaatttttaggtgctttacttagacgttgtttaagaatcaggatggtgtgcttagcattccttgctattattctaatggtaacccgccgtgcttgctgtttttttaagtgcaaagtttctacctatccattactgacatccaggttcgcattaagtaaaacatgaggctcacctagccaagggtgcaaaactctaataacaaccacaatctttggcagcctatgaacctccacattagaatccatacccttgtgcatgaaatgcatgcttagctgtcatatttcacaaaaacaagtgtgcaacttgccttaaatcatgaactatcctctagatggtatggtgttggactgggctgtgagattcagagactaatgatctggtttgtggatggagtagtggcatgggctgtacataacatagccaagatttctatctcccttcctttctccttgttcttctactcctaatctcctatacctctcttcttcacagatccttgccagtttctcttttgattgctgccaataaattccatgtatattacaaccaaactacacgcatgctagcacattagtcactagtgctattggtgataagcattggagatccataacactttgatgcctttatgcaggttgaggtgtgagaaccaggtggttgctccaacctttggggttcaaggaaga

SEQ ID NO: 10871 - DNA, 240 bp, Oryza sativa
ttcaagtaattggtcctcatcaacatgggaggagggcatgttgtaattggtctatacgctcctccatcacttccctagttccctgtggcataaccgggaacccgttggatatttggtcattatttgatatattttaatccagaaatatgatactaaacctaacttgtgtataatatggtggtctagtgatagtgctaaatatgaatatgctaagaacaataataacatcatttagtaaca

SEQ ID NO: 10872 - DNA, 241 bp, Oryza sativa
ccaccaccccctcctcctctctcaccgcccctctcctccgcccgagctggaacgcgaaccccgccccgagatctctgccgctcctcaggttcactcccctcttccccctccctcctcactttactctgtcgtggctccactcgctctaccctaactgactcggtcttgcaggagccggaggtgcgctcgggccgtggcgaccgccgccgccgccgctggccacggggccgctcatcagagg

SEQ ID NO: 10873 - DNA, 1501 bp, Oryza sativa
atgggtaaatagttcaattttgcttcatgcatcataagtgaattttgagtagtatattttccacaatatcatatctaggtgcattacatggcataccctactttttatttaagaagtattacatggcaatataccaacttctcctgaactcttgtaaaacttaaactgcaagttcaagaacctagcgacaagtgatctgattggaacaatgagcgtgtagaagcattatacttgtccaggaagatccacgtggtgtagggcggaatcttgtcgaccacaggcagcttcacaagctgcacgacggtcctatgcgaggcgccgctaccaccagagctcgagagcacgagcgtcccggcgaccagattctcctcctgcacatgcaccaactccctctcccccggcccgctcgccgagtcccaccccacgaacctgcggtgcccctccgccgcgccccgcgacagcgcgttgccgccctcggcgccccgcgacgccacctccgccgccgcggcgacgtcgaacagagcgcacgtgtgcacctgcagcgccttcctgttcgcctccaccctctcctgctcaaaaaccacaaaccaaaccaatccacgccagattgagcaaaatccaaccgactactcacacttccccctgcgagctgaaactgtagagatgcgtgatcggcgggcgggcgcttgccttgatcgcggcgaggcgggtggattggacctgacgcttcagctgcgccagcttcccgtgcagcgcgacgaggccggccgcgtccttgcccgacggcccttgatccggccgctgcacagcgaggccgatcagattggggaaggagatcggagtggggaatcgggcgcggggagtcgagactgaggcgagggcgcgcaccttggggcgttgggaagaggaatcggaggccttggacgaggacgacgccatggcggtgcgggtgcggtggcgcgagcggcgccagcgtccggagctctgcttcccccacacgcggagggttttttttttctgatttttctctctccttcggggctaagagacaaaggatggaaagggtttctctctctacctaatactgccgacgccacgtattcctaccccctcccccttcccaatctgtttccaatcggatgagaccccgccggcgccgcctcctcccgctatccgccgcgccgctcttcgccggcgccctccgcctcatcgcgctttccttcacactgcgctacctcgaccagatcctcgccgtgtccctcgcctccgtacactaccctctcgacccccgccccggaaacctcagctccctcctcctccgacctccgctacgcgtccctccctcccacccacctcctccgccgccccgatcgctttctccgctgccgccttctcttccgcttgcctcgactacttctccttcgccttcgccgccacctcgctcattgctctcatggcggcggcgtgtcgtctccaaccgactccgcagcccgcgcgcggc

SEQ ID NO: 10874 - DNA, 1501 bp, Oryza sativa
acacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgccatggcgtcgtcctcgtccaaggcctccgattcctcttcccaacgccccaaggtgcgcgccctcgcctcagtctcgactccccgcgcccgattcccca

SEQ ID NO: 10875 - DNA, 1268 bp, Oryza sativa
ccaaaagggcccatttactctaaccttaattcctaatatattcccttccttaaccttatcctcatttccctcccaccccacccagccatcacacgcggacagcggaaaacgcacggatgggtggcaagccatcgacggtggacacgcgcggacagcggaagcagcaggcggtggcggcttcttgtgagtcgcggcgtcgacgaccaggggcacgaccatccgtgttggcgttagcggcgcatccgcgacggcaatggcaagggctagcaccgcatccacggcggcggcggccagggaggcgcatccgcagcggcggtggcagtgacgcccagtcctcagccacctgtctgtcgttgtccctcgttggcgttggcttcgtcgctgctcctcggctcctcgctcgtcaatcgtcagccgggtggtgcctggccccacgcacccacgggtccttgcagcgacttgacgggtgatggttttcacccgaccatctctgtggggccggggagcaggggcgggggcgctctggtccaacctgccttgttgccaaccctacgcataaatcactctcgttgagtcctctctacggagttctacctgatttctcgtacttaagagggttacaccgcaaaaagcattcaacttttcggtacaccgatcaccctgccccgtgagccgtgtgacaccatgacctcgcaaagccgtgaccccccggaagcaaaatacgaggcaaaaagtcgcacagacggctttgacttccggtgctttcctccaaagccagccactagccagccttgccaaaagccgtcaactccatgcactcgccggctcggctcgccgccactcgcggtcacagcgcgcgttcctaccccgtccgcactcaaacttgtcccataaaactcacgcagatcaaccagcgttggagttggatggatggatagggacaaactgaaagattccgctcccccgcggcccacgccggtcgtcaaaatgccaccaaaatactcgctaaaacacaccagctcaccaaaatcctcactaaatcagtactatacatttttaatagcgggaagacccaaaccagctcgccctacattgaccaaatcggatcgggccaaatcctcctccccttcgtcgccgctgctgtaggctacccaaatctcgccgctgctgttggctactcaaatctcgccgctgctgtaggctacccaatcgctgcaccatgtgtggtgactgctgcggccgcggtgccgggggagccgccgaggcgg

SEQ ID NO: 10876 - DNA, 1501 bp, Oryza sativa
cccatctccttcacacggaaaacagagcggtacattagcgtgtgattaattaagtattagcattttttttaaaaaatgaattaatttgattttttaaagcaactttcatattgaaattttttataaaaaaacgcaccgtttagccatttgaaaagcttgcacgtggaaaacgagatatgtgagttggtaaagtgggggaaagaacacagccttcgtctactatagttcaaaaccctgatgctcccaaataatacatgcacagtagtacttttaatagggttttaatagaggttgtgatgtgtcactgttcttaattcgtctctttgaacatgtattagagcacacttgcggtggtgcgtgttcgtattttgtgtaattaaaaaaagaaggcacctgacatggacacggtgacacccagcacatatatgttgcgcggtcggcaaaaagatcctgtgaattaacccgggtcgctcggtgcgctgcagaaaagaaaggaaataaacaaaggagagagacgactcagacgaggccagctcggtcacctgacgcgaacgacgccgacgtggacgtacgtaccgtcgcgcgccgtcggcgggcggggcatgcgcgcatcccgacgacccgccggccgcgcgcatgcgtcatcacccaccgcggaacccgcagccaccaccagtagctaagccatccatccatccatcggccgcgcacggcaccgcgcggtcacggtcacggtcacggtccggccgctctacacgtacgtagtacgtgttggcggtggtggcgacttaattccgcgtggcgcgacggcgacggcgacgagcagtgattccctcgcggcgtacgtacgtcgatcgaaatcagcggcggcacgtaacgccggtcctggctgtgggaaaccatctgcttctggctactaccgccaccacgtacggccatagaattcgtcgatcgagtcgtcgtcttccccgcctccacggccggtgtctatggctctctacggtgtacgcgtgccgtgccggccgcgcgctcgccacataagcacatacggccagtcgggccactattctctcgttgatgtgacccaccggtaatacacggccagtagttcaggaaatccagagctaataactgccggtttcaacgagatcttactcacagtattacggctacgaatttggcagctagcgagtgtacattttgcgatatcttcaacattgtattaattcgtgttaatctaatggggctagtactaagcatttgtgcacgaactgcgtgctgctcgatcgttcgatcgaaaacggacgatgccttctagaaaggaaatctggcaaggctgatttgtcacaacgctattggccacatagagataagataaatgcagccataaaaacagcattagcccaaacaaccaaaccccaacccaaaacctccttcttcttctccttcctcactgcaacactcttcggggtgcaggcagccagagccatggcaaccatcc

SEQ ID NO: 10877 - DNA, 1501 bp, Oryza sativa
agcgtgtacgttgtcacactccctgccccccaaaggtgcctagaggacgggccagacgcagcagagcgacgccccaggagcggattccccacgagcagggagacaggagacggccatctcgaggcacatcacgatgtaaactttttcctatgtttaataacattctcccctctaattacctaccccttatcgaaggataggtataaagatacaattgaatagaagaggaggttgtagcagcactcgtatatgctaaatatcatatattaggcccgtggaactgacagcacgccaaactaataatggggggcgactcgccggagtcgaactgacataggttaaccctatcttccaataaggggaatcgctttggttacgcagttcagttggcgctaacaaccaacttacgtttgcggcccatcacagtactgactatatcttagaccattgcgatctctttctttcacttggtttttctgccttcccttcggtactccttaactcggagatactccttcggtactacttggctactaattgaacagatgggtttagtcccttccttcgggcaacgttttctccgggtaccaccggcttaccaccgggttgaaagaaatcccttactattaggacatagtgttcgatacgacttagattttccaatcttcgaaagacgctcgtactttcttgatcttatgaagaaggggcttacttccattctgtaaggatcaattaataagggtattatccctacgaaacaactaccctttatcggtaatttattattagagaataaatgaattggcttttcctgctttcatgtataagctagttcatatggagtgtgatagaggatatctagggctggaagagttgattgaaaataataatccggtagggatagctgtgtattggctcaaagaacaagaggatttacttttgatgatgagtttatcacaagtgttagtgaaaacattcattgggggccctaacgttaacaaattttctaaaggaacaccactaaaaagaaggtgaatccttcttactccaggatatagatatccgaaacttattggataagcaggatttagcaggaaatattgacagcatttcttatagaaaagaaacctacttggttgggtgggaggatgaaaagattctcttcctactggaagatggcactgttgaagtctggagagcggaagatatttaagtaaggatgttatgccaggtagcattcggtacaagagtgagacggaggtagctccgtagaagaaagtagttttgcaaagaagcttgttcttcggagtagattggcactatggcactactagcttttgaacagaagaaagagtttgttttctcgtcataagtgccaccaatctcgttcaggcactaaactagtttcggggaggatggatggttgtcccttcttctcaatagaatccgatagacaagaatcgaaagctgcatatttttttattcctcaagtaagtcagtt

SEQ ID NO: 10878 - DNA, 1501 bp, Oryza sativa
tgcttaacatttgtcttgaatctttttaaggcatgtatttgtaccggttacttaatcatacaacaatataaatctacagtatatcactaataaatacttaggaatgggaaaaaatgcaggaatcgaatgtcatgacacgagcaatcttataggaattgaaaaataaatgaattaatcaaacatgttgtttggatacaccataggaaacttgcatgattttttagaggagaaatattatcagattagagttgagagaatagatgaagagaaaaggtgccttgacttcccaaaggaaatcaaaacatgtggtttgagctcatgtttgaaatacttcaaaaggtggaggaaaggaatggtgccataggaaaatttgctagtccaatcctacaatccaaaggagcatgcaggaatagttcatatgggattttagtcctttgaaaatcctacaaaatcccatcttccaaaggaacctggaatagtagcaccatgggattcttttttttttacaactaaccaacaaggcatatgactattttttattattatggtcaccatattaccgcaagcacacttcccaaaatcttaaacggtgtggtttttgcaaacactttctctcaacatttattagaaaaatccttttaaatcaacctatcatctttctaatatttaatacattcatttcgaccatcgaataatcaccatgaactcagtttcatctattatccatcaacactttcaaacatgcccataacatgtttaaaaaagctcgcatttttttaaatgcaacaattattctcgtcaaaattatattttgtaaaatattattcaatatatttataaagtcttaaaaacactataccacatgaactactaatatgcatactcctaaggatcacatgccattccactattttctaagtggccccactattctacacaaataaatactatgtccctataatcaattacatttaatagctatcgttatttctacgcaacacctcgtaaggattaaaagaccatatttataccttaaactttattccatttatgtaaaaataccgaaatcaattcggtccatgttagtcccacataccatcatattcttttttctcattcggcccattattattttttctcattcggcccattattatgtaagcatgtaaattatgacatacatggtatgtacttattattgattttatatcagtttacttcatatttactccgtcccaatatatagcttggaccatatttgacatagtcctgtgccgtactaaaacaagccattagaaaacctgaaattttctcgaaagggtccaaatgtaaaaatttcagtaataaaagcaccgcatctattagccttcgatgttgcggtggggcttgatcggacggtggagagggccgcatccggcgtaacacaaaacactgtagtccgagcgcagagaggggatccccttccgcaccgcaccccctccccccttctctcccatctccc

SEQ ID NO: 10879 - DNA, 1501 bp, Oryza sativa
gttgtagtcgtattttttttaaaaaataatccgaatacctagattacccaggagagaaaatatcggtttgcctgttcagagaccagccttatctctctttcgttttctctcccctcgttatctcctagtagtatctcctatgtcttccaggctctctctctcgtttactctcccccactctctcctctctcccagtctctctttctctctccctcctcaaccggatgccgttctctctccacctctcgtcgtctctctgcccctgctcgcgcggatccgctgccggcgatgacgggatgggccgagccttcaagccatcgtttctgctcgcgtgatccgccgtcgacggcaacgggaggggcggatccggcgactcttcccctcccgcacggataccgtccactcttcggccccctctcacgtggatccaccgtcggcggcgacggtaggggcagatccggcgacctcttcccctcccgcacgtgtcccgtcttctctccgcccgcctctcgcgcggatccgtcgccagcgacgacgagagggttagatccggcgacctcttcccctcccgcaactgctggtacacaatatgcttgattactgctttagctagtagtatgtgtgtatgtatagtttcaattattaaacatgtccggaagttgatatacgcttactggagtacgctatattattcacaggagttattttttttcttcctcattttcttggaagaatatggatgcatgtcagtatgagaactgtcaattgttctctgtgtgatattgttggccagactgggctatatatgtacttttagtaactttttggcttttagagctttgtggcaagtagtactaattacatattgtgatggtatgtagatcatgatgatgctaattgtgcataagcttcatctacgcacctataaatgacaaaatctaagccaaatatatagcatgcttcaccagtagtcatcatggagaaccatatgtgcttttggattttcttttaaatcgacgtgatcgtcatcaatcgacctgtaaaagtaaaaatgaactgtagtctcttgttgggagctgttggacatgcatagacatagtgatcagcatatataaatatcctatttataggattatatgctatgcttaagagggttctctaatggttggtcagatttaattgtaaagctagagtacaaccattcaaatggatcatatccgatcaaggtgtttaaaagtgtgcacacaaattatgtcggcctaggaaaaacagggccaggtccctagctatattatttaacatttcctatcattaatcagaccatcaacccacttgtttggtgaaaagtttgatgactaaattcagtacatgcttttaaatcattaggtgtagtaacctagtacttaagtctagtttaaggtagtattaggtgtattattgctgaattctcactgtaaacaccaattcatctaatcactcctaatgcattacagtgatcttt

SEQ ID NO: 10880 - DNA, 1501 bp, Oryza sativa
gaaggcgaccgatcggcctcgttttcctaccgcaattaaggcaaactcactgatcaaagattcgttgcatacaagcaattaagcacgctagctactgactagctagccaggggaccttctcttctaaccacacacatgacacacaacagacaaactaattctctctcgtacgtgcagcttaacggtgagaaatggagcctatatatacgcgagaaaggttagctaccctgatcacgtaccaaataacatacagctcgatcgatcgatcgagtggtagtacacaagcagctcacctctcggcgatcgatcgatcgatgatcatgtcgtcccagagagacaaaatcctcgccgttttcttgctactcgtggccctatcatccactatcctgcagacagccgtcgaggcggcgcggcggctgccgggcgagcagcacagcgcggcccacgcgatggcgacgtcgctgcacgagagggcgaggtctctgctcatggcgtgggtggcacagctcacggcggggccgagcccgagaggccctggccactagaccagatctacagacacggccaacaactcatgcgtgcgtgcatgtacgtacgtaggtgtgtgcaccagcgtggcagtgtcgacgtcgcgccgcattgatgtatccttacgtactctaagctagctatggctgattgttgggtacagtgctacgtacactgtgctgggacaaatatgcatgagtagttgtcttcgcttatagcttacttaaaaataattccgccgcttacacacgagcgcatgcatgcatgatgtgttgttatacacgtatgctccttcaattcctgtatttgctatatatatgtacactggtttatgatactcgtccattacatatgtgtgttggaataacaacgggagaaatataacattaatgtacctggaacatttcggcttaaatgagtttcctatacggtaacagctagcggacaatctatgtacgcatggatgtcaatatatgggaaacgaagagccaataattaatgtaggtttaccgtcagagaaatcattctgtattttttttttacgaggaggatgcaatacctcttatttttaagagaaattccattgctagagttgtttgcatccttcttctcaaattgatgaaaaaaaagtaaatatcggtcacgctcttgaatatatgaaatactattgtatctattcatgagataactcaaccatcttatttacatggaacacaatttttttactcaggttgcacacattttgcataatagacacatggtacgtaatgtcaagtggtcctttttctatagttcaagtagtaattttaaaaactaaaaaaaaggtttattccttgggctgggctacattaccatatcactccaaaccacccgaaatctggttgaaggctgaaatgttaacagttttaacagttaaagatcgtagaggtgagtgtgtgtgcgtgtatacaaatgtatgcacttgtattgtgtt

SEQ ID NO: 10881 - DNA, 1501 bp, Oryza sativa
ggagagaaaaaaggtgggctaggtagatcgtgttgttgtgggctttcgtagatgggctaatagaatttagaggtagagttaaaaaataaagaaaaaatagtatatgacatttaaatcctttaaactattcaaagttaattcttgcaaatgctgatgtattattttaattcccttcagcatatttctaaattaaattaaattgttttttaagtaaatatatatataacttaatctttcatactataatctaaataaaagtattccttcaaaatataccttataaattatcttgtcaagcaaaccaaaatatatgttctaattaaagaaatatatctagagattatggaataaaatctctatagtgaatcaaatttcttctaaacaaaataactactctttcttaaaataagtttaataaaagcaaacccataacctatatagatccagtatgtgagttcgagtagaacatcccattgcattcatataaacattatcatatttagttgtgttttattgtttcttttagttgggtgtttatcttggatttctagaattctttattgatttattcattcttcgatttcgggtatctcaagcaagtccaacacctttgaccaactcttgttatattttcgtatttgcaatctatatgtatcaccttgcattaattatattttctgcaattaaaataaatatgttgaaggattcgattggttgttggagcagttggtcatattatggatgtattctaaacttgtcattgtggtgggggctcagttgcatatatttatcatcataaggttaaaaaaacaactggtatatggcatgcaagtgtcgtagcgatcgtgtcgactatgtaacagcccaggtaaccacgtacctagagtgccacaccaaaaacactcaaaaccactaactcccaaaattattagaaatttcgacagtctcccctataaatacgaacatccacgacaggcagttataagataaatcaataatgaaataattcgcacaatccaaaccatcctagttccataaatcccacataagaatacgaaccataactttaattgacatttacaaattctacgcaaaacttatgctaagcaggatcataatctaaaaccaaatttttttagtgctataaatgtgtaatccaagggtgctacttcccgcccatgcatgtcgatctcaatgtgtatctaaaatcaaataaacagaagagtgagtacagaaatactttttttatagtagtacagaaatactcagcaagtataatatggaactagaaaacacgtatacacatcatgcgcaataaagcctgaacagaaaactttctttctttgaaaagaatcatatttcaaacaccaagttaaagacaatagtagtcccatcccagacaaatatgaattgaaatagtagtttccatcccggacaattgtgaatacatcctagcatttgccggcaaagctgagtaagcgtgatcagcacttacccacag

SEQ ID NO: 10882 - DNA, 1501 bp, Oryza sativa
acttttgttctttcaccattgtggctacaacaacaactaatacccactgatgcagggcccacccttattcataaagtaggtagtaaacattgatgatgccacaagcgactggacgcacgcccagcctgccgtgcggtgccccctagtagtactagtactactacagtacactactagtactacactactactataactattagtactactactataaaaaatatatatttctaatgtatcaaaagaaatatatacatgtacaaactttatatacgatgtgtacaaactttgtatactttgtatatgtacgtattaaaaaattgaaaaaacaaaaaaaaacatcacatatacaaacattgtatatgtacgtatacaaaagtttgtatataaactttatatacatgcatatacaaagtttgtatgtgtatatacaaagtttgtatacatgtatacaaactttgtatatgtacatataaaaagtttatatacgtatatataaaaaaatcggaaagaaaaaacctgaaaggaaaaccgcaaaaaaggaaaagaaaaaaaaccaaaaccggaaaaaaaccaaacggaaaaaaccgaaaaaaaaccaaccagcgccacgtgacccctcccccatcgcgtcgctcagccctccccctcccccatcgcgccacgtgcccagtcgcgcgcggggaggggggagcgcaactgggcgctaattagcaatttcggattatggtgaccctaaaacatcaccgcgagatatagagagagagaggattccatctcatctggaaccctagcagcggcggcgatgactcagaatccacgattcccatcaccatcagctctggctacggtagattgtctccctcacgtccccgctggcatcctcgctgctacatccactgcttccctcctctactcggctgggctcctgtttccttcctcttttcttcgcttggttttcttcctctcttcttcgcttggttttctcatgtggcggcggctgtggacatctaatgcgcgatgcttttaggccagaatgtttgaccaataggttactgggagggttggtttgatgttctgttttgtcattttttaatttttccataccaaattattccttatttcccctctaatcgctagcagggtaccttcttagggcatcgccacgccttaccgccatatcgcaatagcgttgaggcgggtatgcagcgccttagctcgccataccgccttaataaccttgcaacagacagattaaaaacaagagatgcataccaacgaggcaatgcctttagttggaacctggaccactgatgcttttgcattgtgagaacctccgatccagattgtaagatccagacaattcacattagtatgtatgctttgaatattgtggattgcggattgcggattgaggatggcatgattctccacaggatggacaatcagagctgtgtaggagttgtgtgttgcattctcatccattagaatatgaacaaga

SEQ ID NO: 10883 - DNA, 1501 bp, Oryza sativa
aaagaatggaggagagagggaggataagggaagtcgggggaaaacgagaagatgaggagacaggaaggatcgagaggcgccgctcgctccgcttgctctctcggtgataagtatcagatctgacgggcctttctttttaaaaaaaagagcactctgtattttaaaaaaacaacacaagtataccatataatcggcacatatagggatttataggggttggtttttaatttttttcggtttaaagtctaatgggtctttcttttacaacttttttatttctataaggaatatttttttaagggctcatatcataaaaactaaatcctaatcatctactatttttatatttgttataattttagtttacccgtagcaacgcacgggtatctatttattaaaattgtttaaataataaaaaaattcttggcctgtccgtctgctctctttttcctatgtccttgtccttttattttgtcccctcattgtctaatcttctttcattttttatgtcaacttattaatatttgacctcaaatacaatttgtaaataaaaaaacaatactcactctcacaaaattaataagatttatttttaagatttgttaaactccacacatttttattaggtaacaatacacaggtacattcgcacaaatgtaaagtgagtatagtttaacttgataggtttcttgtggtggaaccagtcaacctgcattcaaatatttgatttgacacgggtgctcgaggcgttcgtggtaacttcgtcaatctaaatactcgtgttgtgagtgcgtttgcactatgtgtttctaaaaatatatatattctcgcaattcaaagtacattgagtacaaaaattccactcgtgttctacataaaaaaaaatatttccgttcatgatacaaattttcatccgtcgccttttgggcaaagacagtcgcattattcgtccatccattttctctcatgctacaaatcatccaaactaaacatcatttctacaaatatagagcagattatttatctaaaagcaaacaatttttttagcagattagttgactaaaccaaacaacaccttttgtcactgtacacattccgtaatcacccggtgcaacgcacgggcacttttgctagttaaatggataaaatttagaaatttattcgtgtcgttttccgaacgcaaattgcagattgttgactccatctggtcttctcccccaatttcttgctcagttttttctacacccagttgtacgcaggttacttattggatcgatcatgcatatcaatgtgttgaccagttcttgatgcatatacaattgtgtgtcatctcctaccttacaataacaactaatctggcctgttgcattgcaatcagagcttccgaccttgcaaagaatgagctgctaaaagcatttcagtgacagctcgagagtgtgtccaaacatgggggtttctccatggattatcatcttcttgttgagtgttattgtgctggttt

SEQ ID NO: 10884 - DNA, 1501 bp, Oryza sativa
tagtattttccacccaaacatgatgttaaataaatgatccataacaaactaacaacctataagtgtttattatgataaatcaaattaaaacttgttttatgaaaacctgttttttatttgtcttcaaaccgaccactgaaggaaacagtcaaacagactacaaggttcataacgcccacaccacctttcagcagcaaacaggtcaagcatcagccaggttgttcacatggtgccatcctaccatgtataccaaccgctggtttacaacaaaagttgagtttcaaagcacaagactacaaccaacatgtaccgagaaatagcatccagaaagtgatgatcagctaaacagaacttaaaactagaaaagacctggtgaattctcccaacatatagtgacatcctcctttgtgttcatccttccaactgtcctgagcacagtctccatctgaacttggcgcggaagatctcacttgccacctgcctcagaaacctggttccccactatagcactctcctgttttcctcctttttctgcattagagcccaagataacatccataagcaaacaaaatatattatatctgtaggatctttagataatttagctttgaaacaggctgaatttctagctttcaataaataccagcatacaaaagcaattccaatcaaaatgagtgactaaagtttcttcttaaacttgtttagccagggtccaaaaagatgataaacactaagaactggaccaacaccaaaagtacaactaacaacattccaaacaaagtaagctaaggggcacttaatgaataagtgttcatcttttcaaaaccctggcagaaaaggcgtttgctatctcccttttttccagccgtattaatcaaattgtcagaaccgtattttttattaacaactacaacaaaagttaaattttaattttcagtgggatctttatagaatgagctcaccgtaaagaaaaggtacaactgtattttttttttcaatcaaacaagttcattactactataaatataagtagaacagataccaatcaatatttgtcatacttttgcttacacataaatgtggcattaagtggaaaaggcattttaaaaactagtataaatagaagtggaagagacacaaatcaatacttgtcatacttttgcttaaacataatgtggcattaagtggaaaaggtatccacaaacgatacatgaggtattattaaaatcgcgcaaggagatatccccattaacccactttcaaccttagtgttaacgatgactactgaacatcagatcaataaaacataaaataaaagtgacttggcatgtgttgctctatttgatattaattgctagtgctcctgaactggaacaggatatgtactacgtagtattgggttcagcaccaacagagtaaacattgtaagacttttcattatttaaagactacttgacagaaaaggacaaagggatagttgctcataccatttggaacataa

SEQ ID NO: 10885 - DNA, 384 bp, Oryza sativa
cccaactatcccacctgaactaaccagttcattaagccaatttagggtgagaataatcacggtgaatctggtcgatcgcccataaccgcgagcaaggctattcgaatagttttactctggccagaggtgcacaactgtacccacaagacacaatccaccggcatgtcaccatgcctgcgtagacacgtgaccatgtcgagtgattgtgacaagacccttcgcataactctcctctaaccatccacaccacgctgaggtttcacccccacccctaccccgagagtgggcagtccccccatgcaccgcggtaaatccagcagctggacaaccggacactcggccgacccaactccatcatgcccaccctcgccactggtgcctagg

SEQ ID NO: 10886 - DNA, 699 bp, Oryza sativa
gcctttgatgggacaagccatctttgctgatccctagcacttgtttattccaaagtggggggagtgatggtcgatagatctgtagagacagtagagttgtatgattgcggttagtgggcggttggacaggttcagtgttttcgacattagcttttgtgatgatgcctttcttttgagcgagttagatggataaaatcagtgggtggcttcggttgtgacttgtgaggagtgagtctcgttgtagtggacctgtgggaaggttgatggatctgcgtgtgcaggttgggttcttgattattttgtttttttttttgtttgggattgttgggggatgatctcttgttcatcgaattggtggatttctgtatttttttgggcagttcttttgtatctaggcatgttctaatcaattgaaattcttttgctgccctttgcagattctgaaggcaagtgtcaacaccaagcttataaatctttgattggtcagtagttctttctgcaatctggtctgatatatatacgtatcagttgtgggagcaatggcttcaaaggcaatgcctcgagcgccccctgcagctcccaacttacagtcactgaaactgtgttctcagaatgattcttctttggagacaaccagtccgagtaaacgaagtgcattggtgccaggaaggtcagctgaatcaagcaaaccgaatcccg

SEQ ID NO: 10887 - DNA, 1501 bp, Oryza sativa
cttttgagtgacctaacgagatgaagctactgttgaaggatacaaagtctacagtgggcataccctagcacatggggcactagcaggtgaaggaaatttaattcctcacctacccttctctttctctcagccgcgccgccccttcttctcctccctcccacgcctcttcgcctccttctcctcgacagcgccgcctcctccccgtcgacctcgctgcctcctccccgtcgaccgcaccgtctcacgcgcgcctcgccgcgcctcctccaccgcggcgacctcaagcagcggcggccaaggcaccctcccgcgtcgtctccgtccaccgccgccgtagcttatccgcggcggtgttggcggtggagctcggcatctctccggccgcggcgacctcgagcgggacggactccgtcggcggcggctggcctcgtctagttcgacgccaacggctgacctcgccacctcccgtgccggttcttggcgggcggtaggcggttcttggcggcggcggccggatctggagcaccggtgagctggtcctcctcgcctcccgtgctgctgtgcctcctcacctccatgtctcccgtgccggttcttggcgagcggcggcgagttcttggcggcgggttcttggcggcggcgaggaggaggggaggagtccccggcgagcggcggcgggttcttggcgagcggcggcgggttcttgccggcggcgggagcggcaagtcctccgccatcagcgtcgctccccacctcgccgtcgtcctcctcgtcgtcggaatcggagcaggcgggggtggtgttgcaggaggagtccgatctgttgaatcttgttgtgatgattttgctttcgttttcgttttcatcttgttgaatccgatctgttcttctcttccaatcttcaagattttattgcttatctatcaatccgatctgtggcgggagaaagaatgttgtggcgggaggggattttgggagggtgaatcaggaattttgctgccgcgtgaggggattttgggcgctaggccacgcgagcacgaggctgcgccgcccacagcgtgcgtgacccgccttttctcctcgctgcgcgccctcgttttggcgaggctttgcgtcgctaaggtaggggacgacgaacctagctaaggcgcggtccctccctccacggcggcaaaaaacctacgtggcatgactaagccactgtgaggggcctaaggccctgtttagatgggactaaaacttttaagtccctatcacatcggatgtttgaaaattaattataaatattaaacgtagactattaataaaacccatccataatcttggactaattcgcgagacggatctattgagcctaattaatccatgattagcctatgtgatgctacagtaaacattctctaattatggattaattagccttaaaaaatttgtcacgtgaattagtttttatttatgtaattagttttgtaagtagtctatatttaatactctaaattag

SEQ ID NO: 10888 - DNA, 1501 bp, Oryza sativa
agtaggaaacctttgtgtgaacatcttttccttcaaatgttgttttgtactatttccgttctttaatagatgatgttgttgaattttgacataatgtttaacaatctatcttattattagtgtaaatatgtaaagtacaagccatgaattttagaagtattactagaaactttcaaaatttagaccaccgaatatgaatcaaaattcatgttgcaggagagtaggaaaaaaaaagacatgtgctttcatctgtgtgtgcggcaaatatcgaactcgtgactcgcgatccgaatgctacttgcgccaggatggttttgcaacaattgcatactagttatataagacttataatgttaatattctagttacaatataattacagtataattatattttatttgaaagttataacttaaaaaactttcaaaagtaacatatgtactttttgatgataaaataattcacagtaaataacatttatataaatattttggataagataaatgatcaaacatcatttatataatcaatgacgttactaaaaaaaagtggagagtacgtagctgggttctacatctactgatccaatcgtgtcatccaaggggtggtagcgattcctgccgtggtggcgcctttagagcaagtttatagccaactactaacttcaattcatctataactaatctaatagctcatttatacaataattacatactacactattaatatctggtcccacctgtcatacacacactgtatcttaaagtttgtgctacagctggctataaatctgtagcccgctgctcttctctctccttatttgtcttcttaaaatatgtttgcagctggtttatagcctactattgtacctgctcttaagttacatcaggccggtgtcaattaggcaggcaaggcttagctagctagctaacaaatactccctccgtattttaatgtatgacgccgttgacttttcgatcaacgtttgactatttgttttattcaaaatttttgtgcaaatatgaaaatattaatatcatgcttaaagaacatttgatgatgaatctagtcacaataaaaaaaagacaattacatacattttttgaataagacgaatggtcaaacgttggataaaaagttaacggcgtcgtacattaaaatatggagatagtaccaaaataagtaactgccaattattaacagagcggcgatcatcaacaaatcgttgtgaattaatccaagccgtccatcttcacccgtcactgtcactcgccacactataaatagcacccaaatccacccccacatattcagcaagcaaagcaaagaacttcccttgcaccaccacctgatcggagaagtagctagctgcaggagagaaaccgaccaacaatgacggagtactactccagcaccgtggacgagtgctacgagaccaccggcaggcagcacggccacgggcacggccacggtcacgggcacgggcacgggcatggtggca

SEQ ID NO: 10889 - DNA, 1501 bp, Oryza sativa; identical to SEQ ID NO: 9557

SEQ ID NO: 10890 - DNA, 1501 bp, Oryza sativa; identical to SEQ ID NO: 9558

SEQ ID NO: 10891 - DNA, 1501 bp, Oryza sativa
ttgtttgttggggtaagttgtaaccagatttacatttagatcccatttgcaaaccaactgcccagtttaatcattatgcgcactacaccacatcagtaatatttctctaatatctttgaaaagaaagtgagatgatccacagtccacaccatgctagagctacaaaaccaccatatgggtgatataaactccctttcaggtttcaacaataactaccaccaccatttgtaacttctaatggatatcatcagcatatgcatctagtggtgtgttaccttgcacaccacacaaattgttctttttttagataatacgccacacaaattgttaatcaactatatacaaaatcactaaaaaaaactacacacatatattactgggtagtaactaacaataaatttatagggtttgccaattgccatcctagctagccaataaaaaaagtgacagcaacaagtgttgctcccctgccccatttggtaggtccatcttaccccctccctttctttctttgcctttgccaattcacccccactccacacacaaacacattcacattctctctctctctctctctctctcctcttcagctatgataaatatacctgcaatcaccaagccaaaaaccagacagcacttcacttgggagtgagatagcctagttgaagtagtaggagaaggcaaagccctctccttcatcccttctccttcaacatcgtcatcatcaccatcatcacaaggttgtgtgtcaactcagctcgatcaagctagctagctactagctgccactactgcagctgtagtagtatagcatccaatcccacagcctagctagctgtggtgttggtatagtggcttgtgtgtgaaaaacacccgagagacagagagattttcatccatcgatcgatcgccatgccgcctcaggagttgcatggcgatgatcatggccgccaccaccaccaccagacacccgctggcagcggcgggggcggcgccggtgacggtcaccaccgcgacttcagttctccaccttcaaccacttcttcttcttcttcttcttcttcttcttcttctaccaattctcccaccgccaccgccgcgtcgtcctcttccaccaacacctccggcgccgccatcgtccaccccactacctcaagtcacccctccgtcgcctccggccaccactccgccgccaactcttaccctcttgtcctcaaggtgagtagacaagtacacatttgtgtatatatacatatatactactctgtcaaaaaaaatgaattcctagttacgaatctaggttgatctttttttgggacggaggggtatgtatgtatgtacgtacgtacgtacttgtagagctacgtgcatgagcatgttgacatatgtgcatgagggaggttggtgatgagacgtgaccatgcttttttttttgtgataattggtgcagttcgaggaggtggtgtacaaggtgaagatcggcaagccggcggcggggtgg

SEQ ID NO: 10892 - DNA, 185 bp, Oryza sativa
ctgttctcccactgtgtgctactgccgccgccgcgtcgtggatttgtcgcgtggggtgaagtttttgggcttttgtgtgtcgctgacggggtggggcccactccgggttggtcccacgtgtctgtcgccgtgtggcgggggtctaatcgtgcgggcgtttttttgtgcaggtctctcgccgttga

SEQ ID NO: 10893 - DNA, 1269 bp, Oryza sativa
catatttgaattactatctcatattaaaatatagctatattatcttaaggtagttatatttttagatagcgggtgtagtttttcactagaactacaaatctatatgatgagtagggtgcgatggcatattgttatatatcgtctatatttgtatatttgtaaggaacgcatcaacagtgatgatcactattcgatgcatgcctagctatggttttctttgttatgttttttcacataaaaagtacattgtctatgtcattcacctatagtttcataataagaatcacttcatccagcgttgggctcatggtgactcgccgtcaccaagtccgcctatataaacaacatatatggattgcttatacggatgaactgcatttatacctaggaaaaatatgtagtggaaactaaaaactatcgctgtatctaaaaatgaacgcatgagatttgtccacgtcaactagagtaaaaattttactcccagcattactttggttgacgtggataaaactcatatgtctatttttagatctaacgaccgttttcagatttttagtgtatacgtggtttgcactacatatttttcatagattttcaggacctactctttgttgcttacatgtaaaaacagagtatgtccattgaggcacttcgtgcaatgcaaatctatatttcgtctcagtggtttagtaatgaaatcaatatttttttatattctattgtactagttctcggaaccgtcgatagctttgaacctgagattacaattccggaacgaaattctgaaacttcggtaatttcgcccccaccggcaagcacatatttcacacgaaagtttccgattatcttttttcagtttttgtgaattggtttaaaatttattcaaattcattcaaaattcgtcaaactttcaaaaaataattagggaaagaagtactgaaattccaaaaatttcggaaaccctgcttcgaaccaaaaaaatatctgctccattaggaagtccgattccggggctaaatcggaatgttcagttctaatccgatcagtccctcgttcttctccgactgttaatcggactcgaaccaaacagttcccacgcgccatatagcctcgccatccatgatccatccatggcgacgcacacccaccaatcgaaacctgtagaagaacccatggctgcagctacgcaagatcacctcccttcttctccggccggccccgccgccgaccaaccacagggcggcgggcgtacatccgccttgtcataga

SEQ ID NO: 10894 - DNA, 160 bp, Oryza sativa
tgtcacatggtattcctataaatactcctaagtcgtcatatggcactataataaaccaatggaaccattacattcaactactaaatttatctctttaggaaaaaaacttaatgaattgatttaacgggagcctcaaggcccacctcgcttgctcccccga

SEQ ID NO: 10895 - DNA, 1128 bp, Oryza sativa
tatcattaccctcgattattgtttggcaaaatttgctatatgatatctaaaatttgtgtaattggttggagaacactgaaggcactattttataatttttggagaaaaagtggacaaacattttgagtttaaagttttcaatttccaaatgaaggttttgaaatttgagttgaatgtttttggagttcaaattaaaagtgttgaaatttggttgttttttcaattttgagtttaaagtttgaaatttttcactaaaaaattcccaatttccttttcagatttgagtttgatacactccgtaaaaaataatgtgcgtcattgaaaaaagaaaatcatgtcgcaattcacattgcctatactgtcctcaccaagatcgagtcggtgtttgtaccgcgttcctgttcctcgtagttctatgcataacagtgcaagccattttctcctgtaaaatcaaagtgtaaaatcaaagtgtgtttgattgttattctgtgatgaacaattggcatatgagattattgattttgatatttggagatcattgacgaagtggttttggagatgattgatttgcaggtgatgaacagagactgttgctgacaggtagtgaccggtcaggccgggttgttgtagtcagtcagaccagaggtatgtgtgcggttagaccagctagctcgtggcttgaccggccggctctgtaccggtttcggtttagggttgattctttggatatccatggacaatcaatgtttattctagatggatactatgcatatgtaatactgttgttcgctaacaatgagtcaaattggtgagaacttgtgctcggatattgtttcttggttgatgcgtttgtaggtggtcttgatgcctcgggagagtgttgccggtgatggatcgggagtcaacttgggataagatgacgtccggacgatcagaatatcacgtgggatatttaagctaaagatcaatacacgtggttgtgtgtatgggatacatagccgaatttagagggagtccaaatttggttcaattggagtttgtaaagtttgtttcttgtacggaaaggtttcttaggggattatgacttcttgtacaaggttggtctgtggctttaggctgcttacgttg

SEQ ID NO: 10896 - DNA, 1501 bp, Oryza sativa
tagaagctatttatacaattgttaaaggttgaaaagatccaaactaatacatccttatttgaaaatacaagaaaaatccaaactactaaactactaaactcctaatctattaaactcttgaactcctgaactacaactatgaattccacaggcaaaagctcgagtgtagactagcctagaagaaaaactcgtcattgtcatagacctcgctatcttctagtcttcttgttagcacaatatctatatgttaaattatgcaagggtgagtacttatgtacttagcaagacatattataaataattaaaggtgaagagatatgattaaatacaacaatgataaagtaaaggagaaataaaaaccataaatcatctttatcctcaacattttaattttaaaactacttatacttcaggagtagaaatcaccttgatgacatatctccttaaccgggagcacggtgtatttgaatacagtacgactctgtagtgtctgcccagctttacccacacgatgagaacagtttgtaatgctgaaaacaccatagcgttcgagagtcccacttactactagttactgcacagtggggtcttggctcatcatagtggtcgaactcttgccaggcctaggcaaggtatctatatcatcacacttttcatgagacccactattgtgaaacattgccgcccaaactccttacgcaagttcaccccaaaacctgctcctaacgagccacccaacagtctttcatatagtgagacaatatactaggctaagtccaattacttggtcgtgtggatgggtacaaactatgtcatttccatggtataagggggtaattataatccggttaaaccacaaaaaattatctcaacatccaaaacttccataccaacaaacttcatcataaattccaacattcataactttcaacaatcacaacatcaactcaaatgcccattttaaccggattcctaagtttgtaaaggtatttgaataataaacctcataaaatgataaccatgcatctttctattactgttgatggtccttaaatcataatatctgaccgccaatacctgcatatacggaataaaatatggtattcaacttagtggtatggtttattactaatcatttccactaatgttgctatatatttggatgtaggtgacaaactaacaaagttgagaggaaatatacatgaagaaggaggataatcaaacgcatatccaaacttatagagttttggacccaaaaaacccaattaaacacctccaaatggcccaaaccaccatgccaatgggctaagggcctcaaaattagtgtccgcgaggaaaaatgggctgaacggagccgtccagggttcggctgaaccaccagttcggccgaaccattcatgaggccgttgatcaccatttttcatgtggacggtcatgattaattcctaatggcggttccgggccattttggacattttgcataggctataatcgtcatacc

SEQ ID NO: 10897 - DNA, 1501 bp, Oryza sativa
gacgaattgcctccgccttgatgctgcaactccagctgccccacctgagccttcaactcctccatctcgacttgcaatcccttgacaacagcatcaacttgtggcttccaacttgacatggtttgatccattcggcgaacgatgacttgagtctcgtcctgctttgccgccatcgctccgatggagttctggatcccagcgagcatcttctcgaagtctaccgccttgttctccatcgcatcaacctgcttctgcaatcgcgtcttgaaccgtggtttctcccggatgagacgagctctgataccaaaatgttacgatcccaatctgcaagatcaaacgaaaggaagaacagcaacttggagagaaagtaagagaaagaaacagagtttgagacagagctgagacagaggaaggatttcagaattgggatagatttatttccaattacaagaattgggatagatttatttccagttacaagtcatccctctctctagtctcctagacactatttatatcccttacttagtctagatccttccaatgtatttcggatttgctctcacttggcgactgggccgaactcgatgaggcccattctctgcatcatctttgttgcatgcacgtgtatctgatggcgtgacaccaacgtcagctgtgacgtcaccctgccgacgtcagccatcgagtagaaccgacgtggccagccaatcaaaaggcgaggccggcgccgctttcttccgctccactttgtcggcgtcgtgtttcccttctccctctcctctgcaaaccgacctttgccgtctataaatagccggcgagaccacccattccctccacacaaacagagcctctctccatccatgtcaagccgccacctaccgtcggccgatctccctcaccggagttccactggccaaatacttgcgccatcgggcttgccttggtgaggtgaactcatttttctagtttcccctctctttccccctccgaaaccaaccaccacagccacctcctcttgttgtcggagctgtgctcttgtcgccgccgttccggccatcctcctctttacctctgccttcctctaccctccccgggtgcgtgatgctcgggaacacgcttggacgccatcgtcgaggccgttcaaccaccggagcaccgacgcccttctccctccctctcctctgtacccggctggaaggagaagagaggaagaagaagacgagaaaaagaggttgaaggagcacttgacagtgggccccacttttataaagtaaccctttttccttttattttattttcaatctttagggactcatatctttccaaccacaaatccaattccagtgaacctttgatcaaaattcatctaatttcaaactcttcattttgacaccaaattttctattttttaaaaaaatttatttaaattttcttaaatacttttctttgattcatttatttccattctttaaaacctttttgaactaaattttattaa

SEQ ID NO: 10898 - DNA, 1501 bp, Oryza sativa
gattcgatagtcgaacttgctgtacggtctaacgtacgaatacgaaaaagatagcaaataaagcctataagcaaattgctacaaagaaacgataaaaccaaggaataaataaaattggagcaaggagaggggaaaaaaggaatgggttcaaaataattttttgtttgaaaaacaaaagagaggttttggtatctcaaggctgagaatcaaacaaaaacaaagaaaggataaaatgggtaggcagggtttattcggtggatttggttttctagtcggtgctatagagtaaggcaacacgacggctagatatttggatttgttagccgatgctaagatgggcagcatagcggctaaatatttggctcgtctagtcgatgctacagttaagcagcacaatggctagagagttgggaagtttgtacgggtttgaaaagtgttactctacagtcatgagtgacagcagagcggttaggagcgcacatagctcaaggactagtgtgcggcggttgtggaggtcgggagagcagtgaaacttcgaccactttacgcgtcgaggcgtggggtgcaagaagtatcactttgaccttcggattaggttataccgggctttacaaccaacgatttgacgtcggggttcgagaccacgcgaacttcttcacaaaaggcgtaaagttcccacaacggccttttagtggctaaaggatggtaaaagaataattgaaaatttagagataaaaaatggtctttgaataaatcaaaggaatttaaatttaaagaaaggtttttaaattcaaaagtatttaaatgaatttcaaattcagaaattaaataaataaaaggtgttggcggatggcatgaggctcttcgaccagatctgccgaaacccgtggcgaaggctatggagcaagaacggcgtgaggcgaagagtcgcgcgagggccttgccaggccagggacgtctcgggcgaagggtgcaaggcgaagactatctgccgaaggaagacgacttcaccatgtcggcaagtttgcccccacaagggccgaggaagcctttctggcccatcaagcctaagggccggcgatcgctagacggcccatcaggggcccatgagaccctataacattatgtacccctgtaaatgtccctttcatatgggtaatcatgtaaattcccctgtacaacctagatcctagtagtaagagcctgcaacagggctataaatagcggccagttaacgggggatgtaacgggggatcctagggccatgtaacgggggatcccaagtgaaattcaaaatttagtacacttcattttcccaaccactgttgagtaaccacgtccttcgacgtatacagttgtcgtttcgacaacagctggcgccgaccgtggggactccgagcgaaaccactaagagcgaatgccaccgaagagggtcgtgaaggagaaggtcgtcaggcggaaggagagcgacgccggaccggacatggccgccgaggaagga

SEQ ID NO: 10899 - DNA, 1501 bp, Oryza sativa
gaagcgcggcaaaataataccagctgcacaagtaacaaacttcatttgcaggaataatgtaggtttcggcaggagcatcggtcgaaagggggcgccacataccataccacatggtttacacggtctcggccgaagctccaatctcacccttgcccgcgaggggcctgttggcgaatggcatgaggctcttcgaccagatctgccgaaacccgtggcgaaggctatggagcaagaacggcgtgaggcgaagagtcgcacgagagccttgccaggccaggggcgtctcgggcgaagggtgcaaggcgaagactatctgccgaaggaagacgacttcgccatgtcggcaagttcgcccccgcaagggccgaggaagcctttccggcccatcaagcctaagggccggcgatcgctagacggcccatcaggggcccatgagaccctataacattatgtacccctgtaaatgtccctttcataagggtaatcatgtaaattcccctgtacaacctagatcctagtagtaagagcctgcaacagggctataaataaccccctagggccatgtaacgggggatcccaagtgaaattcaaaatttagtacacttcattttcccaaccactgttgagtaaccacgtccttcgacgtatgcagttgtcgtttcgacaacaaaaggtatttaaataacttaataaaatttagttcaaaaaggttttaaagaatggaaataaatgaatcaaagaaaagtatttaagaaaatttaaataaatttttttaaaaaatagaaaatttggtgtcaaaatgaagagtttgaaattagatgaattttgatcaaaggttcactggaattggatttgtggttggaaagatatgagtccctaaagattgaaaataaaataaaaggaaaaagggttactttataaaagtggggcccactgtcaagtgctccttcaacctctttttctcgtcttcttcttcctctcttctccttccagccgggtacagaggagagggagggagaagggcgtcggtgctccggtggttgaacggcctcgacgatggcgtccaagcgtgttcccgagcatcacgcacccggggagggtagaggaaggcagaggtaaagaggaggatggccggaacggcggcgacaagagcacagctccgacaacaagaggaggtggctgtggtggttggtttcggagggggaaagagaggggaaactagaaaaatgagttcacctcaccaaggcaagcccgatggcgcaagtatttggccagtggaactccggtgagggagatcggccgacggtaggtggcggcttgacatggatggagagaggctctgtttgtgtggagggaatgggtggtctcgccggctatttatagacggcaaaggtcggtttgcagaggagagggagaagggaaacacgacgccgacaaagtggagcggaagaaagcggcgccggcctcgccttttgattggctggccacgtcggttctactc

SEQ ID NO: 10900 - DNA, 429 bp, Oryza sativa
gtgaaaaagtataagttaagattatagtttctttgatgataaaacaagtcacaacaaaataaatgatatttatataattttttgaataagacaaatggtcaaactttatgcgaaaagtcaacgatatcatacattttgggacggagggagtatgacaaatagattggatacgcagcatggtagagattgtcgcttgcgtcagtcatcactatgctgtgtgcacatgtgcctgcaatccatttgctcatgaatgtgggatgccatgtgctgccttttgcctaaacctcttttgttaatgggcaaagacaatactcctcttgtatgtaagataaaattccattttaagtagtatttccctcatgttcttccttccttgctttagtgttcaattccaaaaatgcaaatttaacaagtatatgttcatggaaa

SEQ ID NO: 10901 - DNA, 1501 bp, Oryza sativa
ggccgacggcgggttagggtttcagtcgatttatttaggtcatatgataaaatcttaaaatctgtccgaaaatctctaaatgtggagctgaaaccagttgaaatcacggaccaaaaggggatcatttataattttcttgaaatcagtggttgttgttgctatcaatggatttggggagaaactgcagcctccgcatctcgctctcttgtgcgactctcgatttcaaacagtgaacggggatctcgtgcgagattgcaaggtgtggtcagagtggtggtgtagatccttcacaacaaagccacacctgcgaagccccacacggatggatgccacggcacggcgcatgatcgaacggctttgagacacatcgcgcgatagggccatttcgattttatatatttggatcatttctcacattttctcagagcgaccgacagagatcgatatatcctgataaacattatgttttacggatacacataatcttccacgacataacatacgaattttctagcttaatattttttttctcgctagctttatttaaaatggaaaggacacatcacacactacgcctcacacaaaaacgaaatacatgttcgcatatatgcataagcctctactctataaattacaaatattacagaggcgcaggcttctagactaatagcgtatatacatataattgtaatattacatatgtcactttatactagtcttttgcaatatgtagttgaaagtttatgtgaagaacttatgtagaatttgtaattcgtgaagaacttacatatgtcacattatatacgtatttcttctcttggtaccatttgaaattcgtgactttaaaacgatatgcgagtactccatgtagcaatgatccaagttacaattaaaaagttttaccttgagagctttctaaaggtagataaacaatgtaatcctgttttgattgtatacgaattctccacgtagcaactactacaagttacaataaaaatgtggcattgagagctctccagaagtagataaaaacagcgtagcacaatcctaatcctgttcagactgaataggaccccaagtactacaaatctacaatatcgtgcgcataaaaatcgaacccccaacccaaggccccaaaccttatttccgatcgtcggatccgactcgaacggtcacagccgttccacgcgaccccgacaccgatcctgaatcaaacggcacctcgcgggcgtcaaaaatcaggagccgtgctgccgctgcggacctatctttttttttttctctctcgttttccctcgggctacgcctcttcctctctctccgtccgcaggaggccgcagccgcttcgggatcgggaagcggaggagaggggaaggaagggagagaggcaggcgacccggccgcccagcttccccccctccctctctctctctctgtccgccgccccccctcccccctaccaccaccaccacccgccgccgccgcacgatgagctccggcg

SEQ ID NO: 10902 - DNA, 1501 bp, Oryza sativa
ttttgccctttttttaccgcgtcaacaaagtcggattcgtttcaattttttttccttttttccctttttttggatcagacagatttgttttttcgtccattttttttgccccttttttggatcggattccttttaccgctttttctttggatcggtttttcttttcttttttcgcacacgtttttctttacccggttttttattggataaattttgtttttttcgccggttttttgcccggtcttttttacggacgatggaagcacctcttattttttaagtagtagagaagagatatttcacaaatataatgagaaaatcctacgtcatcgatcctaaattcattattatcttgttccgggagatcagatgggaccataaagaatgcaagcataggccagttccaattttgtgaaagtgtgcattgtaattctttttgtacatatgctacattgaaaacacgagttagcatattgtgaaaatgttcttatataactctttgatcaggacaatgaaaatcataacacataaagaatcttcgagttgaaaaagttgagatgcaaatgcacctctaattttttttttgagagaaatgcacctctaaaattagtggcttagagagggtctcattcggaatatgcaccactctcactccacttctccttttcgtggccgtgctgacgggatggaattttctaagcttcgaacagtacatatatgcatggagctttcccaatctatgcgatcgatgccggcgttttgcgtgtgacgtggctttcatcattttgggcgccgtgagctttcccttgcgtagaagcaagacaaagatcaaccgaaagaggtataaaggcccagaccagatggaaatgatctagtttggtttttctatctactctttttggccggacaaggtacaatcgtcatgttcaatatatgagaataatcatgaaaccgtctattttgagaattaccagttcccgtgttaaatttatactaacatatatatacacatattttatttgtttcagtgccacatcgataattgatgataaaaaaactcaacttaaaaaggtgaacagttatcagtttttatgttaatttttggtactatatatttttatggcgtcatatttttaacaaaatataataagatttttcttacaatgtaatacaagggtttacgctatatttttcaaaacttacactgcagttacaatgtaatttttaaaacttacattataattacaagaaaaagatacgaattaccctgaactatagcggtcgaccaaattaccccctaaactcgaaaaccagacatcgttcactctgaatttttaataccgaacaaccccctccccccacagcactgttgagaatggtttagggttcgaatagcacttgtggccgtccagtcacagcaaacattttttttaaaaaaaactagggctcacttgttagagtccccacccccatttctctctcctccctccccttctgaagc

SEQ ID NO: 10903 - DNA, 1501 bp, Oryza sativa
ttgctcaggagaggagtgcccggatatatgagggagatggaggggaggataaggagagagaatgagggaggagtggataaaaatgagggagtgggacatttttttaggtggagagaggttgactggacttttcaccacgcgagcgcccaggaaaatacattttttcatgttgatttttttaaggagctatatgtgaaaatgctgactgatttttacagggacgaccagtggtggtcagtatgcaatctataggataacctcgtcaaaaaaatcattttttttaatagtgccatgatgaaggtaaccagtaacgcgtgtccttaacccattgccaggacatatagagatgagataggcagatagctcgtagtagctccctttatcggtagcgctatccgtcgagttaaacagttccgcaacaaggagtggaggccgaggatgacacgcacgccggaaagcgaaaccaatggcgcggcctgccggccaggacggctccgccgcgggtagcccagcgaaaaatttcggcaattttgcttggtccaacgcgcaggctcctcggcgtcggcatcacggcgggggaagcaaccgcgtgcgtccacatgaaaacgtttgttttctcggcaggcggccgatgtttgatgggttgccgacttgccgtcgttttttttgcgcgttagcacaagcccagtcacgatggcacattggcacccgtacggccgtacggtccatcacgtgtaggaaattgtggtgggtgtgtgatcgcttttgctgatgacccgtggttttttttggtttactgttaggatgcttcttacgggatgaaaacagctggaaactatcggaatcggcagcgtctctttgaaacggatattcgattgtaatgtttatcatttaaattactcaatttttgacgttaatacaataaagaggatattagaaaaaacaaaatttgtatatagcaaaaaaggtaacggtcgaaaacggtatccattgtatggaaaatgacactcggtcgatcgggaatttatgtgatcattttcaccccttcatatcttggcatgtgaattgtgaaatagaagctccaactcctcggaaaaaaagacccctttgaatcgtataaatggaaaaaggaaggaatagaaaaaaacatatgattatgataggaattcaatgcaaaataggggattgcaaaaaaaacacacacacaagaatgatcttctgattgattggattgtagaaaaacatagaaatcagatgggataaatatactcgaagacaattttccaaaatttagtacaagacatccaaaaatgtgtaattagctgggagacaccgtaagaatgcgtatttgctataggacaccacgaaaaactggtaattagctgctggacaccagcaagttatttcgttatatcttgaggaattggagagagaaacaacaatgtaagtacaattctacccttttgattttttttttctttttctctattcttctctactc

SEQ ID NO: 10904 - DNA, 682 bp, Oryza sativa
aaattacgagtttagattttaatcgtgtagattggttgcaaacatatctagcataggaactatctagcatgggaactattatataagaaacaaaaaaaatgtagtttttctaaaaatgttatatcacatcgctaaaaaaaaattgcgtggaaaaatcggttttgcactacaagaggtttaagtgaacatgtacatgaaaacccctttcagagtgaaggtgaaaataagcagattcaagagggcgtatatggaaaattcaataaaatacgcacaacaaacttatcccgaatagtcacagttcctgcaccacccaccagaaccttcccgatcaaaaacctcgtaacaccattcttacctttctcgtctttacccacctcacctacacctaaccaccgtgggcccgagaccccaccataccagcgcacacagttccaggcgccttaagttgtgcgttactcgcgtcgtcctagcacttttcagccactctccaccaacggcaatgctagatctagccattcacccccacccccccccccaacacacacagtcacccactcacctcgacaaatatggcaatgacttgtgggcccagatctacgtgggccccacgtgtcacgggggtaaacccagccagcgtctggaaaacatacaggtaggggggaaagagccggatcaccacgcc

SEQ ID NO: 10905 - DNA, 1501 bp, Oryza sativa
ttcttttcctatcatttgatttattgttaaatatacttttatgtatacatatagttttacacatttcacaaaagttttgaataagacgaacggtcaaatatgttttagaaagtcaacggcatcaaacatttagggaaggagtgagtactagataatttgtttgtatgtgttgtagattaatatgccaagtaattgtagtgattaaatactagccagcatcactacgaccaagaggattgtatcaaaataaatgtgaaagatatgcagcaaatcttcaataatttcaggacttatcaaataaaaaatccaccatttatcaggtcattctactaaaatctacgattgcaaaaaatcgtaagacttcattacttgtatttatttgccactccatacatagttcacactacagcttcagcattgaattctcacgtcatatacagcagtgaaatttgaaaatatcgatctgaaccgatgtttaatacaaggttttgagaaaaataaacaagcggaataagtttgttgccggctgattccctcatgaaagtccacctgaaatttaggaaaacaccaaaagtgtggcgatatatatagtcatgggtaatgtgtttgaaaatttcatccaccaggaatttgcactcgaccttcgtatctttgattatgtgtcttacatgtgttccgcaggtgtgtgagtgtcatacatgtttattttcttgtaatgaaaaaataagacaatgtaggattcaatttccaacaaaaaggtaacattattcatagatttgccaaattcaagtgtttttctttttttttaaaaaaaaaggcagatgtgctactaccaaacggatacgcatatgcacgataagcttgcccggtagtacgactcactaattcaatggtaattttgtcgccaactaagctgcaaccctgtacattgctcatttgtcctatctatctttacacacaaatcgcttactataactacaaattaattatatttgcaattgagcatcggttgcaaccctttacctaactcatttcccctacgccggcaaggcccacggcgtccacttcgagatgaagggaaatggacaattttaaattcaaatatagtacacaattgcaaatgtaaatatttcaaacgaaaactcatatttgaaaatgcgatcgattggtataactaaaacaaaatgcatgtccccgtttacaattccaaaactgcccaacaacttggaccgaattattcaacaaaaattattaaacaaaaatgtttagaccgatcgagctttttttttcccacaagtttgaataaattatgagagagaatttggcgaaatcaggctaaccaaacatgtttagcgtgacagacttctcctccctccggttcatgatcaacgagccgagcgcgatgagatggcttgcaaacttgatcccttgctcaagcggtgccaccatggctactggggcgcggaacaaagagcctacacgagccaactccggcagcagc

SEQ ID NO: 10906 - DNA, 450 bp, Oryza sativa
ggagagctaatgcttatgcttattgggtattttggtttgacactgcttcacgcccaaaaagaaggcactacgtctgagctaaacttggatatggaagtcttctttcgtttagggtgaagtaagaccaagctcatgagcttattatcctaagtcggaacaaattagttgatagtgataggatcccctttttgacgtccccatgccccccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagca

SEQ ID NO: 10907 - DNA, 352 bp, Oryza sativa
tcaaggccccttaaccccctttaacgttatgtaaccctgtaaacgtccttttcataagggcaactatgtaaattcctcatacaaactagaccctagaagtgagaatctgtaacggggctataaatagcccccaagggccatgtaataaagagagagaaatccaagaaatcaatatacttcgtttctttccaaccaaggccaacgatagacaataactcccccccgaacacagcttacaactttcatcgtactgtgctctccaaagagcaactcttctcaaaatctcaaaacaaaaggtgctgagttggaatcccattctaaggattcttgtggttccggggaatccagctac

SEQ ID NO: 10908 - DNA, 1501 bp, Oryza sativa
gtacttaccacaagccagcgtgggcaacggctgggcttgtagtgtagcttttctctagctgacgcatccaggcaagggtgagcgtgatggagaggggcgggccctgcgacggcctctgtcgcttccggattcacctaggcacgagaggggactgcccgtcgcccgctggggacaggggtgaaacctggggtgtggtgtgcttggctagaaaggggttatgcgaagggtcatgtcacagtctctttccgatatgtcgtggtggcatgtcggcgcatggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacgtggtgtaacgttggatagtggatgattaatatcgtttaattattacaactattttcgcattcgacttctatttataaatgccagtattatgcaaatgaacctgtatagctatcccttgttgaatccctgcatcatacccccattccggtatgacttgctgagtacagtggatagtactcagtcttgctttattttcccccaaccccagagtgtgagtatgtgtctgatggcgggttctccgaggagtaggcttcgtccgtgccgtcaaggatgcctgtggagtggtgttctcgctgcagttccagtcaaggattagctcctgttatctttctttttccgctgcatttatgtaagacttttataatgtttgtaagacgtggatctgtatgtcaacattgtcgtttgtgtgccccggccggtcctggacgggggttttaatgcacattctgcttggaattctattcgggaatttctgggcgtgacaagttggtatcagagccgaccttgaccgtaggacaagccaaatggaaacctaagggccctctgaatccttttcattgcatatgttctttgcaattggaattgttccgggaaaatttggggatctgttcttgtggttcaagggacaaatcttgttgctcgtttaagtgagatttgttaagacaagtaggtctagggttttagtaaaattatttgagatgtttttgaccgttagttgggatttgatgggcgaaatgcattaggtcttagctcaggaatatgggttgtaaggtatttatgcttttcttgttattataagtatgtatctaatttccccattattttatcgctatgtaagtccgtcttatttattcgctctcatgcaaaataatctatgcataaaatttcgctcttattcgattctcttatttgagtcctttatttttatttaaattggatttgagcatgcattgatcctacccctttgtcttctctagatggccgagcacccacccaaccaccgcggagaaggcatgggtgatttcgtggcagagttggcacgca

SEQ ID NO: 10909 - DNA, 1501 bp, Oryza sativa
cccgcgtggtcccggtccacggtggaccgcccccccttgagccactgccgagtggggcccgtgtgccggcgcccttccccctctctcccgagccaccgaccggtgggacccacctgtcggcgccgcccccccttggtgacgtcagccctgggaattattgcccaataaattatttaaggactttttgttatagtaataaacacagtgaatcttctaaaattcataactaattcatccgagctccgtttaagccccttcaagtctcagtaaatcaagaaaaatgtgtagaatccattaaaaatggttttgttctctgtttcagtagacttatagcttgtttgcattgtttgccttgtatgttgttagattccggctcttccgacgctccggcatacttcgaaatagtcgccgaggttcctccagcagcagagcaaggcaagtcatgcttgtcacttgatcatgttgatcctacattgcaaatgttctattgttttccttcaaatagtgcatttgttttgcaataacactatgggatgtttacctattgttacagccatgctattttggtaccttgctcctttgttagcttgggttatgacatgaatagactttggactaggaattgcttagccatgcttagttcaactagcacacaatggggaaaactcatttaaaatatagactgtaggtttatatgataatgttggattaatcccaccgctctggtgttggttaattaaaatgaatcacatggtgggctatggttgcatggttttgctagtcgcgcccatggcaattaaggaccggttcgcgggaaaccctggaagaactcctcgtacttaccacaagccagcgtgggcaacggctgggcttgtagtgtagcttttctctagctgacgcatccaggcaagggtgagcttgatggagtggggcgggccctgcgacggcctctgtcgcttccggattcacctaggcacgagaggcgactgcccgtcgcctgctggggacgggggtgaaacctggggtgtggtgtgcttggctagagaggggttatgcgaagggtcatgtcacagtctctttccgatatgtcgtggtggcatgtcggcgcatggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacgtggtgtaacgttggacagtggatgattaatattgcttaattattacaactattttcgcatttgacttctatttataaatgccagtattatgcaaatgaacctgtatagctatcccttgttgaatccctgcatcatacccccattccggtatgacttgctaagtacagtggatagtactcagtcttactttattttccaccaaccccaga

SEQ ID NO: 10910 - DNA, 1501 bp, Oryza sativa
agcagtggcggccgtcaacgcaagaatccagcggtggcggccgtccacgcacggatccggtggcggccgtccccgcgcgagatccagctcccctcccctccccttcctttcgtgcctagatctggcggaggggaggggcgtcggcggctgtgcggccggaggggagtgcggatctgacggcgggtggcgcggaggccggcgggaggcaggctgcactatggcaggcgggcggcgggcgaaagcctaccgccggattctagggtttcgtttttttaaaaaaaattatgttttttcggatttttgtgttcccgtgggttgcgccacccgcacacaaaaatcgtcatgttcccagacccctaggtgcgtgcaggccgcctacccgcacgcaaaaatcgttttagccctcacacaaaaatcttggttgtagtagtgaatggtgaaagtaaaggtggaaagtgagagctagttgtcaacatgaggggtagaaacgatttaaaggagttggcagtggtttgagcctgtgatcccacttgtacttcactcaaccaagtatgagtggctgtctagtggccccatgttgatgtttcctaggagaagatgagaggtatggtgaagtttgggtgtaaattggactttaactccctctctctgtttctttgtctctttgaaaatataatttaggatcaaagagatgattcaccaaggttgtttgcaggtatttggacgacaaataggcccatatatagatgattcactatgttgtgaactctgtgacattcgtgtgacgaatatcattcgttacctatcatgcatctctaatggcattctataaagaaagcttatctttttgttactaatctatgacgtccattttcgtcgccatcaagcccagaaatcgtcataagatgccatgtggcctttcaaggcccatgtattcagggcaagcttggggggggagcggtacagccgctctaggctcccaaatcgcaggggcccccacccacacaccttgtcgggtcccaaaattaaagattgggtaacctacatgtttaaactatatcaatgtcacaccctgaaaatcgcctaatttaataattcagtttttaatgcatttttagaaattattttaaaaacctacaagctaaactcctataatctaggaaaaatttcaacataaaattgaactagataaaattttattaaatactttgcttgtttatctattttctagatttttctgggaattatttgagcaagggaagtatttttaataaatgaaacatcatttcacgaattattttaattgaaaaagtctttaaaatcctcccctaggccgtttggccgtttccagcccaacatccttctccctcgcacgtggccgtgcagcccacgccgtgccaatccaagccgagccgcccctcgtctcctctagtcgtcgacatgtggggcccacatgtcggggtcatcccgtacctcgggccgggccgagccgagcccgagc

SEQ ID NO: 10911 - DNA, 1501 bp, Oryza sativa
aattaatcataaaatatttaataatcataaaatatttaatacacaattaatcatacgctaatagttcaccttattttgcgtatcttttcaatcttctccttttctcttctctcgagcacaaccttagacacaggtttatcctcaaaagctgtttatttatggaacataaggtgtacttccttaggtcaatctaagcggtaatgcgctttgcaatagatggagttttctcttctatcgtggaggttaatataagttatatcataggttcagtttaatgttatggaaaatagcatggtcttcatacgtgattataaaataaagtgtgtgtgtgtgtttttataattgtctgcgcttgcattgtgtttcgcaaagaaaaaaaaatcaaaaagtagaacctttctagaaatctttgaaaaccaaacaaatgatatatctactatactactatttgtgtaaatagggatgaaaatggtagcagtaattaccaaccaaccggacggtcgtttctgaagtttactgatcagacaatacggaaatggtaattcctagaaacgaaaattgtaaaaaatacagaaacggtatcggaaatggttggtgatttaccaaccgttttgtcggttattgtattttttttggtaattaccatttacatatttcggtaaattaccttttttataaatatctctggcccaagttatctccaatggcccattcccttagcctgaatataccagtcccagtgtcccacgaggttgtgataacgctaaaccatagagctgctcctagttggtagttcctcacaccgttagttcgtattaatatgctttatagacttacaattatatgtcattgaagttataactattgtcgaatacttgatcatattatcatttatcaatctattatacatgtttgtacgtatttgtgttgaatagagtgaggatgaatttgtctcatgcaaccatgctagattgctatctaaatgtgtgatgttatagttcgttgcctctgacatgaattatcggctttcaatttataccgtcatgtaaataattatgttttcgatatatctccgtttccggcctaccgtttttattccgtttccgaaaaataatatgaatagggaaatggtttagcgtgtttcctgacccttttttatccctacgtgtgaatgcacgcacggtttcatggcacattggcacagacgttttgcaccccaagaacctgttcaaacgaacacggttccagccttccacacgacatggatgggatggacggttggatttagcaccccgaaacgagacgcccaattttcaaatttcaaaattcgaatcgccgtcacaacggccgcaactccctctcaccaccacctctccatatataaactccccctctctcccctccccttcccatccattccccttcccccaaatccaccctaccttgccgcgccgccgcgacaatccatagagatcatcgagagaggagtccaccggagcca

SEQ ID NO: 10912 - DNA, 214 bp, Oryza sativa
cgctgctgaagtcaagcttcccggtttagctcgctgttatcttttccgctgatatatacatacaacggaggtagccatttgcaccatatccataatatacaagtaggtagccattcgcaccttatccataccaggacgatccatttgcaccttatccatatcatcacataatgcttctgcctataaatagcagcagcaccttacattcaagaat

SEQ ID NO: 10913 - DNA, 308 bp, Oryza sativa
cccccccccccccccccgctatcagaggcgaagtgtgcgcctttatcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgttttctccttttttttcccttattgacagg

SEQ ID NO: 10914 - DNA, 1501 bp, Oryza sativa; identical to SEQ ID NO: 1481

SEQ ID NO: 10915 - DNA, 290 bp, Oryza sativa
gtgtggttgctccacgtaaaacacagtgttatacacggtatccgtcgcgttactgcacagttttgtgagacgagagctaagaagaggtgggtggtgaggggagttaataggtgggtgtgtctgagctttgatagacgggagggggctttgaccagtgtgtgtctgaggtgggaggtggtttttgggccttaaaaaagagggggaggtgggtgtggcccttcagagagagggggtatagaatagttattctatatatacaatagtcttacgctatatatatttcgcgcata

SEQ ID NO: 10916 - DNA, 170 bp, Oryza sativa
cggttaaaccttatccccgaaccggcgaaccttaaccaatccgccgccaaatcctctcgggtcgagccgatctcctccagctttggctataaatagaacccccaagacctcctctttcgtttccaacccctagctcgagctcccgttccctagccgtctctccccgcagc

SEQ ID NO: 10917 - DNA, 1501 bp, Oryza sativa
gaccattattacttaaaaaaatttagaattattatttattttatttatgacttaatttattatctacagtactttaagcacaacttttcattttttatatttacataattttttttaataagacaagtgatcaaatcttacaattaaaatattaaaatcatttgtattagggggcggagcggcggagggagtatgaactatgatcaataatgaatcgtggtggcattttgcatcatgccatcatgtagggttgactgccgaaaataggtagatgaagggggtctagcttgtagattttagatggtgttcttttctcctgaaaatgaagatgaaaattaagtttttttacgcaaaacgatatggtattaatgtatgattgattgaattttaattattataaacttgaaaaatagattaatatgatattttagggcaactttcatatagaaagttttcgcacgaaacgtaccgtttagcagtttgaaaaacgtgccacgaaaatcttaatgttcatccaactcttattgaagaaaagatcaggattttttagaaacaaccccaccttttggcttacaattataatctgtaacggcttattaatatgaagtaatttataagtaaatttttttgatttatatgttctatcaggtatagtaagcatcgtggagtactaagaagaacactgaataaaaaatatttattattttgctatgtatttgtcctcacctctctcttcatgctattatttgctaaatggtatttcctccattttatacttatataagtcgtttgattttttcttagtatttaactaaatttataaaaaaatagcaacaactgcaacaccaaattagattcattaaatttaactatattttatattataagtcgtttgagattttttagtattgaaaatgtaattatattttctacaaactagtttaactaacaaaaaaaaagtatacgacttataatataaaacagagagcgggagtatactattattgcttgttatccatttgtaaatttttaacaatagtttttgttgtggttggtagagatacattggtctgcctgccgtagcagagtttgattaagctgggatgtactaattgatcatttctcacatataaagcgtataaattatattagtacttcaaaatactcctataccgttagcacagcagcattttaaccccttttgtttttcactgatatctactccctccgtcacataatatagggattttaagtttttgtttgcactttttatcacttgtcttatttaaaaattttagaattattatttatttatttttgacttgctttattatctaaagtactttaagtacaactttttattttttatatttaaacaaatttcttgaataagacgagtggtcaaacagtgccaaatggagtaacatatgatataataatctcattagacatagcataatctgacccacagctcgccgtggctaacaacgcatgtcacctt

SEQ ID NO: 10918 - DNA, 1501 bp, Oryza sativa
cgtcaccggccggtgccgggaggaggggttccagaacaaggcggtgcgccgcggctgcgaggcgcttgggctgcgcgtcgaggccgtgtcgcgcaactcgtcggaggggcacttctgcggcagctgcaacctcgggtgccccaccggcgagaagcgcggcaccgacacgacgtggctcgtcgacgccgtcggccgcggcgccgtcatcctgaccgggtgcaaggccgaacggttcatcctcgagacgaacaccggcggcggcggcggccggcgcaagaagtgcgtcggcgtcgtggcgaagtgcttgggcaaaggcatcaccaagaagctccggatcgaggcgaaggtgtccgtctcggcgtgcggcgcgctcatgacgccgccgctgctgcgcaacagcgggctcaagaaccgccacatcggccggaaccttcacctccacccgggtccatggcgtggggctacttcccggacagcacggcggagctcccgggcaagtcctacgagggcggcatcatcaccagcatgcaccgcgtcaccgaccgcaccatcatcgagacgccggcgctcggcccgggcgcgttcgccgccgtggtgccgtgggagtccggccgcgacatgaaggagcggatgcggcggtacgcgcgcacggcgcacgcggtggtgctcgtccgcgaccgcgccgcgggcaccgtcggcggcgagggccgcgtccgcttcaccccgagccgcggcgacgccggcgagctccgcgccggcctgcggcgcgcgctgcgcatcctggtggccgccggcgccgccgaggtgggcacgaaccgcagcgacgggctgcgcctccggtgcaagggcgcgcgtgacgaggacgtggaggcgttcctggacgaggtgagcgtggagaaggggccgatgcacccggggtcggacaagtgggcgctccttgcctcggcgcaccagatggggagctgccggatggggaggagcgccaagcacggcggcgtcgacggcggcggcgagagctgggaggcggaggggctgtacgtctgcgacggcagcttgctcccgacggccgtcggcgtcaacccgatgatcaccatcgagtccgtggcgtattgcgtcgccaagggcatcgccgagtcgctcgcgtcgcgcgcagcgcgctcagtggaaaaccgtgatgtgtccacgaaccctcctctagcttgtgaatcgtaatacgattattaacttcttaattaatactgtgctttattttaagataatgaaaataaatctcagcgtttagcgcacgagcttccgggcaatttaacagtttattactctctctaattcatactccctccatccaaaaaaaaaaaagacaaactattatgtctgtgttcaacgtttgaccgtcggtcttattgaaaaaattatgaaaaaattaaaaagataagtcacgcataaaatattaatcatgttttatcatctaacaacaatgaaaatactaattataaaaaaaatt

SEQ ID NO: 10919 - DNA, 1501 bp, Oryza sativa
ggtaaacggatcaattggagctttctgcaagcatagcagaccccattttatcaccacacacaatttatattcatagatgtttggtataattttagataaaaggaaattccattaagtaatgaaatataaatagcataagaacagccgatggtacccttccatgagaagcctcctctcggacatacgaccatagcctcaggccaaggctcatctgaaatttttcacattccaaaaaacaaatgattagcagatagcagcattaaaaaggaaacgacgcaggtgttacagaaatcaaactgcttgaacaacatgcagagaaccaagcgttgtaacataccatcctcattgcttccatgaaggtgacgctgaattccttgagtaagttggcgtggctgttcagacgccgccgccatgcctgctccggaggcgacccgccgtcgaagtccaactgcgaaatccaaagcatccccagcaaaatcaaacacgcgcccacaggaagcacaagcccaaaaggaacaagaaattggactcaccaactgcagggcggttcggccgacgtactcctcggccggccacgagttcctccggcagtggaagaggttgccgctcaccatcccgtctcacccccaatgccaccacgcccccgatccaactcccgccgatcggaggcacgatccacgaacaaatcccctcccgcgccgcgccgcaatcatgcgcgcggatccgatcccccagcgccgcccctcctcctcatcgcgccctcctccgatccgatgccgccctctgctcccctcccctccccacctctcgatcgattcaaccaaaccagatcaaaaccaaaccgaagcgggcagcctctcgcggagaggactctccagtctccacccacccgcgcgcgccgccgcgggaggcagttgctccacgcggagacgagaagaccgcgaggaggtcagcggaggaggaggctggactccgaagcgaagcgaagcgaagcgaggcgaggcgaagccgcgggaagaggaaggaagagggtggagaaaaggaaggtggttgcggttgcggcggtggcggtcggcaagggcggctgtgtgtaggcagaacgcaggcaaagcacggacgcgcgtgggggaagaagaaatcaaacgggcgtgtgcgatttattgcgtggccgtaccaatttccggggagtccgtccgttgcccatgtttcgtcgtcaggtggtaaaattgttggcgataccccggtagttatcctgcacggttctttattactcactctatcccaaaacaatatcaatagttttgagtttttgtctataattaccattcatcttatttaaaaggttatgaaattattatttattttatctgtgatttgttttattatcaaaagtattttaagtataacttatccatttttatatttacactattttttaaataagatgaatggtcaaacgttaccagaaaaaatcaaaactacacctaatttatgatgggtt

SEQ ID NO: 10920 - DNA, 1501 bp, Oryza sativa
ggatatttgggaggaagatcggatgaatttacaccattagatcaaatatactagtagtatatactagcagtagaatgtacctaaaagtccgtgtttagatcctgaaaaaagttgaaagtttgaaagaaagttggaagtttggaaaaaaagttaaaagtttatgtgtgtagaaaagtttttgatatgatatgatgtgatgaaaaattgagaatatggaggaaactaaacacggccttggtgatggcagaaataagtaataaaagaaagaactggttagatggtgacggatgtgtttttttttctcactgttctcaacttcatacatgctttctaaactattaagcattgtgttttttataagaaattttatataggaaagttgctttaaaaatcacattaatttattttattttttaaaaaagttactccagataatacttaatcaatcatatgtgtcagtgagtcgctctattttaagtgcgcggaagataagttttcaactcaatgaaaaaaacacggcatgagctatcacaaaccgggagaagacggcatggggcagcgacgagaggaagaagatggagtgggttgtgggggctatgaatcgagagtatggggctatgggattgttgatggcacgtctttttcaaagtttccttgttgcaatttaggtacgtgaagatcgaacccggtgatgctctgtctcgtgattactccaaaatattcgaatgctgacaaaaaaaattttaatgacaattttgtcttaagcctgattactgatcaacctcataaccaaatacggccacgcccatcattgctgcccattacgggaatatgactgtgtttagtttcaaacttttttttaaacttataacttttttgtcacatcaaaactttcctacccacaaacttctaacttttccgtcacatcatttcaattataactaaacttctaattttgacgtgaactaaacacagcctatgtatgagtacggtgtacagtctctcataactctagtacagcagaacgaaattaaaagagacggtgttgagcagtgagcatatatacacacgcgacgccggccgcctcttcacattcaattcgacgtacataagctccaattccagctcaaatcaacagctaactactgaacagtaacaatcatttggcaggaccaaattttgatatgatcaactcatgaagggaatgcatgcatcttggtacatgcagtcgagagagagagagtgcaagtgagacttacatatcagtaaacagtaccatagataacgtgcatccatacatgcctacagctagccccgcctctcttgttcgatcatgatatcatatatctcaacgcaagagctaattaaacagtccagataagtaagccaaaccctccttttttttttcgattcatattgccgacgtttgatgtcgcaatttcatttacatagtatagggatcgttggtactaggatatatgcgagattataataaaagaga

SEQ ID NO: 10921 - DNA, 336 bp, Oryza sativa
ctgactgggccaagcacttgattggatgaggcctcaggcagctgggtaaaggccgctggcttcaccgtcgtccttttccccgtcggcgttcgcatcaaccttggtcggggtcggattgggccccaccccctcccaccgtcgacgttttgggggtcagcgtcggcatcagcctcggtcgagttcgggctcaccccccctcccccttggcgcacaagtaagccctcggtcgagtttggcattacagtagcttttttagcaaaacatttgacaaacccccggcgcttgcagttgcaggttgcgtcccgcggcttcctagcgcaccctgtatatacaagg

SEQ ID NO: 10922 - DNA, 516 bp, Oryza sativa
ataattacaaatgtaaatacaataatcttattttcagaaaataaaacttgtttcatattaaaagatttgttggtcaaacatttttaaagttaaattttatgcacgatctggcaggtattgtaagattaatttactatatatacgtacaaccgtgactaacttggattttgattgtatatatttctctttagtctcgaaatgtataccaactttaatgagagacctccttttcactcgctcttgtggacacaacaaatagataccaacattaaactgtttcccagctgccctattaaaaatgtgaagttcaattttagtcaataacgaaagccctattgttgctccaaaaaaaagatttgcggcttccttaattaaaaatgtatatgaagtaacttaacagttaagattaaaccatttatgtggctgcagctactggataaggatatggatttagagagacaaattttattttaaaaagatcctactttctactgaatttaataaagcatatattaa

SEQ ID NO: 10923 - DNA, 1501 bp, Oryza sativa
aaaacaagccacagtgtctaggtatagtacaaagtcagaatataaagccattgcaaatgctatagcagaaataatgtgtgataaccttacttactgagttaggagtcaagaggcctagagctgctaagatatgatgtgataaccttggtgctaagtatctgtcagcaaatccagtgttttatgccagaacaaaatatatagaagttgactatcatttcgtcagagaacgggtaagtcaaaagcttttagaaattgattttgtatcaactaatgatcaagttgcagatgggctcaccaagcctttgtctgtgcgactgttggagaatttcaagagcaacctgaaccttgcacggtttggattgagagagggtgttagatgataaggttagtttggatctggtttaaccgatcctatcacatgcgataatggctgatctgttagagtttgttgccttatccattatcgcctgtaatccatctccttgtaagtcggctaggtttgttgcctagctgcgcaattctttgcattgccacggcatggtttttcatgtcatatatatcaacacgaaggcgacacacaggatcagtgcaatcgtttccaccaatactttccacacgatcgtttccaccaatactttccacacgatgtgctgctatgccgaggaggaggaggtggcccggtgtcacgtcaagaaatttaacccaaatttctagactattttgtgtattaaatccctatccaggaccagccagggtgcacaaaacgacaagtaatatacagttccaaacataaataaagcgtaaaatacttacagaagaggcacttagtcctcacaccgaaagagaacgacgacagcgaaaaaaggcgatcctagcggggcttcagctctactccacaggcaaaactcaaccggggtctaagccttggtactctaacttcgtcttcagctcagaagcactacacttctaaaaagggggaacaatagcatggctgagtacaaccacagtactcagcaagccacaccaatgatgtagacgtgcaaggagatacaagaacggtttgtcactatttgcatagaggcggatgtaaagcattttattgagtaaaacagtaaaactgttgagtgatcaaagtaacattggatctccaccgatcaacgctacaccacgttgaacaggcccaaccaaaccacctgaactacaccagttcattaaccaattattaaggatgggactaatcacggtgaatctggtcgatcgcccataaccgcgggcacggctattcgaatagttttactctagccagaggtgcacaactgtacccacaagacacaatccaccggcaagtcaccatgcctgcgcagacacgtcacaatgtcgagtgattgtgacaagacccttcgcataaccctcccataaccatccacaccacgctaaagtttcacccccacccccaaccccggaggtgggcagtcccctcgtgcgccgcggtgaatccggc

SEQ ID NO: 10924 - DNA, 204 bp, Oryza sativa
ttcatctttttgaaattttgttgttctcttgtccactttctaagaaatacaatcaaatggacaagcatggctattgctctcttatttgttctcaaactgcagcatataaatacacaagatattctgttctgtctggataaaacatgtatttccttgacttgttcttcattccatgtttgggattatggttgatccggttgcagg

SEQ ID NO: 10925 - DNA, 1111 bp, Oryza sativa
aaatgagaatggggtgaactttaggtgctattaaagtgaaccgatatcttcgatgctataaatacaaaaacgtgaactttcaatgctatataaccaatttttcataaaaacaacgataactttgcagtgaacctagcttatgccttcaatgacacaatcaactcctagtctctttttgaattgcctttttccggacagactctatacctagtcaaacaaaagggcgattcccgtgctcgccctgcttgatcgagctttcatcaactactggaataatcttgtagctttcatcaactactggaaaaatcttgtccaaaaccccaatgtgaaatcactcaggcctcatttgacagaccgggatcccggcccatatcccgagaaaaagcccgctagaaaattttcctacgaccatatttcctgaccagggtgtgtttagtttacgttaaaaatagaagtttagttgaaattggaatgatgtgatgaaaaacttgaaagtttatgtgtgtagaaatgttttggtgtaatgaaaagttgaaagtttgaaaaaaaagtttggaactaaactcggccttagggtgtgaccgtgtttagtttccccctattcccaactttccatcacatcatatcacataaaatctttcctacacacataaactttcaactttttttccaaactcccaactttcttcaaacttcaaaacttttttcaggaactgtgtttagttcacaccaaaattggaagtttggttaaaattggaacgatgtgacgaaaaagttagaagtttgtgtgtgtaggaaagttttgatgtgatgaaaaagtctgaagtttgaagaaatattttggtactgaacacggcccaagaataagttcatcgaaggttcctcaacttaacaacgagatttttcgaggtcccttaaccacaaaatcaaaaatatatacccctaaacaaactcactgaaaccgttcaaaaagaggtatttttatttggttttgctgacgtggcatcctagtcagaaaaaattacgtgggacccacatattagctgcacaattttttccttctcttttcttctccttatcttcccttttctctcctctcttctccggcagc

SEQ ID NO: 10926 - DNA, 1501 bp, Oryza sativa
gaacgatgtgacgaaaaagttagaagtttgtgtgtgtaggaaagttttgatgtgatgaaaaagtctgaagtttgaagaaatattttggtactgaacacggcccaagaataagttcatcgaaggttcctcaacttaacaacgagatttttcgaggtcccttaaccacaaaatcaaaaatatatacccctaaacaaactcactgaaaccgttcaaaaagaggtatttttatttggttttgctgacgtggcatcctagtcagaaaaaattacgtgggacccacatattagctgcacaattttttccttctcttttcttctccttatcttcccttttctctcctctcttctccggcagcgggcggagagccaggggagtggatggcgaaggtggagccgggtgtgctactggcgctaccgccgcggcagacggaacaactaaccgaccatcgctgctccgcctgcctgctacgcccgtcgaccgctcgccgccgcgctcgcccgctcccgcccccaccgatgggagcgaggcggccggcctcggcggcgtgagaggggcataggagggccgagagaggggcggaggcgacggcggcggtgctgccgagttcctttccctgtcactggtcgctgaccggtcgagggacaacatcgacgccgtgttcaacccccaatggcgccgtacaattctactgcttgctatataacttaacgattataaagcttgaaggataaattgaagcttcgcttttcttgagctatggtgtttctttgcgttttcttctttgcagcgaggtgaccaggcgctgtacaacgggttcggggccgccggaatgcatggtgacgccgtcatgcagccgccgacattcgggcaggtacgcggccaagaactcctgtgggttcaacttatcccccgattcattctgcttctttaccagcgttggaaacaactgcctgccgccgcgctcgcctacccccaccgctcctgcctgcttcgcctgccgccgccgcgctttcccgctgtcgccccgcccgtctcggtccgtcgaagaagacgacagaagagaagaaaatcttaattttaatcttaactatttaaaagatttggatttttcctttcgtcacatcttcaccccgcgcggtttttagtcggtaaccccttttttcgtccgtaaccctgttttttttttccgcgttttccgtttttcccaccgcagcgtccacaacagcgatttctgctatccgatttgtgatcggatctaatctaatatgacgctacttttcccaccccatcaaaaaaaaacaccgattcctactccagcgcaaatcacgcaaaaaaaaaaatcccataccgattcctactccagtctaacagattaagcccacaagcccaagtttaaaaagaaacaacaccgattctaatccagtttgcgtgcacaggttcagtatcccccacaccgattcctactccaatttaatattacattacattacaggcaatatat

SEQ ID NO: 10927 - DNA, 1501 bp, Oryza sativa
gtacgaacgcacccaaaaaactccaatatgtcgaaaaaatcatgttttggtgctttttgaactttttcattccggtcaaaaaacatcgcacccgtgggggctcaagatatgccaatattggcattaattgaaaaaagttcgtcgtgcgaatcacggagtgagtttttgccacgaacgcacccaatacactccaataagtacaaaattcatgttttggtgctttttaaacttatttaattcatcttttggtgattttcgaactttttcattccggtcaaaaaacatcgcacccgtgagggctcaatatatgccaatattggcactaattgacaaaagttcttcgtgcgaatcacgaagtgagtttttgccacgaacgcacccaatacactccaatatgtccaaaaatcatgtttggtgctttttgaactttttcattccggtcaaaaaacatcgcacccgtgggggctcaatatatgccaatattgacattaattgacaaaagttcgccgcgcgaatcacgaagtgagtttttgccacgaacgcacccaatacactccaatatgtccaaaaattttgtttgggtgctttttgaactttttcattccggtcaaaaaacatcgcacccgtcggggctcaatatatgcctatattggcattaattgacaaaagttcgtcaatgtttttgctacgaacgcacccaaaaaactccaatatatccaaaaattatgtttggatgctttttgaactttttcaatgtcgcgtcccaaaacgactctaaaatacatcctcgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaagtccttttcccccccccctccccctcttgggccggctcggcccatctctctccctctctctcctctcccccgcggcccattcggcatcctccccgcgcgcgtgccgccgacgggcgggcccgcccgcctccctcgatgacgggtggggcccacccgtcatccccttcctcccgccgctcccgccgccccgcccgcgccctagcgccgccgccgcgaatcccgccgcccccgtccgccccgcgtgcaatcaataggggggaattattccccgggatcccctccccctttccccccatttttccctctctctctccctcggattcgttaggaaactcctcccctaacctcgccggcgccactaatggcggccgggtctcccgcgcccgtttccccctcctccggccgccctctctcacacccaaccctatataaaccctccccgtgcctccctccaccgtttccgccactcgccgctctctctccccgccgaaatcgagc

SEQ ID NO: 10928 - DNA, 1067 bp, Oryza sativa
tggaccgccggttcttttcccccttccctccccctttttgggccgccgttccgccgtgcctatggccgctgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtgggacccacggtgccggccggtgtgagcccgggtgcgcccggtccaccgtgggccgtggggctgccgcgtgggccccacccccatggacccggtccgcgcgcccctcccctcggctgacgcaataaatccatttttaaattaaaatttaaataaagaaattcgtaaatattcatttaaagagcatataaccttcaaatggccataacttggccatttgaactcggaattggaccgttcaagtctctaatttttccttaagaagtcaagaacccatttttgtgctttgttcctgcttgttatgtggagtttattagagtaaaagccttttcttttccgttggtcgtgtagacgctgcagcttcggaagatccactcttcgtggaagttgaagccgacgtttgggaaagcgagcaaggcaagtcacatcatccttgaacatattgaatcccagtttataaaattatgttgatttaaattattgcactatcgctttatttaaattcccgcgtaatcactgttttatctagccatgcctatttaactttgttatgaccttattattgttattgttattatttccttgttcaccctagaataaacaaaaccccaactagtggacactctactcatggtaccactagtatgattttaggtagatgcttcgctatttaattaggtaacattaggtggtttttcaattctagactttgggatattctcatcacctggacactatggaatggatgaattattgtggaattggattcacaccgccccctctattcaaaatctccaaaaatggttttaggctgggctcagggtgcatggttttgatagtagcacctcggccatataaggaccggt

SEQ ID NO: 10929 - DNA, 1501 bp, Oryza sativa
gggatgatgcgaggacgccaaggagaagaagcaaagcaccaaatttgagagtttggcccttcaaaaaaaaacttatttaaataataggccaatgcctaaacttaaaatgaaaaactacccacagcctcacccctgatagtgctaatatccaatatctcaacgccgggtgttttggcgccgacctaccaccgccgtgacgctatatgcaggcttttttaaactaatcaggtagaaaaagtacaaattatatatgtcaataagaaaaagtaaaaaccaagatagttatgagaaaaaatgagaacacctagcttcttcacgaggaaaactcaccaaacacctcaaacaataaccaaacttacagcattagctcgcggggatccgatgccgcgctgaaagaaggggatagagagagaaaatagataagagagttaacatatgggtctaagggcatttctgacatttcacgtggtttatctcttcttcaaccagaaattgttattttaatgggtgaggtgtccagcagtaaatatccaactttgagagtgtattcccttaaaagtcacttagtacagtgtcctataactaaaacgcaaagtcacaataccctgcagcaaaatttgtcttactgtaaatctataatttgtgatacaatattttaaatctatagtttcgtaataaattttgcactaaatatgtagttttatgatacacattcttaaatatgtagttttctgatagtttggtaaaagtagtgaaatttaccttttttttatagaggaaaactagttgtttccattaacccatagtttcaacagaatcgccgataaccaagacctccacacccggaggtgaaccgtcccaactgagaacagagttttggggactgttacagccaaacgatgctatagcatctgccaatttattatattcacggggacaaatagctaactcgaaaagaaataaaagtcgaagctataatcttcttcgctcccaggacaagacccccatcgctgcaaattgtagattaccttccttcagagcttgaaccagcatcagtgagtcggactccagctagatgtgcaccatacgcctgtgagctgccgcttctactcccttcaacgcggccaaaacttcagcgtgcaagtttacgttttatttcaaaataagttgggaacaagtttttttttttttcaaaaaagagatgatcgtcaaaatttgggaagccgaaagtccatggcggcccacctcgaaccactccggagctgggcccaaacccccggcgtcctccggcccatctcagcctctcgccgccccccggcgaggcgatccttatccaccaccgtttcgcgtcgcgtcggcaccagcgaagaaggggacacgcgacgcgaccccgcggccaccgatccggcggaggcggggcattcccggcggccagatccgcggcggcgccgaggatgacgggagggggagggggtggaggaggcacggcggcgcaggcgta

SEQ ID NO: 10930 - DNA, 1501 bp, Oryza sativa
cctggatcaggtattggctatcagttggagcacagccatcggatcctgtggagcgcatcctctaccgtgctggaattctacctccacctccaatgctagctatggcccacaagggtgggcctcgcgacagacgtcctattgatcccatgactgggcgccccttagaccttgagggtgtcacagttgttgatgattctcatactcccaagagtggtgatggagcacctaacgaggagacagcatagatgaggcatgatgatatatctgttttagcatattgtgtggttttgcaagattaaaaagtactgtttgtggcctttctgatgggtgtttgagcctgtgactagtatgttgtgacctttcttgctgaccggctttattgatctatgctcctgtcatctattctcaggaacacgaacctggaaacatgagttgttctttttgataaaatttgtatgttgtgttccaatgaattttacaaacttgcatgcattatatttctctcggtctttattcacttgttggcttcttcaagggacaagggtagagtaaggcacaggaagaagttagcaagggttgtgctgggtatgtgctaatatcttaggagatcattttgtgtgtgatagatcctatagtagcagagtagttgcacgtattttctctgaagcataaagttcattgtccctggatggttattctttatttgtgatacccaactggaagctatcctttatccaatctgttaggaaagatggtatgtttattttctggatctacagcggtagaattaggcatattttttggatacctagtctgtagttttatactgatgaatttttttagatttgtatgcagtataattagatgtgagaaattgatacctttcttgtagttcttgcttcttactaatgcatagccaaaattgtccccttggaagcactgttcagggataatcataggatattctcacaaataggagtgtgagactggtacataaatattaaattgcactagttgatctaatttgaatgccctaacttatttcacactgcattgtatcatttatcatttatgtatacttcacataaaacatagtattttaggctgtataaatggtatttatatggacaatgagaattggttaaggctgatgaaacaaagcatatgtagtcaacagctgaaggtatacacactcaccaagtacaataaaactgttagtcatctcctaatttcattttcacctttatcccttccattgttacataaggtatatcttctcaatgaggccacctcatacatgcaaaatgcaaaatgctaaatcaatctcaccaagaaaccctttctttcacatctcaaacaaactccaatcagtttaaagtctccatccatgtctcaaatctctcaaatcatttccctccaaaaccaagaacagtggcaagtctctctcatctagagactttagcttagctagctaggctacacgccatggaagcaccaagaa

SEQ ID NO: 10931 - DNA, 424 bp, Oryza sativa
cgatggcacacatgtaagggtgaagagatcctagagctgcggcggcggcgagggggtaggggaatggacacctagggttagcatgtggttgccacgatatttatagcattgtactcctcgtctactccttaggatgttgatccaaccgctcacgatgtgagcgcctgccaccctgacacgtgtccatctgttcggacaacaagtgtctttccttctgagaggtgtcagtcttgcctttgttaggcggcctgacggcccacctgtaagtctgacgcggcctatttgggcctagatcaattaggaccatctatatctgggcctggttcaatctggatgagacggctcaataaggcccacataacaatttcctcacgaggcagcgtggagacgagagggagaggcagccattttttctttttttttt

SEQ ID NO: 10932 - DNA, 1501 bp, Oryza sativa
tcacatatactgagagactttgtggtgttcttataattatatgttaggaagaaaatttctaactaatttgtggacaccatttaatatttccaagaaatgaatttaaagtggatatgattaaataagaacaaccagtcaagcaaaagtaaatgatgtttattactagggttctatttcacataaattgtctcatatatgctccattaaacacctagcagaatgatcaaaaaaatgcgcatgtttcccaaacttctaaatagtgtgatttttatttgtacataacttttttatattttttggataataatttaaattcatttttaattttataatattttattcgtctataccctcaaataattatcataaattattcaacaatcaaccaataaaaaaacaaccccttaattaatcaatcggaaaatagtgatctttgccactggtgttttatttcacatgcattatatatgtgaaaaaatgtacaatatgcgacataatggtattcctactatgaagaacttaatgtttttgacatgtaaaactttcatagttcgtttttgtccatatatttttaccacagaccatgaaatatcacacatatatatacacgtctatacccacacgttgattaatgcgaggaatttcttttgtttacaactagtcgaatacaagtcttaaaaattcatagaccaaagggtatggactcaacattcaatgcttcatctccacaaaaatagtccacaaagcaacaacatcaccaccacatcatccctctaccctacctccccacatctcatccatgcattatgttcccttcacaacctaacacaaaacaaaaccattcaatttctatagaaaccacacaaacatgtttacaataataatcaaacaatactaataaacaaataaataagatttacataggaacaaaaaatgaagccaataagctagcccaccaagccaatcactcactcaccaaggtctcccactcctagtcatcatcatcatcatctccctaactaaaaccacacctcccctcaccactatagaacaaaatccccagcctctctctctagattctctctcctaataaaagagagaaaaaaaacccaagaaaaataagagagagaaactctctctctctcatcacccacccaaccaagccaccccctctctctcttccttgcaagcatccatctcatcaaaggccaaaccctcctcctctccccaacaagaacaacaaggaggcgcgattcacgcgaacaatcacaggagggggagagaaggggagaaatcatccgctcatctcccaaaatcctccaaaaaaatccatctttatcccgaaaagatcctccttttcttggggtttctgacaggcgtgcacggctatctttaggcgttctcggcctcatctctcgtggaaaggttcttcttcttcggggttgtttgctgctgcttaatttgaggaggaaaagcccaattcttgtggggagtgaaggga

SEQ ID NO: 10933 - DNA, 1501 bp, Oryza sativa
atcacaccattgatctgggaatccctttgctttcggcattcgatagataaagacccagtccaccttatcatatgctttttcgaaatcagctttaaacaagatcccactctgctttttttgatgtactgaattcagcacttcatgtaatatctccactccttccatgatgaaacgatttttcagaaaagttgtctgctatttagagataatgtatgccatgattgtgttgagtctattcatgaggactttagttattatcttaaagcttacattcaacagacatatgggacgaaatttttgtatttgataggcatcttttgttttaggaatcaaagtaatcactacaaagttcaatctataaatatttatcaaacccttgagaaaatcatttatcaagtcaatcatgtcctgtttgaccaagtcccaaaaacacatgtaaaattctcctgttaatccatctggacatagggctttgttcttttttagttcaaaaatcattgttttgagttcctctaaagtgacaggagtggttaacttcttcatatcttcctctgccaccttagatacatttgccatatcaattgaaaacctattttcctttgaatgtccaaagagatctttgtaaaaatttgtaatataaagcaataacttatcttgtccttcaatcacctctccttcatgcaccaaactatgaatctgactcttcctcttcctcccatttgccttagcatggaagaacttagtattacaattcccttctaatacttccttctctttacttctttgaatccacctcagtttctcttccctaataacaaatttgagtctcttttcaagctcccttctctcctctctatcagaaccactcatacccatgctttctactactctaatgtcaatggcatcaattctttccagaatgacatgcttttctctcctatataagccttcccagtttttgtttgtcacaccctaaagttttcctcccaagcctaaaatttaatttataaataaccctaagaaaatgccggtgcaaatcaagagaaaaccctaagaaagtaatacaaataataatcgaatctggcatgtggaattttccttgagttctacatgtcgaaattcactaacaggatttttagtggaattttcagagccctagaaataattttaaccaattaaaattgagcaagcaatattttaattccagggaaaatccttttctccctttttttctttttttttctttttcccccttttcttttcgagtgggccgccggcccattctctttcctcctctcccctccgctgggccggccgaaggccaaggcccagctaggccggccgcctccctcctcccacccgggatgccgacaggtgggccccacccgcgccgccgcgcccacgcctccgcctcctccgggccacgtcggtcacgcccgcgcatgcaccgcacctcccgcgcccactcccctctctctcccgcccgcgcccgcgcccgaga

SEQ ID NO: 10934 - DNA, 1501 bp, Oryza sativa
gtgctgcgctgccggtatggtaaaatcagtgtgggaaaacagattcgtcacggaaaaacagagcagtactctgctttcaacagcttcgtttgttcgaaacagaggacgtaaaaaacagagcattattgctctctcttcatggcgcatgcatggatgcctggataagacgataagctaagacttgtcaatccgtttttccgcatgcagagacatcgcaaaagttggcctagaaagtgaccatcattgatcgatgccatataatggtataaggccttagtggattgtaggccgttcgattaagtttgaatggtggattggtgcatgcagtagtcagttagtagggtcaaaaaagataggtgaactatgtggttgactcctagcaaatcttaaatctggaggcctctagagtctactagactcttggtcccctgtctcttacatgtaaaaatataagagaagatagtaagtagcagaagaagataaaaatcctcatattttgttttataaacactgtcaaaccactttatatctatctacaatgttgagcactctatcactatataactttacaatattctgagttgtaaaaaaatctttacaatattcaaacacaaacattatttatggtgattcctatattatgagactgtcatattgttacgctttatcttaccaacatttttttcacaacagacccattacaatatctcattgatcttcgaaactatgtatgcctgccgattgttataagatcatctattatatctattcttatgtaaatgggtattcttgacagcatactcattcatagattataaattcaaatattttttatcaactattactgtactttttggtaaaattgtatatatgttatattttacattaaacgattattacagtttctgatggtcgcgtaacgcacgactcattggctagtcgactattaaagcagactagtcgcgggaaaacatgaggatgcaaaaacagagcggacagatggtacgaaacagaggacataaaaacagagcatttctcttcatgagaaatggttgattaattaaggcaaagactgacctgtaatgtttcatcccttgttttgcaggtgcaacccatcgatattccatagaacaaggctttagaatggtaccttcagaaacagaggattgatgaatgcagctgcaagcacagcacgcagtatatatccatgggtccaaaaaagcttgcaagttgctggctacaacgacacgcctaatgattcctgagcaaggccctacatacatctacatggatatgcatctctatatatacgaacttacctgcaactaatttctccaccccccaacacaacagcactccacacacaattacacaacaatggcgtccgaacaacaacgccggcgatcaccacctaccatcctcgccgccatccttcttctctccttcttggcgacggccaacctcgccggcgccatcgatccagccggaaggagacggaacg

SEQ ID NO: 10935 - DNA, 1501 bp, Oryza sativa
gccactcatcttccttttgggtacttgtctatcacaaaagcgaattctcatgagtatgtttgttttttttttttggtgataacagggcaggagatgcatgcatgttagctagcctcttcctgtgtgctgcgctgccggtatggtaaaatcagtgtgggaaaacagattcgtcacggaaaaacagagcagtactctgctttcaacagcttcgtttgttcgaaacagaggacgtaaaaaacagagcattattgctctctcttcatggcgcatgcatggatgcctggataagacgataagctaagacttgtcaatccgtttttccgcatgcagagacatcgcaaaagttggcctagaaagtgaccatcattgatcgatgccatataatggtataaggccttagtggattgtaggccgttcgattaagtttgaatggtggattggtgcatgcagtagtcagttagtagggtcaaaaaagataggtgaactatgtggttgactcctagcaaatcttaaatctggaggcctctagagtctactagactcttggtcccctgtctcttacatgtaaaaatataagagaagatagtaagtagcagaagaagataaaaatcctcatattttgttttataaacactgtcaaaccactttatatctatctacaatgttgagcactctatcactatataactttacaatattctgagttgtaaaaaaatctttacaatattcaaacacaaacattatttatggtgattcctatattatgagactgtcatattgttacgctttatcttaccaacatttttttcacaacagacccattacaatatctcattgatcttcgaaactatgtatgcctgccgattgttataagatcatctattatatctattcttatgtaaatgggtattcttgacagcatactcattcatagattataaattcaaatattttttatcaactattactgtactttttggtaaaattgtatatatgttatattttacattaaacgattattacagtttctgatggtcgcgtaacgcacgactcattggctagtcgactattaaagcagactagtcgcgggaaaacatgaggatgcaaaaacagagcggacagatggtacgaaacagaggacataaaaacagagcatttctcttcatgagaaatggttgattaattaaggcaaagactgacctgtaatgtttcatcccttgttttgcaggtgcaacccatcgatattccatagaacaaggctttagaatggtaccttcagaaacagaggattgatgaatgcagctgcaagcacagcacgcagtatatatccatgggtccaaaaaagcttgcaagttgctggctacaacgacacgcctaatgattcctgagcaaggccctacatacatctacatggatatgcatctctatatatacgaacttacctgcaactaatttctccaccccccaacacaacagcactccacacacaattacacaacaa

SEQ ID NO: 10936 - DNA, 1501 bp, Oryza sativa
ggtttgcggatagagtatggtgagggcattttacaaaataatgcattgtaaatctaaaccatttctgagattcttatcgaataccagtaataatggtttttatctctgattgtatttttttattaaatgatttccatctgagtggcttatagaagtttggtgctttgaaagacagtggtaatgacgatggtaatgtcaggagcagacttattgctctgatgtacttcctccgttttataatgtaagtcattctagcattttccacattcatattgatgttaataaatctagatagatatatatgtctaaattctttaacatcaatatgaatgtgggaaatgctagaatgactttcattgtgaaacagagggagtatgaggtttggctcggggctagggtatcacaaatgcgttttctcaacaaattcagaatagatatactatttgggtgatattcatgactatgaagtgagacttggagaccattatacaggctagggctgaatttatgatttttcaacttgaaaagatttatgattttcttactagagaatttagatttgcgttattaaatgcatcgtaaatcaaaatcagtatctacatcttacatcttagtagtcatttattggattctaatcaaatttcaatactcttggtttatctttgattttgtatatctttttattaaatgtttttcttcaagtttcgtggttaccaaaaagttcggttttcagtggcaaccacctcatagaacacctaactcgtggcaaccacgaagttagaaaacatttaataaaaataagatatacaagaaaaaaaaataaaaaaccaagaattggtatttaatatgagtacaataaatggcccctatataataacctaaatctaaatattctaaagttagaaatcattaattcatttatttaatataccctacatctaaatcttccaaagttagaagtaataaattcgcccaaccctatatattggcctctaacctcacttcatagtcatcagtcatcacttcttcccaagtaaaaccccaagaagcggctattacttctctcccctgttcttcttcctccacattcccatttcctaaaaaaaaaatccccaaatctccacatgattcctccgtaattcggcgcgccctctcatggcgtccctcgccgaattccccctcccggtgatctctccgacttgctggagctatcggtagcgggaggaatcaatcaatcaatcccccacgctgggtggttcttgagcaagaacggctcatcgccgtgccgatcgatcacgtcggccgacggggaaatcctctggggatttgtgggtggttttgggctaaagattccgtttctttcgagcccttttggtctcgggtggatccgcttagctttggttcttttgctggttggggggcatggcggcggagtcgtcggctgctgctgctgcgggcgggggcgagaggaggggcccgatggatctgaacctgtatctcg

SEQ ID NO: 10937 - DNA, 1501 bp, Oryza sativa
accaagcggtacttggatattttataggggtaaaagggtcaatcaataatttaaaaaatcgttatctctttctttctctaattctttaccgcactaagtccaatcccactcacttccatcaaaaacaggggtaaacgcctcattcattgaaaaaaatagggcaaaaaacaacaaccctaaaatgtagggtaaaatcggtattggatatcaaagtaggggtacaattgtacaaacaaaattgtccctttctcgtttctccctcggtccaatgcaacctatatatgtcttgtgagggctaatttgaaacaaagattgagggatgaataggaaaaacatagaattctgacaaaaaaatcaagcgcaaaacaaataattataaaacacataaaaaatatatgaaataatcatttgattggaccatacgaaaaatgcaagaattagatgagagagataaactcataagagacttcgcatgatattgaacctcatgttaaaaatactccaaaacttgtatgaatttgggcattccttagaaatttgataagactcaatagttttcaataatcctttggttcaaagaatcatatagagaaatttcctatagcaaagtttattgtttctatacagaataaaagttcctatatttttctatatttttctttcaagtaaaggggccctaattagttactccactgaagtcgaatgagctgggttcactttaccatgcgtgggtttttcttgtccgtcttagttcaaaacggccactacaacttgttcagtaatcttggtgaaataatctctcctactcctagtccagtttttatgcactaatgaatttctctattttcgtagtattccataccaagaacaatacagatataaaaacttgactaaattgcactttagtccaccttttattacccaagtttcaatttggaccacccttaaacctatcttttcaatttggaccgggtaaatttaccattgttgcggtttggactactataaacaacttttctcgtcatgactaacttccctttcggcaaacatatgaaccatatatagaggagatcggccgtatactaaagctgatgtgtttaaggtcgttgattgcacgagaaaaaaaatcgttcatggtggttcaaattgcaacaatggcaaatttatccggtccaaagtgaaaagatatgtttaggtaataaaatgtggtctaaagcgtaattcactcaaacttgagaaactttatttgtaaattatttttttcttcgttcacgtgccaaagaagagagggaaagaggaaacgggaaagttacagccatggaaaaaggctggagaaggtgtagggtctagaagcatccgtgatggatttcgctccctcgtcttctgctcctagtcacacttgacagttcagcttcagctcctcccccaccatctccctcctcgccgccggcccccatttctcccgcgtccacttcgagcggcggcgcgcgtgccgtaccga

SEQ ID NO: 10938 - DNA, 1501 bp, Oryza sativa
gtttctcaagtttgagtgaattacgctttagaccacattttattacctaaacatatcttttcactttggaccggataaatttgccattgttgcaatttgaaccaccatgaacgattttttttctcgtgcaatcaacgaccttaaacacatcagctttagtatacggccgatctcctctatatatggttcatatgtttgccgaaagggaagttagtcatgacgagaaaagttgtttatagtagtccaaaccgcaacaatggtaaatttacccggtccaaattgaaaagataggtttaagggtggtccaaattgaaacttgggtaataaaaggtggactaaagtgcaatttagtcaagtttttatatctgtattgttcttggtatggaatactacgaaaatagagaaattcattagtgcataaaaactggactaggagtaggagagattatttcaccaagattactgaacaagttgtagtggccgttttgaactaagacggacaagaaaaacccacgcatggtaaagtgaacccagctcattcgacttcagtggagtaactaattagggcccctttacttgaaagaaaaatatagaaaaatataggaacttttattctgtatagaaacaataaactttgctataggaaatttctctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcgtatggtccaatcaaatgattatttcatatattttttatgtgttttataattatttgttttgcgcttgatttttttgtcagaattctatgtttttcctattcatccctcaatctttgtttcaaattagccctcacaagacatatataggttgcattggaccgagggagaaacgagaaagggacaattttgtttgtacaattgtacccctactttgatatccaataccgattttaccctacattttagggttgttgttttttgccctatttttttcaatgaatgaggcgtttacccctgtttttgatggaagtgagtgggattggacttagtgcggtaaagaattagagaaagaaagagataacgattttttaaattattgattgacccttttacccctataaaatatccaagtaccgcttggtgtccctccaggcttgggcacttggcatcaactcttcccttcctgaacccgaatccccgttgtgaaacagtggcggcagtgtccgtgggccggccaggcaacggggacaactcgagcaagtgcaggccacccaacccagttgcagtgtgtaggaggaggctaggcattgcacaagaggccatggtagagaggaggacaatggcggctgctgtagatcagcgtagggaggaggtgcggctgctcgacgtgtcgaggaggcga

SEQ ID NO: 10939 - DNA, 1501 bp, Oryza sativa
gcgccgccggcgctttcggcctgacgggccgcccgggccgtgccgtgccgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccgcgggccgcccgtttggcccggcccatttggccacctctaccccgccccctgtgcgcggtgcatgccgctaggcccactacagtacctgtctccacctacaacaaatcaactagatattttgaaaactctatattaaggaaatttggtttattttttttacccaaaatgtttcaccaagtgtattcacaatgtttcactatgtatagatctaatgttgcagtaaactgaaatatttcattataacaaaaaaacctatatattttgggaacccctattaagggaattcgttttattttttattccaccgaaaaatgtttcacctagtgtacttataatgtttcactacgtatggatcaaatgttgctgtgaactaaaacattctttagctatttgctgaaacattatttttatatacggtgaaacaacacctgatttaaacaagcgaaacattttcgatctactaagtgaatcaattccgatatacttggttgaacatcgtgcaatatttaaaataatttaataataagctaaaaaaaatttcgtcggaatatatccatgtgtggtcttgttttaaagatttaattgcaacgaatttaatggtacaatcggataatgatttagataagtaattaagagaaaaatcagtttaaaatagttttgcacgtaaattgggcgctgacatcagcgttctatttttctccaaattgattggatgcccgagccgtacagtcgtctaattaatgtgaatagccgctgctacccaagcctaattcaccttatcattatcattcctggcccctcgccgcaccaccatcgctggaaaacggaagccacacaccacctctatctccacataggggcatcatcttccttcagctgaccgacgagcacgcagcggtgtgtcgatgttgtcggtggggtatacggagcttgtggtgagaaggtagtggctgatggtggcaaacctgacaaggcgggctgcgtatgtacatgtcagtatgttgccgcaacgaaatattagtactaattagtaatactttctccgcctcaaaatataaaggatttgcgttcagatttataaggtataggatagtatgtcacatcacccaaaattccttctattttaggaggaagggagtaccgttcaacgtgtttaagtccctatcacatcggatgtttggacactaattataaatattaaacgtagactattaataaaacccatccattatcttagactaattcacgagacgaatctattgagcctaattaatccatgattagcc

SEQ ID NO: 10940 - DNA, 1501 bp, Oryza sativa; identical to SEQ ID NO: 9196

SEQ ID NO: 10941 - DNA, 673 bp, Oryza sativa
ccccccccacccggttgatcggatagaatcattatcgggaatgataatgataaggtgaattaggcttgggtggcagcggctattcacattgatggagtagaagagcaatgtctagtggatttgcagcagaaaccataggagcccaccagataggcggataggaggaagaaatcaaatttgtactagtacatttttatgagtttttaatgtttcagaaaatgcatctttcttgggttggattgaaacgttgtccttgatacttcgatggtgtttcatatttttgtttaagaatcttgtaattggttaatgttccatatgtgaaaataatagtacgtttcaatacatgaaacatttttcaggtagcggtaaaacatcgcccaaattttaaagaaaaaaaaaggttaaaatcaaacactcgatttgctgtcgcctcccagcattcctgaacttggagaaagtttgtccgaaacaacggcgtcacacagcgcgtccgactccgtttctcctgtaggtcgagtcggagtcggtttctcaccccatgtaacccatgttcgaatcggattcggacactacaaccgccataactacctcggctatatatatgcaatgcacgtgtaatcaaagtggatcaaaccatccatctagctcgcgcccaaacaccgatcgctcggga

SEQ ID NO: 10942 - DNA, 1501 bp, Oryza sativa
gaaaaaagaaaactaacattcagaatgctaatcaaacagtgctttcctttcagtgaagtgtagcattctacagtgctttagggggtgtttatatacaggggtgtaaagttttggcgtgtcacatcgaatattatatagggtgctgtatggggtgttcggacactaataaaaaataattacagaatccgtcagtaagcctcgagacgaatttattaagcctaattaatccgtcattagccgtcagtaagcctcgagacgaatttattaaacctaattaatccgtcattagcaaatgtttactgtaacaccacattgtcgaatcatgtagcaattaggcttaaaaaattcgtcgcaaattagtcacaatctgtgaaattacttatttttttagcctatatttaatacttatcaggtgtttaaacttttgatatgacagggtgtaaaatttttgggtgagatctaaacagtcccttatttatagtttctcaaagttcagtcatatgcttgtaagaatgtaagttgtataatatcctttttgagttttgacaaccattaatacaatggatacaatggagagttttatctgcattttgaaataaacaagaaagaaattcaatgtaacagagtatctagtcccagcaactagttacacatgcatgctgtcctgtaatgccacaatcttaactcacacaagatgctaaccatgttgattgtttgaatcaccgattacagagaacaagggtttcaaacggccggtttaaattgagaaaaccaacgtttgcagcggaagataaaaaacctggtacccatgataccaagaacgtgctgccttgtagtactgaaacttcttatcatagcagagaacttcaacttccatgctgatacataacactaaggatttttatgaccacataagagaaaagtacatccagaaatggtacaactttttaaccattccatcaccttatcacagaatttacaccattcaaagtcatccatgtaaactgctgcctataatttctgtatactaaagattgccaccatacaattcctgaaaaaacggatggcttgatgcacatcgcaaaacaaacagatatgtttatgtaggaacaacataaggctctttgtagtccttccaccaaggaaagaagagagcaatgattgccacaacaaaaacgaaaagaaaaactggatagtgagaacggtttgcatttcttttcttgcctccagtcttcttctcattcacagcttgacattcttgacatggagatttggctgcaccatcaaaatcctcatcatcatcgtcagccgggaacttcaaatcttctattagggcatcagtgttttgcatatggcattgattttcctgccgaattgagtcccaaaattcttttctttccttaagctcactgttttttctgaactgaagaatattagtacctggccctgagcagtgttgtatagctggactttcaagtggtgggtgaccatcttgttctgg

SEQ ID NO: 10943 - DNA, 1501 bp, Oryza sativa; identical to SEQ ID NO: 9197

SEQ ID NO: 10944 - DNA, 1501 bp, Oryza sativa
atagtacgtcgtgttaaattatacaaagacatacatgtgctccatgtgccacactagttgggagctgcttctttttttatttatttcttgtgaagactgagctgatagattaattagtcctcttattttgtttatttcagtttaatcaaggattaatgactcttcagccttgcaaaggccatcatatcgaattaatgacccatactatttttaatcgcaaaaaaatgtgaaaggaatgatcgatcgatatcaataaaacttaaggtttttgtataccatttcagatgagctgccacgtgctaccttgctactgtagaaactacagtccttgcatgctatccacaccgttcgattgtggctgcaagcatctctgcccttgagcgtgtcttcccagggagcctcggctgctctccaggggacccccatttttttccccatcggttgattcatcccccagcttctctatttgcacgcagttcacacgcttcctccgtcgatccatccagcgccgccggtggcatcgccgcctcccttgcccagtgtgttcttgcgtcttctttggcttagctgtggacggccgtggtcttctgctcggtggcttcgtctccaccatctccattccatccgtcagaggctgtcgccgtccgcgagtagcagcagcctctcctctcccagtgacagtccagttgcgccaccaccgacgaccttttgccttaccggttggttctccggtgcccattgccatcgtgtgcgggagcaatgccctctttttcccacggcagtccaggcaagaaaatccttctatccccattgttgtacagaagaaacccttaggcctttagaaatgtcgttctttgatttattatgtaccattgtgacagattcccttaacctgtatttttaatggtgcaagttacttattatcaagcatgtgattcaataatccctactgattaagcatttaattgaatttagcctgctacagtggttatgggatggttgcctgctgcccccaagtccacgacatacacatattaaagttgtccatatttaggttcatgcttagctttccataatactccattgtgtactcatctgcttgctttatgattttgttttgccattttgtataaatatctaggagtggtttggtgatggggatggatgcggtgcctgacactctaacaccaacaccattttctcagctaacttagggacaaatgagacagagaacaggccaggtgctactcctacacattattcggcatattcaactttctttgctttttctcaattctcaactacagttttcttatgttgagcggaaaacttattgatgatttatttctttgtgttctaagtgctcctagcagtgaaagctctaaccataccatatcttttatctcaactcctgaaataggaatctccatgtcagtgttttgtcgtccatttcaacgacccgttaacaggaggcttgcatttaaccctatcaatcctgcta

SEQ ID NO: 10945 - DNA, 1501 bp, Oryza sativa; identical to SEQ ID NO: 9199

SEQ ID NO: 10946 - DNA, 1501 bp, Oryza sativa; identical to SEQ ID NO: 9200

SEQ ID NO: 10947 - DNA, 1501 bp, Oryza sativa
agttaaatcttatggtaatccatcagcagcgatatgttcctgctgttgtagttaatccatttcctgaattctctatagacatcttattcttgtcaacttctctagaaccaatggtcaaaagaccagtactactactactctgtaaaagtttctagactagtgtacttctatgcatcaatggcagtgtttattccctttaaacttccaaaaattccgtcacatcaaatgtttggacacatatatagagtattaaatgtcggaaaaataaacaattgcacagtttgcatgtaaattgcgagacggatcttttgagcctaattacgccatgatttgacaatgtgatgctacagtaaatatttgctaatgatagattaatcaggcttaataaattcatctcgtagtttacaagcggaatctgtaatttgttttgttactagtctatgtttagtacttcaaatgtgtatccgtatataaaaaaaaatattttggcacaccaactaaacacggccgatgtgtagtagtagcaataggcagccagcggtagtactactttctactaatggggtgtttagattcagggtgtaaagttttggcgtgtcacatcggatattctattgggtgtcgcatggagtgttcgggcactaataaaagaactaattacagagtccgtcagtaaaccgcgagacgaatttattaagcctaattataccgttattagcaaatatttactgtaccaccacattgtcaaatcatggagcaattaggcttaaaagatttgtctcgcaaattagtcgcagtctgtgtaattagttattttttgtctatatttaatattttatgcaggtgttcaaacgttcgatgtgacagggtgaaaaattttgaggtgggatctgaaaaggggctatattcatgaagcttcaagtttggttggttgttcagcctataaatataggcaactagtgtatgtgtagattgctgatgtttcatccaggaaagattcgacgtcacgtcgccaaagtgcgttgcctgcgcgagttcgcggagccaaaagagggcacgcgttctccacggcaggtgagggagcacggcgcatggagaatggctgggcgctgcattgtggagctcgtggccttagcgttgcgtggcttcacgcggcggccgccagccctcccacaatacttgcactgttgtatgaagcttatcaggttcttcgtctacgtggcacatgaggaatagcaaaaatttgtggcgcgctgtgaacgccctaatacaagcaaacaagttacaacaagcagcccacatattcaaggcaagctccactgcatcgagtactcccctctgttcccttggctagctccacttcatccagcactcccctctgttcccttgcttacaaatatacaccaacaacaaattagagcgcccaagttcgagtagggcgtgacgaagtagctcgacgtatcggcattgtatattgaagctataggtatggcttcaagtt

SEQ ID NO: 10948 - DNA, 1501 bp, Oryza sativa
gtggtatgtggatttctgatgtgtgatttgggtaatggggaggggctcgatgcatcggctcgttttgagccgatacatcgagctgtcttttcatttgtggagtttcaaaggtgtcagttcgtaaactgccacagttgattcctccatatcaatgcctcttgggctgcgtaggttgagaaatccaaacatctatgtgggcttcccaaccgacacctaacacatttatgtgtatttctcccttgccccatcatttcaactaattacaagcattctccatttaatttcttcacctacttactttttttcaattaatcaaaatttttataatcattttcacatatcctcttactataaagttagagcccactaaatcctaaagcttaacatacaaagatgtcacatcatcatccactgataattacaacactcaggctgtgtttggtacggagagtttggaactctcccttcaaacacgtaaaacgaggtggttcattaacacgtgattaattaagtattatctttttttctaaaaaatgatttaatatgatttttttaaagcaacttatgtataaattttttttacaaaaaacgcaccgtttagcagtttgggaagcgtgcgcgcggaaaacgaaagtggtgtggttgggagctcaagctgccgaacacgaccttaaacatcatgcaagcatgttatattatctataattttataatatattaaattttatagcttatcaaatgcaaatatattaaatcatctcacataatatttgattatgtctcatcatctttttttataatatcttatatacctatatagttcatcctaactcgtaacttagttaatgcgctctctctctctcttctctcattaagtcatatcacatcaattgttttgtccttaaatgattatctatggtccaaatcatctcactccttttcttctcttactagaccttacatgattaatctatgatccaaactatctccctccttttcacatcaatttacttttatatttgaatcatcattctatatactatttaaatttaaattatcataaaccatacttgttagggttacgagtaaggtataccctctacccttcgatatacgctacatatcgatatggtatgcttgcgcgtatacggacgttttcggcataagttaaggaagtccattatggagtccacagatggaaagagtcctacttagatagaactgggtcgtcattgtatcgtaccgaatccgatgtctccgagtcctacttggaaaccagttgacctgcggtataaaagggacccccgagaggacctaaggcatcgaatcttaccaccaacacatccactacagcttacgaagccggagcctccaggagccaagtcgccgggatatctagtcgaatctgtggtttccatcatataatcccatatcaactggattagggctattacctaccaaggggcttgaaccaatataatctttgtttttctgcctgctt

SEQ ID NO: 10949 - DNA, 1501 bp, Oryza sativa
gaagactcgaagacggcggcgaggtgctcctgctgcttgccgtcgtcctctcagctgcagtcccaggcggtgacagtgcgcgccctgcgcgcccgcatctaccacgccgtcgcgccggcggagctcctcctagcggcgttccgccgcgtgtccgtgctcgccgaggaagctgcggcggcgctcccggcggacccggcggacgccgagtgcgtggcggggttcgtcggccgcgtggaccagctgcgcgacaccatcgaggcggtggtgcggcggcgacgaagactcgaagacagcggcgaggtgctcttgctgcttgccgtcgtcctcccagttctagtcccaggcggtggtgcgcgcgcatcgaccgcgccatcgcgccggcggagctcctcctagcggcgttccgccgcgtgtccgcgctcaccaaggaagccgcggaggcgctcccggcggaccctgcgtacgctgatggcgcggtggggttcgtcggccacgtggaccagctgtgcgacgccatcgaggaggcggtggcgcgtggggacgaggccgtgaggagggtggaggaggtcgtgggtttcctcggccaaaccaaggccatcggccgcagttgcgtgcggcggctgaccgatgcggtggcggcggcgctgcgcgcggtgtatgaggcggaggcggaggagatgcgcttcgagggccctctcgacgaggcgctgctcgacctccaggacctcttcgaggcggcgaggaggcggtcggagaggcccgccacgatggggaagaagagagcagctggtcacactcgacacccagctgcgttgctcgaccacgccctgcaggagaccaacgctagcatccacgctgcgctcgactgcgctcgaggttaccttgccggcaagctccctctccggcttgactccgggaagatgatgggagaaggaaggaagaagacggaaaagatgggggatggatggaaaatgtgacggtatggtatggtgctaatttcgtaaaattcaagtggcatggttattaatagatgaattataatggtatttttttaatagctagatttatagtggcatggatcaaattaaccctatttttgattggagggggtaacagattgataatttttgttgggtgtagttccatcgggttccatcgtgggtggggcacgcaagcattaggaaagttttttcaaaaacactatatcgaatttttggacacgtgcataaagtattaaatatagattaaaaaaattaattacacagttaggggagaaatcacgagacgaatttttgagtctaattagtccatgattaaccataagtgctacaataacctatatatgctaatgacagattaattaggctcaaaagattcgtctcgcggttttcagacgagttataaaattagttttttcattcgtgtaaaaaaaaaacatttccaatatccgataaaacctaaaatattttatttcgcgaactaaacagctccttattttcca

SEQ ID NO: 10950 - DNA, 1501 bp, Oryza sativa
tatagtcctatgtggcatcttgaggtttgtgcttggatgcccatagtacttgccctaacctaaccaaccacctggaaaagaggaggccactttgaaaaaaaaattaatgaacctatctcctagttaccactcaccagcccccacttctcgatgtgtcctcccacaccggggacgtggtggatccggcattccggctccagctcaacatcgacatgagggcagcgatgacagtgaaacagagaaggtggagcacgtggaaaatatagtcatattttaatcctaaaaattaagacaataaacatgacatgtgtagcaggaattgatctagaaaaagtgctaaacatgaacatgctaatgactagaaaagcatcatagagaaacacatgtttaacacacaatagttaaaaatgtaacatacccggataacgcttcggtactggataatgcattgatggtgttgttgcctccgttgatgttgacgttctcgccttctccagtgacgttgcctccaggagcgccattgccgccacctctaggagcgtcgttactaccaatgcctctaccattacctcctccagtagacatagcgatgtagaggaagtagacgaagaagacgacgccgtgcagaaccgatgcagcagagcagttgcgctaggaagcgctccccaaaaacttaaacgcccgcatacccatgtaggtactcaagcgagctgagttcgggagacctgtttatcctaaacacttgttcatgcaagtgctttgaaccggggaagcagaggtgcagcgcaggaacagaagaagaaaagatgtagacaccgaggaggagccggtgcgcgaagagaggtggaatcaatccgggattgattcgttcatccggtgatgggtttgcatagtgtgtctctgttattggagtaataacggaatcaatcaatccgggaatgatttgattccccagccggctcggtgcgcatgtggtagtcccactaccacctctaccggttaacaagtgctctccaatagcaacctagttaagttgaaaccttccacataaatttttaaggtgacattaatctcttaacattaattgtgggcctataaaattcattaggaataaattaggcctaatccattttctctaacataggatacagcagtgacggggccggtgagcgttggatctggtggaggcaagcgttgagggtgccggatccaacagctgtagggttactgctcggcaaggtcgaccttgagtccatgatgacaccatcgggtggatacaggccgttgtgcctggtcgtctcctgcgcttgggcgatggtagctcgggagagctgtggcggctgtgctcgggggagtgacggaggcagttgcaatgagggagatgatgaccacgacgatcacgatctggatgctgtcggaggccgccgtgttttgatggttctcatgagctgttgtcccatctgcatgaatttatattttgatttggatgatattgagcttg

SEQ ID NO: 10951 - DNA, 1501 bp, Oryza sativa
tagtgaacacgttagaggcgcgctaattttttagttgtgttgcttgatgtgttgtctctagtctggttggctctcctgaatatattactttcaaccatctaacacaagacaagtttcgtctgcgcaagcatatatgagccctggaggataataagaaaaagcggaggtcctgtcacaattgaactaaagctccttagtataaattatgggaaataatagaaatcattctaaaaatcacttgagtttgatattcgatttcataagttattttactgtaaatatttaacacccagcgtaaatgcttaaccgaatcaccccgttatcgctgatatagagccaccgtaggttaagctagccgcttcaaaaaaaatttctgatgtttgcattagatttattttttatgtgtcactgaaatctttttctgcatatagagaaacaacgtttaaactctcatcaataattctatttatcaaatctcacaaaaagtgttaaagtctatactcctaaaggtaaattttgataagaaccatattgatggcttgcaatttataaagacatattgatttggataaacacatgtgcactggggtggtttttcaaaacaaaaccgagtagagatgatgatttgcaacaaaataatttgtggggtgaaatgtcaaatttgaagtgacttttatgatagtttttgttatcgcccacgcgcgcacatgacgtcgctagccatccagaatccagagacctcgatcagccgacacgcgcgccgcgcccgacgtactgcaatggcgtcgccaccagctcacggcggcagcttccgcgtcgtgcgcaccgctcgcgtcgcgccgtcgtcgcctgcggccggtgccggctgcaacccgcagccggaggccactctgccgctcacactagtacagatccttccatctgtaacggcccataacaagaatggaatttgcgggccgtcacaaggaagtaatctcaatcaggccgaagtttcgcctgattgagatatggtcgcacagctatggtatatcggcataaaactaaagcccgtcacggatgacacttatctgtgacgggctatagttgaggcccgattgagatgagggttccatatcttaatcgggccctaaaagaagcccgtcacagatgacccgatgacactcttttttgacggccttttattaaggcccgatagagagtacttgtatgcccgtcacggttgattgttttagagccgttacagatatttgttgcatagtataaatacccccaaccacctagtgtaactgtatcccactgttcactattttggtgggaggctatagggggcgattttttgtcctttttccaaggaaaacagaaattaaattcccaaaagtgatcaaaatggatcaatcaagtgagtaatataaatcattaattgagcaatttcatcacgtcttacttttacttttgcaatactgatcttataatatgtgtctctaatttgtttttttttagc

SEQ ID NO: 10952 - DNA, 1501 bp, Oryza sativa
ggggatcgcggggaataattcccccctattgattgcacgcggggacggcgggatgcggcggaatccgcggcggcggcggcgctagggtgcgggggaggcggcgagagcggcgggaggaaggggatgacgggtgggccccacccgtcagcgagggtggcgggcgggcccgcccgtcagcggcgcgcgctcggggagaggccggatgggccgcgggaaagaggagagagggggagggagatgggacgagccagcccaagagggagagggagggagaggggactttttagagtttttctttttataaaatcattttaactttgtttatttcttaataattattatttgtgctctgaaaattccactaaaatttatttacgtattttaggcttttaggaaatatacaaaaatcccccaagccttatttgacttttaactttgcacattttaattgttggaggctttcacacggattttaattattctcggcataatttagaggatgtattttagagtcgttttgggacgtgacggtcctttgtcaaatttgggtgataaatcgactagcttgggttactatgatgacctagctagaactttatgcttagccatgcttaattaccactagctcagtcgatgggataattgcagtattagaccttttggtatcatgacgagctgcgtgctcgagacatccggccatgtttcatagtcgtaattatccaactaaaacacgactgaatggtgggctgtgggtgcatggttttgctggtcgcacccatggcaattaaggaccggttcgtgggaaaccctggaagacatacagcgcttgccacaagcgggaatgggtaactgcctgacttgaagtatagctttccgctggctgacgcatccaggcaagggtgagcgtgatggagttcggatgggccctgcgacggcctatgcggctttctgattcgcctaggacgagaggggactgcccgctgcctgctgggggcgggggtgaaacctgaggtgtggtgtgcttggtcagagggggttatatggagggtcttgtcacaatcactcgacatggtgacgtgtctgcgcaggcatggtgacattccagtggattgtgtcttgtgggtacagttgtgcacctctggccaaagtaaaactattcgaatagccgtgcccgcggttatgggcgatcgaccagattcaccatgattagtctcacacttaataaatcgactcaatgcactgtagttcaggtgggttggttgggcctgttcaacgtggtgtagcgttgatcagtggagatttaatattaccttgattactcaattgttttactgtttgctcaataaaatgttttacaaccgcctttatgcaaatagccacaagccattcttgaatccctttgcacgtctgcatcattggtgtggcttgctgagtacggtggttgtactcagccttgctattattcccccttttcagaagtgtagtgcttctgagctgaaga

SEQ ID NO: 10953 - DNA, 1501 bp, Oryza sativa
ttcagaccgaactggcaacccgaccctgggtcccagctcgtcccaagccaacccaggccaaccattccacattttagttgttaggcaggttttaagaattaaaactctaacttgggtacattgctcgacttgcccataaccgagagtgcggctattcgaatagattatactctgatcggaggtgtacatctttacccacaagacacatcttcctcacgtgtaaccacgtgccacataccaccacggtatacggacgaaagacgtgacatagtttccaacccatcctagccatagacaagaataccgacccaaccccacctacggctggaacccccaggacaggtaggcaggactgagcccctagcaacaggacaccggccctgtgccatgacatctcgacaaccgggccgcagctcgtgtagccttcatttgtcctagagatgtccatcgacccccgacttcatccatctctatccgtgtacttttgtttataaccagactgagccacaaactaagccttacccactagacatgtagaagtacggtagtgctttgcaacagaggcccgagcttaatccttatagtacccgaggtacgactaacaaaacccaaccacgcacttcgagcccagcctaaaaccattttgggggttttgaatagagggggaggtgtgtgtccaattccaacataagccaaccattccatagtgtccaaatgatatgagaattcccaaagtctaaagttgtaaaaccacctaatgttgcctaattaaccagcgaagcatctacctaaattcatactagtggaaccatgagtagagtgtccactagttggggttttgtttaatctagggtgaacaaggtaataatatcaataacaataataataaggtcataacaaagataaataggcatggctaaataaaacaatgataacgcgggaatttaaataaagcgataatgcattaatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacagagcacaaaaatgggttcttgacttcttaaggaaaaattagagacttgaatggtccaattccgagttcaaatggccaagttatggccatttgaagtttatatgctctttaaatgaatacttgcgaatttcttcatttaaattttaatttaaaaagggtttattgcgtcagccgagggggaggggcgcgcggaccgagtccacgggagtggggcccacgcggcagcctcacggtccacggtggaccgggcgcacccgggctcgcaccgcccggtgccatgggtcccacgcgtcagccacacccgaggacgcgggcggctgacagccgggccccacgcggcggcc

SEQ ID NO: 10954 - DNA, 1501 bp, Oryza sativa
cggtttccttcccctccggccactctctcccctttccaaccctatataaaccctccccgtgcctccctcacccgtttccgcccttgccgcaccgtctcctcgccggaatcgagctcgcgccgtcgctctctctctctgccatcgccgtcgagctccggtccgccgccgccgtcgccccggaccacctcccacctcggcgccgcctccttcggcttcgccgcatcctcgccgacctcgtccacccctctgtttcggtcgccgaccgccggaacgccgttgaccccgtcgacccgagccgcgccgccgccttcctccgctccggccgcctttttcgtcgtcgccgtcgacctagggtgagccgaggaccgccgcctcttttcccccttcccttcccctctctcggccgccgctccaccgtgcctatggccgccgccggcgaccataggggcgcgggcgccgcctcccgccggccgcgccgagtggccgccgcgtggggcccggctgtcagccgcccgcgtcctcgggtgtggctgacgcgtgggacccatggcaccgggcggtgcgagcccgggtgcgcccggtccaccgtggaccgtgaggctgccgcgtgggccccactcccgtggactcggtccgcgcgcccctccccctcggctgacgcaataaaccctttttaaattaaaatttaaatgaagaaattcgcaagtattcatttaaagagcatataaacttcaaatggccataacttggccatttgaactcggaattggaccattcaagtctctaatttttccttaagaagtcaagaacccatttttgtgctctgtttctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattaatgcattatcgctttatttaaattcccgcgttatcattgttttatttagccatgcctatttatctttgttatgaccttattattattgttattgatattattaccttgttcaccctagattaaacaaaaccccaactagtggacactctactcatggttccactagtatgaatttaggtagatgcttcgctggttaattaggcaacattaggtggttttacaactttagactttgggaattctcatatcatttggacactatggaatggttggcttatgttggaattggacacacacctccccctctattcaaaacccccaaaatggttttaggctgggctcgaagtgcgtggttgggttttgttagtcgtacctcgggtactataaggattaagctcgggcctctgttgcaaagcactaccgtacttctacatgtctagtgggtaaggcttagtttgtggctcagtctggttataaacaaaag

SEQ ID NO: 10955 - DNA, 1501 bp, Oryza sativa
acagaggtaagcacttttcgtgtgcataatggaaagtaaaaatgaatttcctctctgatagtaacaccatatgtttcttaccatgtaaaggcgctcaattttctcaataactgaattgaaccgatttgattgtgcgcagtcattttctgtaggatgtgtctgattcaaaagatggaatggccattatttcaaatacagtacattatttcaatttcaataaaaaaaactagttgatctgtgcaatcatatgtgaagacaaccacaagttaggctgatttaattcaacaaatgggtaagggtaatgaccacctgcaaatgagtaagcacaaccaccacctatcagaatgtctgatacaagttccaacaaaatataggaattattgcctacaaatgacacatcttgcttgtatagtattccagtttacattaatcatcttaccagacaatttcgaggaattaatatatcattgttgcatcattgcaagacaatgcacatacttctagtgtatgcgtaaaccccttccataattctggtttgtcatcaaaacggacctgctatattgattctaccaacagaataaaagcttaacaaagtttgcatggcatttgtagttcttacatatggtcacataagtagcaagtcttgagatcttatcgtttttgagaaacaagtcttcataacttgaccttcttccccaatgacatgataatcaccattgatcaataaataatacagtaactgttatccatcaaggctgaaaaaatgagcgattgacgttgcaatttccactattaaactgatccatgtaccacactaccaaatgcagatgttagaagacacgcagatgctaaatcggggcagcctagttacctagtgggaaatcccaacatcaaggtaaagctggtgaccgcagacatggtgaggggcaatctggcattgagaaatgatatattttgatgctatagaaaagaagcagaggagcatattcttttcaccctccaatttgcaaaggtgctcgcggcggcaacagctaatggatgctttcctttaagttaaatctcaataacttttgctgtcacttctcggtttctctgttgcgaacttatgctcggctctgcatttggcctcaccatgatagataattgaaaatcgtatttagctaattgaagaatcataatcagacctcccaactcccacacaaaatcccccgcggttttcaggcttgatcaggtgaaaaattgcacgcagaataggcacggaagacagaaatcggcaaaaaaacatgtaacgagagcacgaaaccctaccgcaccagatggtccagggaggggggcgaccgccggctgtgccgccgccgccggcggcgggggcggcaaggcagctccgaggtcagcctccttgagcatcttcctccacgacacaatggtggtctccccgggccgtagctccacggagaacacccgcctccctcccccgctcgcccccgcccccgcacccgcc

SEQ ID NO: 10956 - DNA, 1501 bp, Oryza sativa
ggtgaccaagatagacatgtaggatgtagctagctttgcccatacaacaatgacttacaaaatgaataaaataaagaacgaaaaacagagaaaatgaatataagaacaggttgcgtcaatcattgaatggagcataagttagtgactgagtaatttattcagtaggatacatttagtggtataatccattgtaggcagagtgctttggctaagacagcagttggcctagatcagcttaactcctgcttgcatgttactgctattagtagagtgtagaagcagttggtgtaggttatattagctgctgctcttcaatacataatgccaaaacagttggctacagtctgcattacactaatgctgcttacaagataattgcatcagtgctgaatataaaatgagaaaacagaacatctacaaacttttgctgaagatctctacgacagttaggtttttatttgaagttttctcatatcattttaaattaatccagcacataaaatttcagttctggtacaagaacagcaacatttatctctctcttaaaaaaaaaaaagaaatcacgctgagggctttcctgaaaaaaaaaataaaattgtgcttcaggctaaggacttgttcataagtagaataaaaatcagggattttggtgctatgctacacattcccagacctcgctataaaacagatccgatcactctcctgatcggcgccggcgttaattccaagaaaagaagaagagaagaatctgaaaaactttaagccgctatgggtctgcaggtatgcagatcactctctcaatccaccagcatcatcgtttctacgcttaataccgctataaagatgaagaaatctttaccatcgtctgctccctcgtttgtttgattgattttattctgtgtgtaaaatgtattgtaccttagatttagcctagaacaattcttgttcttccccttccctttgtggcgtaaaagaaattcttaatctcccgtctcctccgctccttgcgccgccaagacgagtcgctgctgaccaggggaggggcggcgagcagagcaggggagaggatcatgatgagcatcacatcctctttctgattcatctctctctcccatcgggtctggaatttgcttgtgttcgttcgttaaccctagcttctcttctagatctggaagaagctcttcccttaatttcagagccttaaccttaatacaggtaacagtttgtttgttccccgaaaagttagttgatccgcccctggccgtagagactagatctgactcttccctgctattacacatctctcatctctttgtctgattcgttcagtgagtcttgtcaaaagatctatgagatgcaatcttcttgtttaagatgctgcaattgttccgtttgaattgtaattttccattgctttgcggcttaacattacaacttctgaagaaagatttagtgtgacagtgtgactgaagcatgatccgattacaatttgtgactgata

SEQ ID NO: 10957 - DNA, 1501 bp, Oryza sativa
gagagataaagagctgtgtaagtaccaaaatgcccctagacacgtactgttcttcctctctctccttttcttttccccattcttcctcgcgaccgcggctggcctaagccgggatggctcgaccacggtggggcggcggcagcggcgcatcgccggggttcaccaccgacggccacctccgtctgccagctcaccccgtccccgcctctcctccccgccgtcctcgcttcctgcaacggccggcgcgggccgttggggcgcagccggaggtgtcgtgctcccgccgtggctgcgatcctgccccgccctcgcgcctggctatatgctacatacacgcccaccgcgctgctggcggcagtaggaggcggcgtgcccggcgcgacgcactccacgacggcggcgtgtctacccccacgctcccgcttggctatacgccgcgtacgtgcccaccgcgccccgcgcggtgcaccccacggcgccagtggtggacctgccggtgtttcctgacgacgcggaggagtgtgccggtgggtgaggctgaggcagccgacgtgcgcggtgctggaggggagggcagcgaggaggctggagagggagtgctcacggaacggcgacgacacacgacggctcagccgtggcggagctcggcagctcggcggtggcgcaacgagaaaaagatgaaccgagaaagaggaagaagaagaatagagaaagagagattgacaagtgggaccatgggcaaacttatctttaaccaaagtttctctcttcattttgaccgtaaataataaaataatgggaggagtgtctagtagctaattaccactttttttagtgtccacgagcaaatacacgatcttcgagtgtcccacaataaaggtcgcaatctttcggtgtcctgtagcaaattttgcttaaagattttgatacaaattagcccacaatcataaattaccaaattgcccttgatttatcgttgtcctctgaatgcttgagaaaaacaatgaattgtttacttgcactcaattcaaatgggtggaccagaataattctttagaagtactaatgaccttgaaaaactaacatgacaaactttttgggacatcttataaattgcaaaacaaccatctttatatgactgagaaagtactacaatttatcataaacttgataaaatataaacaaattcaattaagaaaaaaaatcaaaatgactaataataatataagacgaaggagtactctagaacgtttccgtcgttgtttgctccgccacgagggcgcgctacactcccgatgtcacgtgcgctgccctctcgatagcacgagacgaggtcgcgttggcgtgatacgatacgatcacattcactacacacgagttaaaagaaaagaaaaaaaaaaaacacctccgcctctgccgtcccgtgccgccccagcccaaagctgcccgcgaggccgcgtcgtcgtcgtctctatccacatcccgcgccacgccccaggac

SEQ ID NO: 10958 - DNA, 569 bp, Oryza sativa
cttacattgtgaaacggaggaagtacactagtacagatccttccatctgtgacggcccataacaagactggaatttgcgggccgtcacaaggaagtaatctcaatcggaccgaagtttcgcccgattgagatatggtcgcacagccatagtatatcggcataaaactaaagcccgtcacggatgacactaatctgtgacggctatagtttaggcccgattgacatgagggttccatatctcaatcgggccctaaaagaagcccgtcacagatgagggtcatctgtgacgggctccaactagaggcccgattgagataagtttagtgcccgtcacagatgacactcttttatgacggccttttattaaggctcgatagagattacttgtatgcccgtcacggttgattgttttagggtcgttacagatatttgttgcacagtataaataccccccaccacctagtgtaactgtatcccactgttcactattttggtgggaggctgtagggggcgattttttgtcctttttccaaggaaaacagaaattaaattcctgtaggtgatcaaaa

SEQ ID NO: 10959 - DNA, 1501 bp, Oryza sativa
cgcgcgagctttgttgtcatacaagtacagtcaaaagttgagctttgttgtcgtacagtactacagtcagaagtttgcaacacgcatgtatgtttattttttacagcggacgccattagtttttgacgtaacgtttgggcattcaattcagtaaaaaatatatactaagtattatttatttttttatgactggattttatcatcaaacttttacatatctatactattttttaataaaacaaataatcaaacattatacgaaaaatcaacatcataagaaaaatggaaaggtagtatattctactaccgagtagcctgtttagttactgcttcagcactgcgagccgagagttttgtctctggccacttgatctggactggacgaggccgtccagttcggtgcttaatttactgccttttctttcatcaaatgagttcgatggttgcgtaaggtcaacttaatataaataacaaatacttactccgtcccaaaatattgctacataggatgagatttgacccatcctagacaacgaatctggacataggtcaaatctcatgctagatagcaatattttgggatggaggtagaatgtaatggatacgacctatagcataagatctacctaatataaattcgaacttcaaaggttcggccgagctgaaagaatgaaaaaactactcattttttcatgtgcatgtttacatactactaacagttgtactccctccatctacttttgatagtcatgttttcaaatctgaaaaatttatttttgataggcatatttcaatccaacaacatattctcttaatgactttctcggatttaatgcacgactctctattcttccatacaaaattagctacatgggcatcgagaaatgtaaatattaaagaatcgattgtttacgaggaatgactagtagcatgtttaaatggatgataagtagaattatgtatcctgccaagatgaaatataactatcaaaatagatggagggagtatttttttaaaatatatatatacctaaaagttgctttttaaaaaccatgttaatctattttctaaatttaaaacaattaattatgcgctaatttctatttttacgtatactcaattaatatccaattaaaaaccatgctaagctcgttttacggatactcaattttctcttttcccctccttggtagcgtcaggatttgaaatttcggttcgaaatttcggtcagaaattttgccctcaccggcatgcttaaatctcgcccgaaattttcagttttttacatttttatgtgaatttggtcaaattttattcaaattcagtcaaattttcaaataatttcggtcagaaatttccgaaattttggtaatttcggtaacctccggcataaaattgaatttcgaaattgaaaaccctggccgggtagcgtacgtcgtagtacttataagtaggagccggccgagcgagcaacaagtagctagcttggtagcctacacta

SEQ ID NO: 10960 - DNA, 1501 bp, Oryza sativa
ccgagaaagtcattaagagaatatgttgttggattgaaatatgcctatcaaaaataaatttttcagatttgaaaacatgactatcaaaagtagatggagggagtacaactgttagtagtatgtaaacatgcacatgaaaaaatgagtagttttttcattctttcagctcggccgaacctttgaagttcgaatttatattaggtagatcttatgctataggtcgtatccattacattctacctccatcccaaaatattgctatctagcatgagatttgacctatgtccagattcgttgtctaggatgggtcaaatctcatcctatgtagcaatattttgggacggagtaagtatttgttatttatattaagttgaccttacgcaaccatcgaactcatttgatgaaagaaaaggcagtaaattaagcaccgaactggacggcctcgtccagtccagatcaagtggccagagacaaaactctcggctcgcagtgctgaagcagtaactaaacaggctactcggtagtagaatatactacctttccatttttcttatgatgttgatttttcgtataatgtttgattatttgttttattaaaaaatagtatagatatgtaaaagtttgatgataaaatccagtcataaaaaaataaataatacttagtatatattttttactgaattgaatgcccaaacgttacgtcaaaaactaatggcgtccgctgtaaaaaataaacatacatgcgtgttgcaaacttctgactgtagtactgtacgacaacaaagctcaacttttgactgtacttgtatgacaacaaagctcgcgcgtgaattagcatttctgcgtgcaccaggcctaatttccacacgggaattaacctttactaaccggtttctatgttaatcgctcatgagattgggcatgagtcatgagtggactggagcaagtctacgatgctccaggtcagtcctggccggcaagattttccaaagtacccactccgtttcattttttttagataatggacccactccgtttcatagtttttgacttcttttactggttaaactctaatcaaatttataggaaaatacgataatatttttaatacaaaataaatatattattaaactatattaaatattagttgtaatgaaactaatttggtgttttagaatttagatattgctaaatttttctttaaatttaatcaaacttagaaatgtttgactagaaaaaaaaaagtcaaattgacttataatatgaaaaaaatgacttgtaacatgaaacacggggagaacatacagcgcattgttgcttacaatgaagcgcacagttgcaatatcctgatcccacatatatatatccacacctccacttcatgtacatatatggaatacctacagagtacagactacagttatctcttttttttttcaagggaacatactacagttatcacacacacaattgcttttgcacctagagtcagagatcaata

SEQ ID NO: 10961 - DNA, 1501 bp, Oryza sativa
caaattgttcttcgtgttcatgcccaaatccctctgttaaagttgagttaagcccaaatcatgcaatcccgaaatataagaaatggaattaggccttctagggtttcgggttgaagaaattagaagaaggggaaagcaaaagttcatgcaaatctcagacaaatccccaagaaccgaaaccctagctacagtaagatcccaaatttttccccaaatcatgaaaccctaaccctaaaatcaaggggaaaaaggagcacggcgggcttacttaagggccatggtggccggcggcgaccaccgtgtcgccaccgacgccggaaagaggcgagcgcgcgcccgaggacttggtccccgagcggcctcgcgacccgtcgtgctggcccggctcttcctcttcgcgtgctcgtctcgccgacgccgcctcgctgaggtagccgtcgccgccccgtctcgccgtcgccgccgcggatcttcctcgcgcgagcgaccggcgggtgcttagggcaccgtcgagcaacgctcgacggggatgcgcaccagctatggcggcacgcagccccggcgagcaaggctcggcggcgccacctccaccccgtcgtgcgccgcttcgccgtcgtcatcgtctcgctcaccgtcgccgcgggcgtgagagaaagaggggaggagagaatggggctagggttttcaggggggggggcggccgcgcgccggttttgtcccgcgcgggagcgatcccggccgtccgatgagatggacggctcggatcggctcgtcccgacgcgggctaaccaggccgcgcgggaggcggcgaatgccggcctaggcccaggttgttgggcctggagcccaggcggaaggcggcgcggcaatgacgggccaggccgagtgcggcctggctcgagaacgtggcccagttcaaaaaaaaaggttatgtgggctgcatactaatgggcctaattaaaaggattgggctgagataatattacaattaaaattttcttttttgaagaattatgattatgattatgatatttgtgtttaaacattgaagatattttattatgttttagttaatgataataagaataataagtgattttgttatgtgataaaattctctttcatttatttatttattttatgatcattacattatatttattacttaaagttattattgttttatgcattatgagtttatttccgttacaaataaatattataattaagtgtgacaaataattgtcattctggccaaagctgattgacttttatttgatcacaaaattttattaattcaattcaaatctggctaaagctgttttgattgaattaataaaaggagttttaaacaaattaataaagtgtggtttgtatttattattctggccaaagctgattaataaatacttattcacaaaattttattgttcatttccttctctggccaaagctgttttggatttgatcaataaaagaaggtactcatcttatgcctcac

SEQ ID NO: 10962 - DNA, 1501 bp, Oryza sativa
ataagaaaaatataagagaaaattacttcggaaaaaaaacaactctaaacaatgagagggtgtaggcggagccacactataatcaaaattcaatggcctaggctcgagaggttggtctggcgtttcactgtaatggattctcctcaaggagctccagcttgacgaccaatgtgacatggagaagattgcgcaatcgcataaaaacaaggtgaaaacggtatggaaatctttccgatagtattgataccatttccatataactaatacttcctccatcccataataattgcattcttaggaaattagagacaatttaacaacaaacacaatttaccacaatagccctatttaataattacattgtatacgcttatttcatatttatacttgattaaaaggaaggttgagcaatacattccatatgtaaacttaattaaaaagaaggttgtgggtatacatcggttaaattaaaacatgcccccaactgaagctcccacagcgatttggagtcgcgtgttcgatcgccgcgatatccacgttgcccccgaatgctcaggcagccggatttcgcaagcgctcgtggctccgcatcgactctggtcgtttttcaaaaaaaacccttagtattattgataatttgatgcaagtccccaatcgtacatttctaggttatgcagtcttatccaaaagaccttcaaaatatgaaatatcttatgctaagaagacaaaattcggaaaattggactgcgctctgaaaaacgtaaagtgagggatcattttgcaaaaatgaacatccccctccccctctcccaaactagaggtggccaaacgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccgacacggcacggcacagctactgtagcggcacggcacggcacggcccgcggcacggcacggcccgttagcgggccagcggcgcactgacaaggcgagcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcaaaaatttgtttatgtcggtttaaattttcagaa

SEQ ID NO: 10963 - DNA, 1501 bp, Oryza sativa
ttgagtaaatggatcatgaagttggaaggcaactctcagaacatgagctgtgttgtttttaggaataagtacttaaggaggggcagtttttttaagagttctgctagtgggggttcccaattttggaaaggccttcatgagtgcaaagtctggttaaactattttgtagttaagaagattggtaatagagaaaaaaaatagttctgggaggatgtttggttgggagatgttcccctaagaattttgtttccttccttatatatggtgaataatcaacaacatctttcggttagggaggttatgggtgcccctaattgggatttgtcctttagaagaaatctggaccagtctgacaaggctcaattagacgttttgaaaagtttgctgcagcatgtgaggctagatgatttgcctgatagcttaatttggcctcatgagaagaataagaagttcactactaaatctatgtataggttgttaaagtttgggggtgttgtggacaaagagataacagagatttgggggtgcaaagttcctttaaaagtcaagcatttcttgtttttggctgggagagggagaataccttgtgctgaactcttagttcagagaaattggaagggggtactaaattttgtaaattatgcctgagaactgaatctactaaccatgctctttttacttgtcctattgcttgctttgcttggtgctctgtaatggaggtaattgggggggggggttaatttcaaccaatttttgggatggtataagagctgttaaggataataaattgggggtgaatttaggcctttttctttgtgctagtctgtgctggggtttgtggttggtaagaaatgactttgtttttgagaataaattagtgagatcacctttgtaggtagtgtacaaggcaatttccttgatgcagagatggaaggtgctgctgtcaaaagaaagagatcgcgaagctttgaacgcgctgcttgagaagctgaaggctaagctggagtctctacgtcctgtgaatgtgctaccggacaatattagtgcttaagccagtgatgttgctcttaggggtttgagatttcctagtcgtttggatacttcttggcggggtttgtaagccttttggggtttagttttctagcgcgtgatgggtactggcagccccagttttactctgtttttcctttaagtttttttttgtattcagaccttgttttgtttggctttctcccaaaagccgggtaatcaaattacctgttatcaaaaaaaaaaatctatgcatgctgtaaatcggattatactgatatctactcgagaaaacatcttactccgatttctcagaaaattcacacagaccaccatctctaggattagttcttcagcaagttcagaataacagacaaaacccaagtactctgaacctaatggccatttcagaataacacaccaattggacaaaaccaaatgcccaaattgtatcgcattgttctctaacaag

SEQ ID NO: 10964 - DNA, 1501 bp, Oryza sativa
cgccgccgcagccgcaaccctcgcagccgcgccacgcggccgcagcagccgctgccctcgcagctccactccgccgacggtcatgagggagagaagcacaacagggcaaggagagagagaatatgggcttggctcatattattttgtgggctgacgtggatccgatgtgtcaaaaaccacggtaaaaatagggcgggggttaagtgtctggtattgttcgagggtgtattatacccggttgtagtttaggggtgtattttggacaagcataagggtttgagggtgtattatacccgattttatagttcgggggtgtattttggacagacataagagttcgagggtgtaaaatggactttctcttataaatggcaagatactctactacaggcacacttgtattggaatatcatcttgacaaaatatatttcaaaattagcgttatggagtgcaagtgttccagtcttaggacaaagtaaagtggtttttatggtcaacaattatgatggaatagttggtgaatttttcatgtatggctatatatatagagaggtataagtagaccaaataattttatcgacacaattcgaatgtccaaatgagaataaaaagtttgtggttattgaattcggttgcggtgtagttgaggccggtggacgtatttggagatgggccacacatttatttcactgatttccccaaatttgagtactccaaacatcatgtttaattatttgaaaactaatgcaaaattatattactgaatacactaataaactagtatcatatatgcaattatattactgaatacactaataaactatcatatatgcattgttaaacaaacgaaggaatgaaccgacttttcctctagagcacctcttaggctttggaatgcatgaattatgcaggacttccaatttttttaggaaaacatatttttacataaaatggttcgattttcgtatcatcttggaagaaaaagtgggctgaaaaacttgcagagaactgaaaaaaaataaagaaataccaattgtttaataataaagaaataaacaaaccggatttcctctagaaaacacatcttacatatttttaatgtacaacaaatattttatagtgttttcacataaagttgcccaattttcctagtattctagaaatttatgtgttgtaaacttgcagagaacttgaagaatccaagatattcatttttataggcgcgtatatcctcgagtcaggcacacgaaggaggcaacgaaaagatcaggcgacaccgggccaaaagtttaggggggcaaaaccacctcatccacaagcaggaagcacaacccctgagcacctcacgatgccacaccaacgccaaagctcccgattatccaatgccacagggagaacaaaccctatcctctttctcttctacacaaaaaattttctcctcctctttctcttctctctgtgtcactgcgtgtgaggagcgtagcttagagtgagaaaataa

SEQ ID NO: 10965 - DNA, 1501 bp, Oryza sativa
attctgttggcaggagagaacgaacggcccaaatatggcgcaagcacagaccattaatcttcttcccttcaatttgcataccaaaaaattagttaccacaatttgtggatctcctacaattgcaaccatgcatttgatgcatatgcatgcacccaggagctccacacgacactccatcatttttgacgaccttacattggggagccagccagtttgtcaaaccattgggaactgcatgatttggaaattggataggccaacttttatacacaagagaagttccggacaaattaaacaactaattaggacacatgatcaatgtctagtcagtgatccaaaataagctcacctaccattctcaatttctaattccacagtccatgcatgcttaatttgcagaccagctaattaactctcatgccattccaatcaaccaggcttttgttagctgatcactctccttaatttcgttatacacttggagaggcacatcacagtattatgtaccatacagtacttgtcccaaccaaccaaaagagacagctagcttcacacgctgcacctactacattaccaatagtgaacaaatgcatggctgcccatgacttgtagtacatgggctaaaatttctggctcaaatgcaacctatggggcgcattgtgtgtgcacaataataagtttgtgatggtaacggagaattgccgtggtcccaatctgaaattaacttgatagagctagctagcaacaatgattggaatccccatgaaacctcgcctttcgatcgctatatgatcccatcatcgtcgcaaaatagggattactactatataaaatgagtgagatgtgagaaattaccataacaataattcagcgtcgcttataatcctcgtgtctatattaattaagttaagaaagaagaagcccatacttggtgtgtttggtaggaagaaattgttctccctcagttgttgaactattttccatattctattaatatatatttatagaagagaagtggattttatattaagccctataatatatgttcccttgtttctcatgtgcaattaaataatgttttaaaaaaatcaatatagattactgtatcaccaattattcaacaaacttttgcatggacaaaattaatatagaaatgaagaaacaaaaataacaaatttcattgcaaaataatttgttttgttttgttttcccctatggaaaccaaatttaaccttgcattttgcatattaacagatgacatcctaatctaccttgttccattttccaattattattttcagtaactatttaaatcacatgaagaaaacgtccatgtacgatcttgagggagtattttatttctagacactgggagcagtttaatttattttatacatgtagtagtacgtagtgcctaaggctgtgtttagttcagcccaaagtttggattttggttgaaattggagatgatgtgactgaaaaattgtgtgtgtatgacagg

SEQ ID NO: 10966 - DNA, 1501 bp, Oryza sativa
atgatacaataattagaacaacatacacaaacatgttttgcattacaagtagtacgtcatctcattaaattaggtcggattaaaatcaccaagcatgcatggagttataactaattagtgcatcaattcgtagtaaataatagctcatacattcacatgaaactacaaataatcaatggtactaatacattaaaataattaaaggatacatattcaagactttgtttaatattgtttatttttatttatttattgatagtattactaattaattaaatttagaactaatagaaaatctacggagttcaaatgtgtatgccttaccatattccataattttcttgagagacatgtatagaccgttaaggatagtatcaaaaccaccaaattaatatgttttgtcggctaaccgaaaaggaatacctgccaagtctagagagcgagggaaagtccattttgcattttgttggcggataaccgcaaaggtaacaagcacttttagttgtcgggatttggccgccaaaaaaactaacgggccaccaagaaaattctagattccagtagtgatgcttgtagagtaataagttgatataatgttaagattgctaaaaccatatatgttcactaccatatatatttaaaatggatacatatataaattaagattttgaggatactgttattgagatggggaaaatgcaaaccaaattcacagtttaccacatttcagtagtgaaatgctttggattcgtgtccactgcatacaataagttgaacttttcaaacagcttcatgccatattacaacactttatgcactttagacaagaacctagtagaatccaattggtatacgtgctctatttgctagctaatgtggtagtaactgaagataaataaaacaaatctcccaccgaaagtacttataaagagacatgttcctcaaacaaggcatccatgcataataaagttggttttatctgaaaaaagcaaacagaggctcttccagtcattgtaaaaggtatttggattttttttttgggaaactcacaacacaatgcccccccttttatgtcgtattcaacacttcccaataatcatgacatataagataagtattatatacaagataagtattttaaagtatgaattaatcaataattaaatatacaagtaccacttaatgatcatgttaatgtagaaaaaaatcatttgtatatgctctttaattgagaggacatattaaataagaaaccttgtacttttgtctacatatgtgtcattctatcttggccggtagcataaataatgtacttaatacatgtgaagtgaatctgtccaaaatacatgtaagagggatatgcattacagtcaatagtaacggacaaatttccgtataaatagcatgtgctctccgagaatttatacatctcaccaagagaaaaaacaacatatacagaatagtgtcccaacattagtttcacttccttccctttcctttt

SEQ ID NO: 10967 - DNA, 1501 bp, Oryza sativa
tacctttgtgagtccaacataaaacgttccatgtactacaaggaatacaaccaaaccaagattacatgcaatgggacgtacgaatctaatttggtttgaaccttcgcacatacatgtagcatttaaaacgtaaataacatattatatgaatagcccaatcattttagtatttctataacagaaatctcctaaaccgtggctcaaaatttagcattggtatattagagcaggtacaatagcaggctataagccagctataaacatattttaaagaaataaaggaagagagagaagagcagcgggctacagatctatagccagctgcagcacggactccaagacgtaatgtgtgtatgacaggtgggaccaggtattaatagtatagtaagcaactattgtatgaattggctattacattggctatagattatttggagctagtagtgggctatactattaaacttgctcttatacatgcgcatagacctaagacctagctacacaaacacaattaatacttcttagtactaaatctcactatcaacgggtacagctgccgaatcaagcacagtaaccaaccccagcacgtgcttaagtttttgcttgtaacgtttcaccactcgtcttattcaaatttttttgcaaatataaaaagcgaaaagttgtgcttaaagtactgtatataataaagtaagtcacaaataaaataattaataattttaaaattttttaaataagacgagtgatcaaacgtttgtaagcaaaaacctaaaatccattatattatgggacgaagagagtaataaacaacaacagtcacaaccacaaccatatgcccccaacgtgcacaaattcgtacacaaacccccaccctaaaatagcagaagcaaaactcatcacaacacagaacacacacacagtaaagctagtctgtccacagataatcccaacacgagatccaccacacatcacaaaccacacaaaagccgcaaattcttttttctttttttttctcgcctatttattgcctcctccaccctctcccctcctcgcctaccaccaccaccaccgtcgccgccgccgccgactgagaagaggaagaggaagaggggagattccgccgccgacgagaggtgggggggagtgggttgtgatcgtgaggagggctctcatccctagacgggcgagttgaaaggcggcaaagacggctagcgttgaagcggtcgggcgcggccacgcagctgcgccgcccacgcccagtgggggagccatcgcttctccggcgacggcgtccagcccagccccgcacggcggccgcggggcgcttccctcggccggcggcagcccctctgacctcctcttcctcgccggcggcggtcgcctctgagaccgctcgccccccccatccaccttctctaacatccaatcaacaaaaatctttcgctgacctgaccctgaccccgagagagaggaaggaattgagatttaatcatggagatga

SEQ ID NO: 10968 - DNA, 1501 bp, Oryza sativa
gtatatgttgttttttctcttggtgagatgtataaattctcggagagcacatgctatttatacggaaatttgtccgttactattgactgtaatgcatatccctcttacatgtattttggacagattcacttcacatgtattaagtacattatttatgctaccggccaagatagaatgacacatatgtagacaaaagtacaaggtttcttatttaatatgtcctctcaattaaagagcatatacaaatgatttttttctacattaacatgatcattaagtggtacttgtatatttaattattgattaattcatactttaaaatacttatcttgtatataatacttatcttatatgtcatgattattgggaagtgttgaatacgacataaaagggggggcattgtgttgtgagtttcccaaaaaaaaaatccaaataccttttacaatgactggaagagcctctgtttgcttttttcagataaaaccaactttattatgcatggatgccttgtttgaggaacatgtctctttataagtactttcggtgggagatttgttttatttatcttcagttactaccacattagctagcaaatagagcacgtataccaattggattctactaggttcttgtctaaagtgcataaagtgttgtaatatggcatgaagctgtttgaaaagttcaacttattgtatgcagtggacacgaatccaaagcatttcactactgaaatgtggtaaactgtgaatttggtttgcattttccccatctcaataacagtatcctcaaaatcttaatttatatatgtatccattttaaatatatatggtagtgaacatatatggttttagcaatcttaacattatatcaacttattactctacaagcatcactactggaatctagaattttcttggtggcccgttagtttttttggcggccaaatcccgacaactaaaagtgcttgttacctttgcggttatccgccaacaaaatgcaaaatggactttccctcgctctctagacttggcaggtattccttttcggttagccgacaaaacatattaatttggtggttttgatactatccttaacggtctatacatgtctctcaagaaaattatggaatatggtaaggcatacacatttgaactccgtagattttctattagttctaaatttaattaattagtaatactatcaataaataaataaaaataaacaatattaaacaaagtcttgaatatgtatcctttaattattttaatgtattagtaccattgattatttgtagtttcatgtgaatgtatgagctattatttactacgaattgatgcactaattagttataactccatgcatgcttggtgattttaatccgacctaatttaatgagatgacgtactacttgtaatgcaaaacatgtttgtgtatgttgttctaattattgtatcatctgcctactgcacaaaaacagaaaatctttatcttaacaactaaa

SEQ ID NO: 10969 - DNA, 1501 bp, Oryza sativa
ttcgtaatccacaccacaatttgatggactcttatcgtatggttttggggttcatctaaattatgtatctatacgtgaaattgttcatgtctgaacgatttttgaacattggatagtgggtatgtataatgggcaggaaatgaattactagagaggagaatcaaagagttttggtgtttggttataactttgtgaatgtataatgggctctcatgatctagcttgattgcttgattaatcaagctaactgttcataatccacaccacaattcgatggactcgtaatctcgtatggttgatggttttggggtccatctaattctgtatctatacacacatggtgaaagtgaaattgttcatgtcttgaacgatttttgaaacttggatatatatagtgagtatatgtataatgggcaggaaatgaattattagagaggaatcaaagagttttggtatttggttttattactttgttagtagaagtattatttaactttttttatatcgatgcgcttgtttgtattgtttttccatttttaaaccgatatttgtaagggagttaacaaacagaactggctcgactgttgaaacaaattaactgtggcaaatgcaacagttgagctagtacgtgcttctagacagtcgatacttagttttctttaatttgcagccagttagttaattttcttggcggccgcatataatcctgatcatcaaaattactcgttgttttacggttatccgtcaataaaataggcttcttcttgctatctagacttggcgtgtatatatttcttatcgtttggctgacaaaacatattaatttggcagttctgatgctattcctgacggtatatgcctctcaagaaaattgtcactacaacaaacatgtcttgtaaaggcattttcctaatacaggcatttttaaaatgcctttacatcattgtagagacattttgaataatgtctcataattgtcttttggtgaattgtattcactcttgagttgatcatttttatcttcaatacactaacaacctcaacctcacataattactttaaatatgtgtttcatgttacttgtatctagttacttttatatctagttacttagtatgtattaatattcggaaaagtgtctctaggtttaaatgtctaaaaaaatgcctttacatataaagcaaattttaaagtttcgaaaagatgtctatacaagataaattcagcaaaatatgctaaaagtgtctttagagtaaaagtattttaggtgattttgaaagtgcctctaaaagtgtctctagactatagaaatcgcctctacacaagggttttttcgagtgtctagaaatgataaaatagttaaaataataataataaggtaataaaggctaagccattaatccataaaataatttcgtgagcaccaaacaatgtgtttcttccttgttgggctgatcgaaattcttttaattaatagatcgattgtgcttcaggaaggcag

SEQ ID NO: 10970 - DNA, 1501 bp, Oryza sativa
ataggccggtccataccttgcctctaggttaggtcgcacctgattatatatagaggagaaaacggtaatcttaaatttaagcagtagtcgtaattatttattgctcacaattatttatttcttacatgtgttatttgttaattctatgttcatgttggcttagattttgtatctttgtcggataagccctgagatatatttttgtgtcctatacttaacaagatattaagagagcttaggtcaacatagaaacaattaatacacacgtacattccctgactattttaagagaccgacctagctacgtacgatacgaggagttgaatttggaataaaatgaatgaatgcaggaacacacacgcacacaaacagcacaacacgagatccttgtgattttcatgccagcatatattttcttcttttttttcccgtattgaaattaaatgatactctgatcgaattcagaattgaaaacccctggttcttaatattaattaatttcgcacgcgttcgactgtatatatacgtgtcgtgtgtatgaacaagtcccagatcgatgtttttgaaccggaaaatccacagcccaacgcttttaatttaatgcatcaacagcatccgaagactcgcgaagaaaaggcaatgatctccggttaattaggttttgcatactccctccagttccgtgtttcctgttattaattttggacataatctcatttgccaatgagtaatattaattgattaattaattaagatgtctattttctgcccgtccatattaaactgagtgtttctcccacgttggaaaccacagcagcattaactagaaggtgtaaacttgtccaaaaaaatgttctttaatctttctgaaacaacatatattatcatccaactcacataatgcttgaacgatagtaaatatgaaactggagggagtatatatactctctatcttaaaaaaaagcctcgttatcctagtagtaccgaatctgaatagaatatatcatcatagtacgaggttgattttttttagatgaagagagtatgtacttagcatggagtatatatgatggaacaagaaggtgttggaatatattcaaggccattaataaatgggtcacaaataaaggagggatatatattttgagagccgaagaagcaattgtgtcatgttgacccggcgcattaattaaatcaaacagctaccctcttcttcctccccatttcctgttcttttttcttcctgacccttctctctttctaaaaattgcattagatttaattaattccacatcaatggcgctatatataccactgcccatgcaacctacctagttgccttcaacctaagtgaagctactactcgccattgataaattgagagatttgcttagcttccattgccattgatctttcattgagcttctaattaagctaatcccattaatcagttgctaattacaattagatacagaattaggctatagctagttaaggagaa

SEQ ID NO: 10971 - DNA, 1289 bp, Oryza sativa
tctaagagcatatttggtttaggatcggaccatggatcagacttgcgatgtttcttcagtggttctatggatccgttctctagagcggaggactattgtggtcttaaaaagatactgtgtaattgggttcgtttaggttttacttgattctttctctttttttttgcgggcatcgggatcatcagggttgtggaatgatatagagtgaccatagttgtgatggatgcgcttgagaaaaactaattgtcaaactttattgtaaatttttttgacacatggtcttttctgtccccgagcccctgtggccgcgacgaagccgatgccgccgcttcgggctgaccgctgacgtctccttccatttcattatttgccatccaattcgtaggcctttcagggcaagccactcaatatgtacttctttcatattttgtcactaagatagcgaattcctttattccgtgccactccgtcgccgatccgtccgtccgtccccaacgccagcttttctgtcgtcttccccacctcgtcatgctcgtcaccggcgccggcgtgggccacgcttagaggtggccaaacgggccgggccaaacgggcggcccggggcacggccgaacctgtagcaggcacggcccggcacggcctgctacagtaacgggccgtgccggcacgggacgagtagccgtgccgtgcttgggccgctggccgagcccgcgggccggcacggcacggcacggctactgtagcggcacggcacggcacggcccgcggcacggcacggcccgtttcgccggcggcccgtcaggctgaaagcgggccagcggcgcacgcgccaggccgaaagcagggacagggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcacagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 10972 - DNA, 676 bp, Oryza sativa
tgaaagatattctaatctatacagaattaccaatgcaaatggagtgagcttaacttctgttaaaaacaaagggtgggagtctattactttcagaagaaattagacaggagatagacttgcagactggatcaatataaaaaacttatgtgagacggtaatattaccaggagggagagacaccttaaaatggattttgacaaaaaaatggagagtttagtgttaaatctttttataaagctctgaaaacacatgacacaatccccaggccaatagggatacacaaaaaaatctggaaaatcaaaattccttttaagataaggatttttatgtggctgatgatgcaaaataggattttaaccaaagataacttgagaaagagaggatggaaaaaaggaacagaaacatgtcaattctgtgagaaaaaaagagactttgcagaatttgtatttttgattgccctatggctagatttacctggaatatggtttgttgtgcttttgatcttaaaccaatcagaaatttacatcaaaccttggagaattgaacaaaaaactgtgatagaatgacatcacagctactgctgattggagttgatagaataacaaactgccatctgatccttctgaaattttgtttgctgcttgtaattggatctccgattggggtattttacaga

SEQ ID NO: 10973 - DNA, 1501 bp, Oryza sativa
ttaggtccaataaggacagtgggggcagttgcaaatgatggtaattgatgcataatttttgagcaaaattgaggccaaacttattatatgtcatgacttgtgtttttaggtacaaaaataatatatatgtgactgttttgggttttgggtcattttgagggaattgggatggatatgcatagaaatctattattaaatgaagttactaaaattatggcatttaggagaatatgaagtgtcccggtcgccaaatctggtttggtcgggttactgtctgcacggtaccgaccaagacaaattggtaaaaagaacatttcgttcaaatacaacatttgtagaaatctgttatcgttaccaatatcctagattgatttcaaggtcatttctttatggaaccctgttgggggaagtccctcgatagcgggaggtcgtgagacccccctttcgtgggtttggccgggggaagaagctcgcttcatagaaatcacgtatccgcccctaaggctgctaatcaacttgcacacaattggattatacaggttcgggccgctgtggagcgtaataccctactcctgtgtttgggattatggttaagtgttacaaggacgtcttccctccgtatgagttcaggttttctcagaatcatccccttgttcggtgggcaaggtcctccttttatagttcaaggggataccacatgcaccgcctctatctacccttccatgggagggggacccactttaccttgaccgggtcacgatccgtgccttcgcttggaagctaagcagcagcccttccttgagtgggacccagcgccgccccctgcctggtacggggggcagccctgtcattctctcataaatgagtgaagacttgtggtggtcctcctccgaatgacgtttcgacgggacgggtcatacctatctctactccaccgatacagaggcgacatgggggggcacagccgcccattcaattggacgtgaccggcgacaggcccgtcatagactggtcacgtcctaattgacgggggtcagctagacggcaccacacgactgcccttactgcattaaacacagtgagggacagttggggcaccgcacatcgatggctgttcagcctgggtccccttcccgctcgttccccccgccacatggtagctgggcgagggcctcagggcaaagcagcgcgaaagcccgaggggcacaacgtggcaccccgaggcccccccggccgcttctgtaactcatgaggaggtgagcgtgggtgaggcgaggataaaaggatacggaggcaaggactttgccttcttcctttcgccaactgcccacttgccttctcgctccttaagccctaatattctcgccacttcacaatatcccgcgcgccaagccctccgccgcttctccaccagccatcatggctcaagacgctggtgacacagtgctcccggcatcacgcattacggcggatagacaccttatcctcccccgtaagatca

SEQ ID NO: 10974 - DNA, 1501 bp, Oryza sativa
gtacccctggccgcagaccccaaccgtactggagatttggaacaacggagctctcgcgacttcgcgtatcgacagatttgctactaccagcgtgcagcttactagtagtagttaattagcttaatcttcgcgtggataacggcgacaggtgctttgccggcacgtggaaatcgacgccgttcgtcgcaaaatcgtgcagcagactgaccgcagcctgactggaaatttgctgctactagacgatgatgcctgatggaagcgatgtgtacgtcatcatgtggacaattcgagtaccgtttagtccatcccaccaaacccccaaacaccgtgcccccgccggaggccaacttcgcttcccggaaagtttgatcgggtgtccgcggccaaagtaatttctgatttctctacctcatttctctcgtttctaacttagaaaactcgtcaggtagtagacattcttgtatagaacgggcgccaacgctggcagtctcactctcacccatcagtcttgacggcatattactacggcattggtggaagctagagagtggtattagatggctttagaacatctcagaggccatttccccacgttgatgttgactgtttactgtttagagggcattattttgtccaaattgattcttaaccattgggcaatttaacaaaaccaaagcttttttccttttctcttggatgacgacagatgccggtttgtgatcatttgtgttgtttaattagggtcctatccgtcaaatactgcaacatcagcccactaaaatttctaagacaattgctatgcatataactcagtcatccgactcatgtacgaatttaatcaacgactataaatactgcaatgcatatgaacattctcttatttaattgatctacgactataaaattgagttaaacatatagcaatactcattttctaaatgcttacatcattctgcgtttatgggttctcactttagctccttgtgccacctaaattaaaagtttagtagtagtactagcaataatgcaatacttactatatctagtcccaacacctgtggagaccattttaatttagtccgagtttcggacaaaattcacaaagcaaacaccctaaaaagcgacgcgcacctaaacacgtgtgacgcgagcggcgagccggcgagcgtcatgcgtcccaacaaaactcgggcgattcgcatccttatcggctgaccagttcgggcatacgccaccccgccttgtcatccaccgcgcccacccgcccggcacccgcacaccgccggtgcgcgtacgccgctccgtgaagcaggctataaatcacgcgaaatctcgcaaaaaaaaaaacgcatcatctccccggcacgcgccacacgcgtatgtaacgcaacgcaccgcggggactcgcgcggctcgaccacatcagtcccaacgacccccccccccccccgggcctcggcagcggcgcgggcagggatggcaacggccgcctccgcctccg

SEQ ID NO: 10975 - DNA, 1501 bp, Oryza sativa
tcttcactttactgtagcttctaaagttgagaacaatcaccgagaagatctgaagagcaaattccattttgattgaacagggacctagctacagctacatcaaattagattagataaagtgagataaaggagacagaaatggaactgttgcaatttcggccacccgtacgaatgtactacactatttctaacattggaaaaagaaaggtactagtactacatgcatattggtacgacgacatatgtggtcattcttcaaatagatggtcttttgtcatgttgtgatcaagttacttggtagaaaatagtgtaaaagttttatttagacttagagggcactgaaaatgaaaatcttagttgagaaaaaatggtctatgaagaattaagcatcaacgatctactatgaacaataagtggacaacctgtttaacctaacctttattcaactctgggaaaaccaccgcataacctccattattgggcacttttgctctgatcaattttttttaccaccaatgataggtggtatgcttttgatgtgacaacaaattgaaatatacacttccatccaaaaaaaggtgagctcttacacagtgatatcatgatgcctcaggcacgctttcatgtgacaacagtatatgttatggcttatatattgtggacgcatcgtatccattattttggtgtcatgtacatgtcctctcgcgataacagtatccaatatttcactagatatcagagcatattttgtacataaagaatatcacacattattactatataattagcacgtataaatagccatcgcacatgtttatcatttatcaacccatgcatcaaccatgtagcatggttttcatgagcagccgcgcctccgtgtgatactatcaaattagattagaaacacagcgtgtgtatgcagcaatatccaccggccccacggaacgggcggtaccagctacctgtcacagacatgtgggcccagcttaacgctaacgcgctgatggccccacatggcagcgacctgccccctctgtccctccgttccacgggcgcaccgagcgtccaccgccccccgcgatatccgggggtttaggcgatatttagccacgagagggggaggggagagtaggagaccgacgcttgatacatccctccactcggcgcggcgccgcggcgggcggacgcgacgctgctgagtgagtgatgagtgtgcgaatgtgtgatcgatcgcgacagccaaaaaactggcaggcccccgcctcaaaagccgagctctcgcgtctcttttcctttctcttctcccggccccccgcgccccgcggcgcgcgccaagcttctcgctctcctcgccgtgagagtgagcgcgtaggcggcgcgcgcaccgctgctgctgctgcgtgagcatccgtgcatgatcgatcggcgcacgagcagtgagagttggagaagctttattaggagggatcgatgccgggggcgggagggaagaagaagtcgc

SEQ ID NO: 10976 - DNA, 1501 bp, Oryza sativa
  unsure (1)..(1501): unsure at all n locations
ggtcgaacacgccaggataaaaccatttcgcgaggccgggcaccgcatatctgaattttccagatccaagcagccaatgtaatgccagcaagcgcgctgtgagcgggcggtgtgcctcacaagcagccaaagctagacggcgtgccattttacgctcgtcttcggccccgaaagcatctggaaactggatgaacagcgtgagcagagagtgtagaagcatgaggctggacgaatgtgccatcccgccaaactgcaccttgacgtgcgctgcgatcgccggagcccacccgaccacagccgcggacacctctgcaaggatggccgccatctccatgcccgatgcaggcgtgaggacctgcggcctgtccatgatcagagcgagcactttccttatgtccctcaaattcacctcggaaggcggcggcacggggttggcaggatctggtgcgggtgcgcggagatgcgcgggcacaaagaagggggtgggcgggccggacaccgccaagatggaggtggtggaggggagcctgccgaggcggacgacgtggcgggcggcggaggcgaggaggaggaggtaggactgcgcggccggcgagcgctcggcggcggcgagagcgtagacgtggccgaggacgtcggcgaggaggcccgggagcgcggcgtcgagggcgcgcagggcgcgcaggcgagggcgcgggcggcgcggtcgggtgcgtggttggggcggttggcggaggcgagcagggcgttgacgagggcggagagggggtcggcgtggtcggtggagacgggaagggagagcgcggaggcgaaggcggatgtgacggtgaggaggaggtggtcccggagcgggtggtcggaggggaaggagaggaggcaggagagaaagagggggaggtgggtggggtaggncggnagcaggtggtcgtcgaggaaggagaggaggaggggcctgaggtgggaggggaggtcgcggcgcgggagggaggagagggcgaggtcgaggagggggaggtggagccatcggtggcggcgcggggtggggaaatcgtcgatgagctgctcccactcctgaggcgagagggaggcgggaggcggcggcggccggtccatcgctggcgccggcgaggggaggggaggagaggagtgatgcggtgtgtggtcgggtcgggtcgggtcgtgtggtgtgtccgggtgtcagtgtcagatcggatggtggggtagggggaaggagacgtacgtgttggtggttccgccgcctattgcagaattttttttatttataattttttttattaaaagttttaaaaaataattttccattttgaaaattgacggaagtagtcccctaccgccctctgggagggcgccctctcagagggcggcgaaaatgacgtggcagacggccgttcgctctcgggcgacggccgtcaacgaaatttgcaggcggcccccttgccgccctccgctagggcgattttatactgtgcggggggccgcc

SEQ ID NO: 10977 - DNA, 1501 bp, Oryza sativa
agtagctaactatataacattttcaactcttgtttttcttgaatattactagaccttttaggtgtgtggaagaggcaaatgtctcgctctcacagcacctcgtatctccagctgaactgaatctaaatatctgatccattttgttttcaccaaatgcgcaaggataagtacattttcctacgttgcagcagagtcagatgaaaaattcttgcatcattaccggcctttgattcttacgtttctcaaaagcatgagctgaaaatttcatttttattgagttgaccttatgattctgagctgtgatcccctgatgtttactcaagagcagcagctcattatacctgaacagcttaaacttgaacgcttatgaaggatgaagtaaggaaatgctgcttcataaagaaaaagccacgactcccaagatggatcagcagcagcagcaacccttcttctgcgaccaatcacgttgctatgctggatgtaggcttctgaacggcagtccagatacagagaaactgacttcaggaaataaaataaaggggcttctcaactctccagcctcaggtcagacatcatatatcagaatctctgggttcttgaaatttgattagtttttgaagaatgcattcttccgccattattatttttagaatgggggtgggactgtggagtagtagttgccgtgcacaaataattttatcctcaagattccctatacattttggacatgctgtaatgtttccttcaaaaatgctgtaatgtggatagttcgtgcatgtagtgtgggtgtttagggcatatattgctggaaaatatttgttttggtccttgataatttgttggtcttgtagcgtgggtgtttagtgcatctactgttgggaaggctccctaaggtacagggacagggatggattccgttgctgaacttccctcacatttctgccttgaatttgcatgtttgaaccttgttgcaaagagcaatacagccaaatgaaatgccaaaaccttgagataggggacaaaatcaatcaatatgctactcaagatctggatcttgtctagctataagaaatccatatgaaggtgtgactcatctagctgagaaggaaatggatggcatgggggcatcttatttaaaccccctaatttctcacacacacttgtgttgactgtaattaatgtcttttttttatagatgatgagggcgggtgagcagtattgtgccatgtgaaacagatactagtataatgaggagcctgaataggaaattatgggtatggatatttgggcaggcagctacgcctggcatggtacaatatggtatggtagggggtaggcgcttcggcaagcgctgcaccacggcctctgcagatttgcttagatctcatcctcctccatttctcatcctcttctcattctccttgttggaaatgctttcctttttccattgtatattctgtggtcggtcggtactcagttttttgccaactaccactgtata

SEQ ID NO: 10978 - DNA, 1501 bp, Oryza sativa
tgaatcagttgccggcaaagaattactggcatcatctacatcgccacagttctgcttctgcaccaacaaacaaagagcaataatgttgagcaaagcagaacaaaaatggccaaagaaaagaaggaaacaataaccaaatcacataaatgtaaagaactacatcatttgcaggttaagcttatatgcagagaattagaatgaaggaaacaaacagacctgtgcactgatcaggtcgttctggttaggcttccttggctcaccatcatttgcctgcttctgctcctgaatccttttaagccttctatggtccttgagatcaactgcaaagcaagatgagatgtaaccacttgagagatattctagcaatgcactgtgaggatacacaaagaattccacatatatttggtagcaagtgcggagctttaacagtatgaagacattggtgctcaagcttgccaaatgttagcaacagtctgaagagatagagtcacagagacaagaaaggtggcgaagaaggatgttacgcacgtcttctggtgaagcggatgaaagcggcatagatgagtgtagctagagcagggatgacaagaacaggcagagcttggatgggctgcctccagctcaaattgcgcctcctggccctccagaaagcataaacgaacaccaggacctggcgatcaatttaagcaagaaaagataagaggaaaaactgaagtttttcaattcagaagtaaccaaaatcacatgatacatcaattgagattaaaaaaaagaagaagaaaaaagactatccagccaacgttggaggcgacttgcgtgatcgatcatcagcatccgcgagtagcaaggaaaaataaatcgattggtggtgtggctagcgcgcgcataaaagcaaacacctggagcgcgcttccgtggaaacaagtgtggtgacgtatgggggcagggcagggtcacctcacctcgaggttgaaggagaggaaggcgagcttgtgggcgagcctccgagccgccgccgctcgcctgacaaggcgcgaacgcaccaccgtttcctcgttttgaccatcgtcgtcgtctccgggcccggcggggtggtgtgcggctccagtccggcgccaagcagcgcggaggcgggaccagaccccggagaagaatccgacggagggatcatcggcggccatccctttcctcctcttggctcttgctttctctctctctcttttctgcgcactaactagtctctcgctctcgtaggacatgcacgccacgccacgcactagcagaggcagaggcagaggcagaggcagaggagaggctttctcaactcattttttcgactcttttcctatagaaatcattcttgtgtgcagttagctaatggttctttaattttcctctaatccaaataaaatcatatattgtgattcagacaagattttgtactcgttgttggagagtttgtgcctgccgactcatactgcgccagccaactgaatgggct

SEQ ID NO: 10979 - DNA, 1501 bp, Oryza sativa
gctctgtttttcttccccaactacgtggggccgcggccacaggtgacggtgactctccggagcctgaccgctggcacggccggctcgaccacccggaagatgtggacccggaactcggccgcggcgacgagctcgaacacgcagtagtcgccttcctcgaggcagttcccgcgcgcgaacgcgcaccacccgcgcgacagccggtcccgcgtgttcgggatgtacagcaccgaccacaccttcccccccgggtctcgcagcaccacgtccgtcctctcccgcggcaggtgctgcctcgagaaccccgtcggaaacctctgcatattaacacacacacacacacacacacacacacacacacacaaaatctgctcatcaggctgtcacacgattcaggtgttgtgtgtgtacatacgatcgatcgagtagagttgttcgcgcaccatcatgaaggagtagtagacgtgcatggtgctcatgcggatgacgcagtaggggagcggggaccggaacgcgtgggcgatctccgtggcgcgctgccgctcggcggtggcgacggcgcggcggcgggacacgtaccccttgtagcgccggatggacggcgggatgctggcgagggccaggtcgtcctggaggctccgcgtcttcgccgcgccacgcctcgccgcgccgccgtcggcgtccagagccccctcgggcacgtgcctcggcggagacgccgacgatgcggggagctcgcacactgggagctcgtcggcgtcttcctcgttcttgaccgccgttgatcctgcagaagagtacttaggagcttttgagtaacgtatagttgtgtaatactaacaacaaattaaaacagttggcaacgaaatcgcacaagctatatatatatatatatatatatatatatatatatatatatatatgggctgtgtttagatccaaagtttcgatccaaatttcagtcctttttcatcatatcaatctgtcatacacacaaattttcagtcacatcattttcaatttcaaacaaactttgcgctgaactaaacacagtcatggttcaatataattttgtcatgtcactgtcagcgcaaacccgggcctttctgcagcattaggctgcgtgcctaacatatactcccttcgtcccaaaaaaaacccaggattgagttttttttttttgggacggagggagtagtgacgtgatgtgcgacatcggtaaatttgtccagggatttgatgatttgatatcgtcgaaagtggagtacgtaccaatcacgggccggtgggagtgggagtgggcctgggatgtttctctttgtggggtttagtagttggaccctcatataggctgttcccttcaccttcgttcttcaagcccatctttcaaatggagtcttggcaggaaattcagtgatgttgcgactttggaagtggaaccgtatgaaaaacttgtcttgtacatgatggtcaagttacccacttgccctaaacgttaagg

SEQ ID NO: 10980 - DNA, 713 bp, Oryza sativa
cccatgtgggagcgcccggcgagccactttcccggcccaggcccaggttgcggcctggggaaaggggagggggcgcccgcccgcgcgcaaggcggccgtgggccgactggcaaaggccgaaaaagttcattttaggtccctcggggccgaataaaaaaaaaggaagtttaataaaagtccctcggccgaaggaagcattttcaatatgtttaatgattgtgtttatttctaagcaatttgaaccaacgtgaaaattgtttagagaatagataaatgtgagaaatgcttctgaacatgtattttgtatttttcatgcaaattacaatagaattttgaattgtttaacatgttttatctctgtttaaatttgaaccaacgggagaattttacagagcgtaaacaacagagttttgttttttccccccaaaatttatatgaattgtatatagatcttccgctgcaaatagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatcttaggtggctact

SEQ ID NO: 10981 - DNA, 199 bp, Oryza sativa
acataatgttatagcatagtatgtacagatatttataaaacccaaatgttcatagtcagaagatattttcggtgaatcggaataggtgaatcgggataaggagattggaaattaattgtttgactcactctatccattctaaaaaccaaacttagaaatatatatatgaaatttgtatcaagatttatactttacggga

SEQ ID NO: 10982 - DNA, 1501 bp, Oryza sativa
tccaccgccgtccccaaatcctaccacccccgcactcccgcactcccttccccggcgcgctcgcctcggcaccgtgccgcctcggtgtcaaattcgccgctagactccgccgctcggccgacgcggtgtccccgaaccgagaccaccggcgcgaacgccgttccctggaacccagtcgtgcgccgccgcctccttcccatcagcggaccgccgccgccaaggtcgattcgtggccgccggtgagcccccgccccttccccttaccgcgcgcaatgctgtcaccaccctctttatctctcttctcgctatcatcctgccaccctcgatgccgcgcgcgccacgcgccgtcgttggcctctctctctctctctaaccagctcgccgtcacactcccggagttcctcgcgcccccttcccattggccgctccccacttttccttctcgccgcacccacgctcgcggtagcccgccgcggccgtgtttccgccgccgccgtgcgcaaccgcagttccgccgtcggcccttctctcctcaacccctcgcgctgccaccctccttgagccccggcgaaactccccggtgcgcctccgcggccgcccgcctcgccggccgcgcccgcgccgtgccacccatcccgccgccgcacggccgccgtcgccggccgccgtcgcgccgcctctccctcatccgagccggtggatggaatcgcctcgactccctcttgcttccagtgtccgcgcctcactccggttcgccgccgttcgccggcgcccctcggccgccgtgagccgtccgatccgggcgagcctggcctccctctctctcgcgcttgcgtggcagtccacgtgggcttgaccaagtccgcgcctgccccgtcagccgcccagtcagcctccgcctctctctccccacccgagccctaatgggccaatctcctttgggccgcgcctcacgctcggcctaaaaagtctgtattttctccctccaccaaatcaactcacatacacaaaagtccatcttccccgccagttggccccacatgtcaatgagtaattaaagggtattcttgggtatattcttttccataaattcaatagatcatttctttgttccaaaaattccaacaaatcatttctcatattccagaaattccaattaagcttcaaaaattcatatctctagatccgttcatccgattgactccgttcaactttcaataattccgtaaaattgagatctatttaatggcactattatttagtctaaatatgatctttattttgggttttgtgtaggtttttaattgtttgcgtatagttgcggttaccggattttcgtcgatcgcgggttttctcgaagattcgtgaagcttcgtgaagaccttaagcaaggcaagtcaccctttgatcaattgctcctataattggaaaatcattattattttgtttgtaacttgcattattagaatcacacacttaatttgctaggcctcggtttgcg

SEQ ID NO: 10983 - DNA, 1501 bp, Oryza sativa
actgcgtacatagcaattataagctagttccattggcagaatgttattgagaaacacgagacgatgtgcattttatataaactagcaatgtgctcataagtgcaatgggataaactaattaatatttttttttaggaatatgcaaaagaattgtgcatctttatacaaagacaccatggccgcgaaagggtatacttagtaaaataagaaaaacacaccacgctgcgtgccaacaccactaccatagcctgaggaagagacctatgtgccaagacggctgccccaacataactgattgtcgttgggcctacaatgcagctatgggtgaaagaacctctaaaatgatgcctccaaggaggttatgacactgaaaacaccgtcatcgcttgtcaaaggatacttggatgtggttttcacttaaaggatcccaataaaaaagatgagggaggcacctcgagaaatgcctttaagagggttgtggcacccaaaggcattaccgtcgccggcctaggaataccatgctagatttcccatagaatctgcctacacccctgttgttgagacctcatcgaccaccaatcttgccaacacatcatcaccaccacaacgtcgctctctacttgacttctgtcctactgccagcacaaccacaaccatccatgcctacacactggcacgaccatgaccatgaccatgacaatgaccaccgaccgttgcacgatggcgaccatattggccttcctcctatgccatcacctcaccaagaaggagcgaggtgactgccaacacccaccacttcacgtcggcaatctcggatttcctctcctgtcatcgcatataccgtctcaccatagagttccccacgatcagatctaaaccggccataaaagggaggagctacaaggagatgaaaacgcactagcaacagaggacgacccgtcgttgccacccgtgatggtgatgttctgcggctcgatccaagtttgaggccccgaatccggcggctgctccaccaaccagtgcttgcatcactgccttctgcatggtcaacctcacgagtgcatgcgctctatccgtcggctgcttgctgcatgggccaacatgctgctaccagcctccgccttcatcaatgcgtactagacctctgcccggtaggccccacactccttgccaactacagaccctcgccgttgcaaccccgcctctagccagtaacacgaatagcctctgaccacacccactacatcctcagcaccaagtagatttagagtttgttgtcataggaggcaatctttaggttccaggggcacactgtgcaaccatggagaaggcctcgctgtcaccggtgacctaccgagcggccgtcggcgacgatgacgaggggaagatagggtttctggagggttgggaaagatgcagcgtgattcacttagtgagtcgctggagcggctcatgagacctttttagaagaaaagtttcataatctcaaacctaattaata

SEQ ID NO: 10984 - DNA, 1501 bp, Oryza sativa
aatctacatcgttataatttgatccaaccacattctaatggttagattttgtctcttcacttaatgataatttctaggtctctataacgagaacatggtgtgtccttttcgagctatctttataatatactaattgatagatagatttatttctttcagataaaaatcagaggcgacatgtcagaaatttgtcgttctagtagtacaaagaacaagtacatggaggacctagcagcttgcatgcacagggtcttggcatctcgtcagcccgaaatgatcgtccatgtctggttgtgtgcatggatgaatttcttagagccgaccataggtccatagtcgcaattggctcatgtttttatatcccactacattctggtgttttgcaatccttaatggcatcaaggacacactaggtttgtaagttagttcgtcaggaaacaaaataattagtgcctcctgatgacatagttagtctgtttctggataatcatggagaaggatatagtagtatacagatcaagttgtctttactccttagggaaaaatatcttggcatctatttaagcagatgtgtgctcaattcttctgcacagccttaagccattccagttccagtgttagtactattccgatagaggttagctctggattcattcatgtcacatagcctactttgcctttcttcttcttcttgtgcttgtgtcaccataatctagctcacttagtcacttgagcatgctaccatcatgttatttgccctgtacaattgatcacatttttttcttcaggggattgtgttttaaatcatcttgtagcttgaaattgagaactaaatgttttatagtctagcaggtaatgagttgttcagtcagcgaatcaatgtctactactctatttggttggtggattgccaaaaaaaaagtgaggttagaatgatatgcaggtaaaattagccaaaaagtaagtctatgacatgtgggccacaagaataaaaaagagaggggagaccggtttgtgatagtgaactaaacatttttctgtagaaatttgccaggatttaggttggcactgttagtcacgtgatgatgtgccatctctggctaatagtatcttgattttttttctgaaatgtttggttctagtaattcaagcctgttattaaacactaaccgatgcagttctaggcaaaattaaaactgcacaacagaacaagttgttcttcacgcagaatgtcacaaacctcatttttcagtagtttttttttaattggtggttctagaggttttgaggttcgtataggagtaccccatccttttaaatttgatgaaaattttgatgaaataaatgtaaatttaatattatgaaatttcaaagtatgaggtaggaccatctaacgaaaatttcttccgccactggttttttttcaaagtcttttatatcagtctccctgccctgaaccacgattacagaagagaaaaataaggaaaggaaagagaaggca

SEQ ID NO: 10985 - DNA, 1501 bp, Oryza sativa
ccaaccagactcgaagtcataaactcgaattgcatatacttagcgggtttgcaatcaagcgacggttcagtgaaataacgagttactttatctaaaactcaaaattaaagcacatatgcgcacacattttgagtaataattgattggatttattgataaatgatttgcttggatacaccacatattgatactgtatttattattgtcttttatgtgaataatgagtatttataaaagttaatgcttgccaagattatcagtttaaaccctgcagagtttcatcaccttctttctatggataaacatgctttgcgaggaatatcggttggagacaaaattttctagtatttacacatagatccattggatagctataagcacccctccacccgcaccccaaaaaaaaggcatttgtaaacaacatagtagtgataccgttataatttattttccgcctttaactagtacaatcttttgagagtatttggaacacgtcatcacttcgtcccttattatctctccccgcatttaatcgatattgactctcaagactattttggacatattatagtatcgtgtatttagaacacatcaaacattaaacccgacttaaaactccatcatccaataccgttaacttttatttttccgcttttaattgctacaacctcccgcgcgtatttgggatacgttattacgtcatcccttattacatcttcccgcgtttaattagtacgtatcacctctcatgcatttttctggacatattacaatatcgtgaatttaaggatcctcagcactaaactctaaaccctagttcctgtactctttaccatgccgaaagcgaccacgttgatgcgaagaagaggcagcaggttgaagcctctatgagagaaaggataatgctacaatcttgaaggatatattagaaatcttgtagggagtaaaatgcaaaaacgggggttctatagacggacggatgcggacggcggccataagaaggtgcaggggcagggggctctcctctcctctccctcggtctttgccaaattcccactccgcttggctttctggccgccctgcccgctctgcccgcatcctcgccctcagccttcgcctttcccctgcccgcgctgccccgacaccaccaccacccctcctcttcactctcctcctcgacttcccttccaccaccacccgccgcgcggcgtcgccgatgccaccctgcgcgctcgccgccggggggagcgcgcggcggcggcttcctccgcggcgctgacgagcgggggacctcgggggttgcgcgggtgggcggcggcggtgaaggtgcgtgtgtgcgcgcgggtgggggtgatggggaaggaggggaagcggcgggaggaggaggggaggcggaggaggaaggggaaggggaagggggcgggggagatggtgctgcagcaggaggaggaggacgcggcgcccgcgatggggtgctggatccgcatcccgcgccggctcg

SEQ ID NO: 10986 - DNA, 1501 bp, Oryza sativa
gtgattaactaatcatatatagtacacgttttgcccctaaacaactgctagttgcagagtgttagaccggtcaacgaatagttttctcctattagccagtataattattttttccccaataatctgtgtgccgtagggtaggactaggaaggcctcgattgtcaatggccggtaagaaagttaggtatccaccgaataataatgcactgggatggagtggagtggacttcatcacacagggaatctcttgctccggaaattatatgcatgcagggttatgaacatggcagcgacagtagcttcatcttcatgggacccaagtttgacaaattagtgaagcttcgaggataaaaaaaagtagtaatgtgcggaagaatttgtaagttttagaatcggtcgtgacggtggtggtggcggcggtggtaatgacggttgtcagcagctacaaaatctctaccattaggcttccagcagggaacttattttctctagtttttggtaagaatgattacacttaccctttgttaccgaagttttactttataccatatgtactctatctaatgttttcatattggactaaatatttttaccatttttcactttggactcacctaacacttttgtataaccacatccaacatctcctccgcaaacatgtgagctacacataagtagaaaagatcattggcatgaggacgctgatgtactcgtaaagatggtgatccaaagagtataaagggtgaaaattcctagttcaaggtgaaatgattggatagaaggcgattcaaaatgaaactttgataataaaatgtgataaactgcaattcaccctattaggaattattcccaacgttttagaatgttgttttggttttgtccaaagttaaaccactttaaattaactagatttatttataggaaaacataacaacatcaaattaatttcgttaaatccacaactgaatattaattatatttatttagtattaaaaatgctaatatgtttcccgtaaacttgacaaaaggtgatgaaatttgacttaggaaaaaaaacaccttacgttcttaagcagacagagagagtagggagatgtttgggattctggaaatggaggatgatttgctgtgaggatatagttgttcctaatgtgctgtttcttgaaaaaaagttgccgttccaaatcaagacacactttacgctgggcttgggctgtttttaccatcccgacctgtgcaagcttgggccgagcccgtttccagcccaactcagacaggcccagctttgctttgcgattcgcgctctgacgtgcgcgggatcggtcggtcaaccgcgaccgacctactccgaaaggcacacgtgacacgcctttgccgcctttgcgatctcaaagccaaagccgagggcacacgccgcctttgcgatcgactcgcgcgtctcctctcctccttccagggctcaggcgaggggggtacggtggtggtgggctcgccggagaga

SEQ ID NO: 10987 - DNA, 1501 bp, Oryza sativa
caaaacttgctatttcaaaaaaaaaaaaacaatagcctgtcatactctggttaccgaacttattgatctattggatgagtggtgctatctgggcagaagtttgttgaacctcaagagaaaagaggtcaacaaactggaactcctaacgattatatagagcttgatcttcctgttatgccttccacataacctgttggcttaactgctttgaatgaagtacagaacatgatcaaatttctgatgctattattcacatttctgagtatgttcagtactgtgttgaagaaggtaaagaaactgaatacgagacatgttccacgacctctactacggaaataggtattttctgtaccctttattataacagataagttgtgtagttatccgaatacttaattttttatctgcggatgtgaaatatagtcaaattagtttataatatttatagacaaataattgaatatatttataaataccaaattagtttcattaaatcaataattgaatacattttcataataaatttgtcttgggttgaaaatgttattattttttctataaacttagtcaaacttaaaacagtttgattttgaccaaagttaaaacgtcttataacctgaaacggagggagtactagtttgaaagcttgtggataagattttttttattttgaaaggagggcaaaagctttggcttatatattaatagagtgggtaaaaattatacaaagtatatacagggccaatctaagaaaaccagcccgcaagaaggaaagctcgttaggtgatatctcctaaaattccaaactcctatagcctagtcgctcccgctttgacccaagctctaccttcttctttgatctttgcaagaattgaggccggggttgaggctgtgcttcgaaagatccttgcattccgatcccccagatctctcaagtgactagcatcagtagtgtttgcagagggactcttagggtgttagtggactcgacaacgagattccaccgatgttcgatcgaggggcaatcatttcatttgcccatttggaggtccatgtgcgtccatatctggatttccgcccaaatcctcttagtgaacctacatttggccaggaggtgaagtgttagattcgtcgtttgtgcagcacagggggcataccttttgattgaacttgtggataagattgaacttcaagttgaaggtcatttcagtggttatgaattgcagctagcactgtactactgccactgctgctcgtggtcagatagttcgatcatcaagaatgcattctgacttgaagaaaatttcaatgttcaagtgtgattttctgtgagcaacaaaaacttttttttgcccgaatgactgaacgagatcatccaaaatgtcactaagatttatcggtcgaggcaactgagggatctttttgcggcggcagcgtgtaaggggaggataggccgaggcgcagatcgcaggaggctctcgtcggagcaggactcgagcca

SEQ ID NO: 10988 - DNA, 1501 bp, Oryza sativa
acagtctagggtgctcaaagtctgggtccatccttttcggagaattaggtttttcccaaataagggtgaaaacggattagattatatcgatccaatttgctctgaatccgttcaaaacgaggataaggtatgggtttttagaaatccggctgatatgaatgcgaatgcgaatgcgaatggtatggtgtggattcagatttggatgtggtatctataaaatctggcggatatggattatatgatatttctattggattatctagataatctgaaattatcaacccatataatcactctatctattgcatataacatgagtcgacccattttaatgacctatattatcaattaacctaatggtctgtttggttgggggagtgtttaggaggcattgggaatttagagggatgaagctgttaactgttttatttggttggaagacatgtgaattttggtgggatgtggatggggaattgaggaatacctgggtactgggtggtaattgagaatgaattcctcctttactttgcctaaacaattctcaaccatctgttttcattaatgacctaatctccaactaaactccctatcaatttgtaccatgtgtactaaacaagatattgggattaaaaatcaaattcccatcttaatctcactatcaattccctcatctaaacttctaatccccttcctcaagttaccaaacaagctgtaaactcctttgttcgaggattttatcgtcttatctcatacttacgtagttgcgttttcatataatggatattatttattcatgttattagcaatggattattcttatgagtcgttattgttgtcccctgtattgctaaatcaatatcgtcccttgtatatatacataacatccaataattttaatccttttccgaaccaagtccgcaccgctccgcacccatttccgatattcgaaacacgctccgcatccgcacccgtttttttaaaaaatatccgttttcacccctattcccaaacgtgtgatgtgtgatggaaaaacctgatcgttttcagataacgtttgggtgagtgagagggaggtcgacgggtggcaagcaattttcgcacaagcgcgagaggaaaagaaaacaaaaatgctactaacacacacaaacacaaaaagaaaaaaaaactcaatcttttcccctccggactcccgtcccgtggtaccaatactacccctacacacacaacacacatccctcccccaacaatgctggacccactcctctccttgtccatctcctataaataccccccgcttccccccacctcatccgcctcaactcaagcaaaagcctccccctccaattcaatttcctctctctccatctctctcctccaatcgctgcctcgctcacgcacgcgcgctctacctacctgagggcgaggctggtgccgatggcaatggaggctgcggcggagaggagcgccggagcaggggcggcggcgacggcggcgccggaga

SEQ ID NO: 10989 - DNA, 1501 bp, Oryza sativa
gagctggtgcaacacaattttgttcttggcatcgagcatcgttcaacgatggtgaactgaacgtggcacacatcacagggcatccaatatgtaggagaatacttagcagtaacacaaagagaagtgacatgcatatgtataaatataaatcaaacacggggctttagacacggaaaacaaccaaattacacataatatacgcagatccaaagagagcagtgcaaagttactgaaacattggccccagagagtgaggttacagagtgcactcaaacacctaaaacaacatagcacgtcgctgctgctcttattgacttcctagctaaccccattgtcatgattaagggtaacaaactgaccattgccctatgcaagtaagatgatcaatgtccatctgccagtgaatctgagtacaagggaacatagggaagataatgcagtgtggaaacaactccaagctcacctatataatgcacttccctgctatccatttcataggatatcaatattccttcatttggcaaaacaaagaaaatgatattccgttccgggtgaatcgagacaacttagtagtcatgtccaaaatcttttctccttcttccaaatagatgtaaatggctgacagtgtgcttcaaggtccactgatcactgctgtagtcctgaagaacccatactgataagctgttatacagatcgtagcgatcggtatttacgaaatacagtcgaccttgagacagatctacgaacccgtcatcgacattgcagtcaggatcatcaagagtttgtggcattggaatggtcctccaagaattcccctccacatccaccactgcaaccacataccccatggtgatcaaatgcagcatcccgttgaagaacacgctcctccaatcatcaagcaccccgatttgatggccccaaccaatgtccttgtgactccacactccagtttcagatgaatagatctccagcgcgttgatagttgcatcaagttcaccatcatctgcttccccatccgcgttcgcgggattcttttccaccaactcgaacacatggaaatgggaggaggagaccgccggatcgaaccccaagtaggcaatctgtctcttgtcagaccttgcggattcaggcaggacgacccattgccgagtggcgtgattaaccactaggtaatcgaatctccgccggtaatcggaaatcctccagcagcggcagaggaggccgttgcaggaatcgaggaggtcgagggcgcggcaccggggaaggaagtggagcgaggggtcgaggaagagggggcggcgtagtggtcgaagaatccggcgatggcgccgtggaggtggtagcgagggaggcggtggtcggagtcggggtgggagatgacgcggcgccaccgccagcagacgcacttgaggccgcagagcgtcttgtagggcacgcgcgagaggacctcgacgaggaggtcgtcggtgaggttgtcgtccggcggcgggatcccctccct

SEQ ID NO: 10990 - DNA, 1501 bp, Oryza sativa
gtagctatctatatgggatgtggagtaaagagagccagggacttttattttagtgattttatatattagttgctgtaaatttaaataaaaattgcatagcatgtactatacgcttatggtgtaaataagtaaaaagaactacaatcttgttgtttgttataaatcccaaggtaaggtggaaaaccgtaatgatgtgtgccaaaacgttgcatttgtcggtcgatgaaacggcaagaagaaaattagtttcctgggaggagtgttaggtactctaagcacagcaggttctataaaagatttattaatcgattcagggagtgcaaacaaattaatataagatattgcttacccctaaatcagaagaggaatagttttaatcatgtgaataatgcacttcttttttcaatcctcgagcccctaaccaggtcctctttccattttcaaataatgcaccaagtctatattatgcacaagcttaagttagcatcaaccttggttaagaatgacaatccaaagcattgagaatattcaaacttgtaatattattgatgatataggagaaaactacttaaaagctggtatgcaaaacaactaacaatgttgcacttaatattattcctctttaatttttctcatattttcctgtcatgtgctcgaggtatatcttctccatgaagaaacaactattttctcttgtccacgtcagcaaaataagtgttatatatactgtggcaaattaaaacaaaacatgtttagaacggaaaaacattgcagaaaactagaccaatacacaaattacatctgctattcgagaaacataagttctcaatgtttttataattaagaattgaattaacttccctgcaaatatcacagaatgcttggcaatgcaaataattctcaccatataatttcgatccaccaatcacagcaccatcgatttgatgccaactcacatgttacacgcttgctgcacatgccacatttctttccccctttcctacctccaaaaaacaccacaaaaaaaaaagagtagcggcaggtaggagggcattcccgtccaccgccgaggcgccgacagatccacccgctaccgccggtcacccgggcccaccccgtcagcgggtgacagcctgtgcccagctccacccctcatccgacggccgagatatctccccctcatctcatccgacggccaggaggcgagccgggtgaccggcggtagccggtggcgagactcccaccaactgaagcgaaaccaacccgagcgtgtctcgcgtatgtaagaagagaagacgaggaggcgagaggaagtagtggagcgcgagctgaagaggaggaggggagtggaggaggcggcgctgcagatctggaggcggagcggcgaatggtggtgtcgccggcggccgccgcgatctaggcttgccgcgcgcgcgcggatctgctagctgcgtagccgtttctcgctgtgagtggaggaggaggaggaaggggaggagga

SEQ ID NO: 10991 - DNA, 1501 bp, Oryza sativa
tcacgtggttctcccaggcaaaagaaaaatcgtcggagttgaggacaagactgatgaggattattatcagttggatgggcaaccccctttcacggtgacgattgaccctagcatcctcctatcaaatgaagacaccccttactcacgtagcgatcagaaggagggaacaatagtgaggagaaagtacgtgcggtcaaccgtcaccgccaatgtattaccgtaattattgtgtacacgatgtaaactattttagatgtattaattatccatataaatcaattgttgtattgcatatgttaattacgtacgattattagaggttttaacaattttaaatcatgtaattgctagatatatgcgataattagaatttttaaaagttttaaatcatgcatgtggcatttacatatgatacttagagtttttaacaattttaaatcatgcatatgctagttatatgcgataattagaatttttaaaagttttaaatcatgcatgtggcaattacatatgatacttagagttttaacaattttaaatcatgcatatgctagttatatgcgataattagaatttttaaaagttttaaatcatgcatgtggcatttacatatgttaattatagtttttaacaattaatttaatatcattcatatgctaattatatatgattattagaacttttattaattttaaatcatgcatgtcgtatgtatatacatatgttaattacaatttttaacaatttaatatcattcatatgctaattatataagattattataatttttattaattttaaatcatgcatgtcgtatgtatatacatatgttaattacaatttttaacaatttaatgtcattcatatgctaagtatatatgattattagaatttttattaattttaaatcatatatttgcttattacgttttatccacttaatttactacatacaacaataatgtttcgaagtaattgtcattaatttttcgactttaaataattttaatgcattattttctattttagaaacacatatgtaatggaaattaatattcagtgcgcttatcagtagtctcggttcttaaccctaaccgggtttaaaaagaatttggaaatagcgggaaaatatctttagtcccggttgatgagaacaaccaggagtaaagatatgttgttctcaacaaccggaagtaaagatatctttactcccggttgttgagaagatctaggggtatatatattcccgatacgcgccctcgtattctccaccaacacttagaagttttttccccgatcgatctctctcggcttctccttcgccgccactgcctagggcatctccgcgccgccgccgccgtcgtatctcgccgtcgtctcgcgcgcgtcgtcgtcgccgcctccgccgccgccgcatctctggggtgatagccgccgccgccgcctccctctctctctcttcgacctcgatctctctctctctccccaaaccactgccggt

SEQ ID NO: 10992 - DNA, 1501 bp, Oryza sativa
gagcgcggcatcgcgcgtggcgcggcggcgacgaagcgcgcgacgtggcagtggcggcgtgcgcggcggcggcgtgacggtgcggcggtggcgtgccgcggcggcgtcgtggcgtcccggcgtcgtgccgccacggcggcccggcgtcgtggcgcggcttcgtcggcactgccggcgcgacgtcgtcgccggtgacggccgcatcgaggtcggggtcggcatcgtcggcgcggcggagtcatgttcggccgcgacgacgtcggcggcggcgtcggcaacgaggcgaccggcagtggtttggggagagagagagagatcgaggtcgaagagagagagagggaggcggcggcggcggctatcaccccagagatgcggcggcggcggaggcggcgacgacgacgcgcgcgagacgacggcgagatacgacggcggcggcggcgcggagatgccctaggcagtggcggcgaaggagaagccgagagagatcgatcggggaaaaaacttctaagtgttggtggagaatacgagggcgcgtatcgggaatatatatacccctagatcttctcaacaaccgggagtaaagatatctttacttccggttgttgagaacaacatatctttactcctggttgttctcatcaaccgggactaaagatattttcccgctatttccaaattctttttaaacccggttagggttaagaaccgagactactgataagcgcactgaatattaatttccattacatatgtgtttctaaaatagaaaataatgcattaaaattatttaaagtcgaaaaattaatgacaattacttcgaaacattattgttgtatgtagtaaattaagtggataaaacgtaataagcaaatatatgatttaaaattaataaaaattctaataatcatatatacttagcatatgaatgacattaaattgttaaaaattgtaattaacatatgtatatacatacgacatgcatgatttaaaattaataaaaattataataatcttatataattagcatatgaatgatattaaattgttaaaaattgtaattaacatatgtatatacatacgacatgcatgatttaaaattaataaaagttctaataatcatatataattagcatatgaatgatattaaattaattgttaaaaactataattaacatatgtaaatgccacatgcatgatttaaaacttttaaaaattctaattatcgcatataactagcatatgcatgatttaaaattgttaaaactctaagtatcatatgtaattgccacatgcatgatttaaaacttttaaaaattctaattatcgcatataactagcatatgcatgatttaaaattgttaaaaactctaagtatcatatgtaaatgccacatgcatgatttaaaacttttaaaaattctaattatcgcatatatctagcaattacatgatttaaaattgttaaaacctctaataatcgtacgtaattaacatatgcaata

SEQ ID NO: 10993 - DNA, 1501 bp, Oryza sativa
tgccacctgacaagcaaaatcacactactccacatgatagttcaagctaatcgaactctattggcgagcacaatcctagggttgggccaaaaccaccaagcagttcccactacacaccgatctaagtaaaaaaaaacacctaccacaatcaagaatacgacatgaaagcaccgaatcagcttatctcagcccccaaaaaagggggagggggtgaagaaacactcactttcttcttcaagtccgacttgtgggtcttgatggcggcggcgaggaggcgggggaggcggtcagactccgcggcctcgacgtgggacggccacacctcgggccccttgtagcagaggaagacgtggcgctcgtggaactgcaccgtgccggccagcttctccgtcccgagctccgcgcgctggaacccgaactccgcgtccgcatcggccgccacggcgagggcggtcgcgtccggcgcgtcaccgggcgccgccgccgccgccaggagggcgtcgccggcggcggccgcggtgggggaggatctggaagggtcggccatgtggctacggcgacgtgcgtgctgcgaagggaggaagagcagttgaaatggaaatcgcttcgggagcttggggaaaatggcgagcattcttttttttttctctcggggtttttattgctcgagatgttcttgcgagaggggaaagagtgatcccacgtatagggtcccacttgtcagtgacgttttgcgtttgaattctgttgctttctttttggcgagagcggggcccacaagaggagggcgattgatgtcaactaggagcgcgtgtcacactgtcagtccagtgggccacacctgtcagtaagattccgtggacgaataagttcactttgactcccttaactattggccaaatctaattcgtatccttgaagaacaatactggatatctcgaccctcaactattaaaatcagtgtaatttgactccctcaacgattttggatggcagtttcactaacgtggtaactacgagacggtgtttgacctggtctttatcctacatggcaccgccgccggctaccgtcgccgggagagcttgtagtagggagagacgggggagatgtgaagctggccgagacttggtcaacatagcggtggcatcacgtaggacgaagactaagtcaacaccaccacgtagtcgccacatcagcgaaaccatcctccaaaatcatcgaggaagtcaaatgtgcaccggttttaatagttgggggtcgatatatcgatattatggtttgggatacgaatcagattccaccactagctatgggagtaatattgaacttatttcattccgtgtagtactacctcacggcctaataaacaaaaaggcccaataattgcagccagcccacaaaagtgtcgcataaaaaagccaagcccgcgactggcaaagcggataagccccccgcgcccgcacacaaccgcaccgccatttcgcggttccgccatggcca

SEQ ID NO: 10994 - DNA, 1501 bp, Oryza sativa
cgtcacctaaggctggatctggcagccctgctgcccgggccccggcgtcggtgacgcagctccgcctggccccgccgccaccgccaccaggcatcagatcgggcgagctcgctgacatcgccgtagccgcttgggccgcctgccgtcgtcaccctaaaccgccgccattgcacgatagaggaggggaaaaggcgtcggtggttgaggagagagggaggggaaaaactgagaaaaggagattcttttattgttgtggaccccacttgagattacatagcattgtgggatttgtggctaacattatttctagatgttcctgagagtctaggtggcacaccaagtctgataccatgtggtgacgcactgctaatgccctgagttggacacggatcgtccgattttaccaagtaaagtcacggtgtgactttcaagccatatccactgtccgactcatccgacgtctctcccgcggccgcgcgctgcttcctgccattaatgccatctgaatgctaatgccatgagaagattatttgttttctttaatcaccaaaataaaaatagcttaactcgcatagtggcatgtcatttttggttaccggactaatctcgtaatagtgtttaattagattcattaatccttaattagaatccgcaagtaaataataatgagtcaggaaccacacgcaggaaatatcctccgtcggatgagtcggacggtggatatggcttgaaagtcacaccgtgagtcagacgatccgcgtccggaaggcagacgcccagaaaacagacaaccacatggataaggacatttattcggctcagcaatcagcattcagctgcagtattcttttgaatgatagggttcctttcgctttgcaaattgcacaagttgcagaagtaaacacatggtgaccaacaaatgaatatcgagctgagttctccacgtcggcctgactgcgactgaagtttggctctgcgtgtctctaaaaattttcagtctcctccaaaattaaccagtacaccatacgtggttttcttcatcactattagtacattggttgtccaaagtcaaatgctttcttaatcatttttctctttttgcaaaaacaaaggacaaacgcaggcgcttgcacactctatctttctttataagtacctctaaagactggaccagtatatatcttttgattcataaagtcaccacagatatctcgtcgccgatgggtatatgttccactgaaagaataattagccatcgtaaagcagtatccatgctaagtctagaactttaacccgagtagacaggttccaccaccagaaaattcaccaattggtttatgctcactccaccactgttaattatttctaaaatggacaagaaaaaaatatattagaaaaaaaagttcaagactttgaccggtgaaaagtgctttcaatccacggacaacgaggtaagcgctgatcatcgatagctactcttgcagagatcgacacgcacgca

SEQ ID NO: 10995 - DNA, 1501 bp, Oryza sativa
gtatgtcatatactcaccttgcaatcattcatcagaggaagagttctacaatgatgctgatggtgtggaggattaggtgtagccttggtcaagctgcttgtggagtggagccgtctgcgccgtttattttattttccgctgcttagatctttattgattgagaggaactatctacctctgtaatgactttttattcgcttcttaattagagtaataattgtactctattatcaatttgttattgtgtgcctcggctgattcctggacgagggttcacacacatgtaagcgtttggaattttggatagaaattccgggcgtgacacctcctaaaactaacttgcataaaaccacttattttatttaatctcttttatgacttttatttaaaacctatcttgaggtatttcttgattcgatttcgatttaaaactttctttcgctaaaacttcctttatttaaatttagtttgaaaaccctttttacctttatgaattatggtccaagcaaccttcccattttgtgctagaatttaaaccgaagcaattccaattttattggaattaattgttaaacccatcctttgatcttaaacctatccttcgattccaagcatatccttagttccctttccaaatttcaaatatctaaattcctccctttgatctagccatcattaatctctatggcttgatttcctattcggcacaagaatagcaatattgcaaatattgtgaatgattgctcttgtgctaagaagaatagatttttattttatcctcctcttccaaattgattccctattagccaaaaataattcttcaaatatttctgctatcaaatctaggattcaaaccctttttatctttacctccaaccattttcctccgaatatatatattgaggaattatattgttaattcccctctcatttgagtgctttgatatttagtccattatattctatctccaaaaacattgcactcaaataaattggaaaatccctcctttgctaaatttccttccaaaacttcctgttcaaattatttgcagccatccaaacctctataaaaattagacttcttcctttttgacattgggccgaattccccttttccctcctctctttcatgcggcccaagtcggcccagcctcagctgagccgcctcctctctcctcccttccttctgtgggcgccgccgtgcgccatcggagcgcgtgcgcgccgccgccaccttgccgtcgtcgccaaggaatcatccatgacgtcagtcgccgtgccgtgctcctccttctccgccgccaattcctctgcggccgccacgtgcacgcgccgccgttgccgaccaatcaggagacgaggccggcgccgttttctttttccctacgcagcggcgccgtgccttcctcgtcctccaccggcgaaccgaccttcatgaaccgacgtccaccggctataaatagccggcaaacccctgctcttttccccatccgagccttga

SEQ ID NO: 10996 - DNA, 1501 bp, Oryza sativa
gccgtgccttcctcgtcctccaccggcgaaccgaccttcatgaaccgacgtccaccggctataaatagccggcaaacccctgctcttttccccatccgagccttgagctcttcttcttctctctctcctaagtccggccgacgccgccatcggtcgatctcctcctctatagttcccctagctaaatccttgcaccactgactccccctccctccggcgaacccatttttcccgtttttcccttctcccccaccccatagcaaccaccacaaccacctcctttgcagccgaagagaagctcttctacttgccgttccggccaactcctcatctccctctgccggaaaccatcctccccagatgcgcgtcgtccgggaacacaagttgccgccgacgtcgctgatccccggccactggagccccagcgccccttctctctctctgttgttacacgggaagaaggagaggaggaagatgacgggaggaagaagaagaagaaagaagagaaaaagaaaaagaaagactgacatgtgggcccctgcacagtaacattttgtattttccctatttaattcaaatcctattatttagaagcccatatctcctaaaccgtagatccgattccagtgaaacttggacctaaatttatctaaattcaaacccaatcttttgaccccaaatttgctcttttaatattttatttgaatttattcaaatactgtttgaatttatgtttgccttttcaaatatttctttttaatccaaaataccctttagccactaaaaagccgccggttggaactttacgccttccatagcgacgttctcggtttactatccccgacatcggaccgttggttgtaaagccaggcaaaacccaaacccaaggtcgaagtgctgctcctggcaccccacgcctcgatgcgtatagtggtcggagcttcactattccctcgacctccacagcacaccacacagttagctcttgggctctgtgtgatcctagccgctccgccgccactcacggttgtcggagtaacacttcctccccactaaacccacacaaacctcctatccctctagccgttatactctatgttgacaccggctagagaagataccaattctagtcattatactgcccaactctagcaacgaccagcaaacacctaaaccctagctgatatttatcctacctcaatcagcttgctatccagaccccacgccagctagaatatcatcacaaccatttaccctccaactacctataacctatacatgaaatacgagccgatatgctatcctatttcagcatcgactcgagaacaagtaaatcctggccattcttctaccaaagcccaacttcagccaatactagcccaataatcccaagaccctataaaaaagataggctataccctaaaccctagcccttctaaccgtttcttgctttcttgctattttatggcttttattgaatttggttcttcttcttcttcag

SEQ ID NO: 10997 - DNA, 1501 bp, Oryza sativa
ggccaggtggtgatgcccgtcgccgtggcagctgaccagggcacgcatcgcattcgcaccgcctttggcttgcctctctttgccctcgtgggtggggaaagcgtgggggccaacaaactgcgggtggggctgggggggtggtcagcctcgtcctgccttggttttaaccgccaactgctctctcctctggctctcttacacttgcacagatgacagatctggtggttcaatgttggcatttggtgtccgagtttcaacggcaacgccggcgagcggcgagccgtccctccttcaccgccacctaacttttcaatgttcgtgttatctgggctgctcggctgcttggaacgaatagcgccacaaacacaacgcagcagtgtagccgtaaccttcgtctctcgaacgacccatcttctgtgatactgttgatgtttaagtttggatttgtaatgatgtctgttggtacaaggattgtactcatccgtctcaagctaataccatttgatgtgttgcctgaggagtgtggatttttgtacgaagcctttttgttttcctgtgatagatctctgttagacactacattttcatggatcgtctttgataatattgttcgcaatatgtgtcaaaatcgataagattcgtcagttaattgcttttcgttctaaaattagatgtgtaagaaaatatctttatgctgaaaaaaaaaagtataccttttactaccatcaatatgaatacagtataattttacaaacctaattgttctttaaaccttagatacacagagcccaacatagagtaaccctatatagataacaacatgcacctaaatgaattgtatctcaaggtggtttcaaccaatataaattttctattaaaaaatctctttaaaaaaacaactttgtattagacaagcttcactagcattgattttacttaaatagatatatgtccgcgcaggtatcatctaccaataaataaatctccagatctttcatcccttatctccaaaacgatgcaactaggggtcgaactttcgagccctagaaaaatattgagcagtgttcctttacttactcaaaaatgtttcattgcacggtatgaagtatgcccactagttgcattttttttaaaaaaaagatactaattacaacgccaagaatataatattacgcactatttcaaatgaaaccgactacaacgaaaaaaaacgtttcctgcatattgtaaaaaaaaatgtgtgcaattctacttccctgagagttgaccattcatcgtagaactatattttgtcatcactcgccacaattgtggaaaaccatgctgcatatatatcaccctttccaaaaagaattaaatatatttttgaggctaagtgtgctgcttgagtaaaatttctgccggatacgccagttttagggcccctttgaatcgtaggattgaaaaaacggaggaatagaaaaaatataggattctagcagaaatgtaagtataaaacaga

SEQ ID NO: 10998 - DNA, 1054 bp, Oryza sativa
tgtccgctctgcgcgccactctcgccgccgccgccgacgcgactggcagagtaagccgcgcggagctcgcccactgccgccacgttcctgcttcggccacctccgccgttgcgcccccctcctccgccccccgtgctcgtccgctcgcccgccgtccgctctgctcgcagcccgtcgcgcttgccttccgctcgcccaccatcgcccatcgctgctctgcccgcatcccgacgccgctccgcccgccgtcgttccgcccacagctgcgctcacctaccgccgctcggctactgcgcggaccaaccgtcgcgctcgcccccgccctcccatcgcgctcactctgtgaagaagagagagaagaggaggagaagaaaagaaaagaaaaaaacgatgtgcaactgacttgtgggccccatgtacttttttttttttttttgctgattaggatgtcacgttagcgaatccgtccacatatactgccatgggacctcctttgaactgtttgtgagagtttaggggtacacatttctggttttgtggtttagggatctcaaaaaaatctcgctgttaagttgagggacttccggtgaacttgttcctatagtagacgattcagaaggcccaactcgtgcccgtctcactgatgggccgggtgctccgcgggcggcccacttgaacgcgccgcctctcctaatctctttgcttactcgcggttcgcgaagcgccgtcacagcggctgcttccccctctctcttccgcctcggcgagcagcgacaccaccggagcagggcggccggcggcgacgggcggggcccgacggggaggaggtaggcgggcttggatctgcagggctcacgcggcgtaagagcaggggaagccgtatctccggcggcgttcatcggtgagaggcgacaaaccctaagcatctagtaccatctaggtcgagctttagctgaaatctgtcgtgtgtgcgtgcgttttgttcatcggaattcatggcgatggctgcctgactgctggttttttttcttctcactccctccacagcagcagg

SEQ ID NO: 10999 - DNA, 1501 bp, Oryza sativa
tcgacccgcgccgccgccgccgccgtggccgcggacgacgtcgacgtcgacctcagcatcctcggcggcggaatgaactacatcagctagctcaccggctggcgtccggcatccatggccgtgacggcacagccgcccacgcgtgccgagggcgacgtcgtccgcagtcacggcgacggcagcccgggtcgatgaaccccgcctcggcgtcgtccgcgttgctgtaccgacgctggactacgagcaaagaatagcgctgcggtggagcagcctgtaccggcgcatcgtggtggggcacggtggccggccagtgaggcgcacactgaggacctgggatgagggcgagcgttgcctcggcaagtaggagctcgcccgccgccgctcaatctgacaatggataatcagagaaacaatcaacaattaggactgatatgtagacgtgaattgaaattgccaacttgtagtgattcctggtacgtcacaagcaaagcatgtgcaggatggccggagtggcaggagacgctgcagccggcgccggggatgccatcgctgcacgcctgcacatgtcgcttttgtcgtggaacaactctggcgcggcggaacggtagcacatcatcttcgatctcgccctggttcgagtcaattcatcactagagagagccagaggagcacgagcccctagccccgccgcggatggtgcttgcggaggcggcgttgtggtcgtggctggcggcggaaccacgggagctgagggtggagctgggccggctctgctcccgcgtcgtcgcgcgcagagtggagctcgacagcgcgggtgatgccgtgctggtccttcctggccgttgtcgaccgcgtggccgtcgccgaggtcgagcttgtcgcctcgccacggtctgctcccgggctcgacgcttcgcctcccctgccgcccgcagctcctccccctgccggcccctcgtgggcctcgtctcctccctcctcgtcgcgcacccgcccgtctcacgcgacgctagcgtcgccgtcgtgcgtggcgtgacccgtcagctggtctgcccaaatcacagagcgaagaagaagagtgatagagatgaggaaggagagaagaggttagagagagaggagctgacgtggccaagctgacatgtggggcctacgtgggtcccatgctgactcagccgccacgtcggacaaaactggggtcaaaaccaccgaaggacctaaagtaaatggttttgttagttcaaggacgtccggtatctggttttgcggttgggggacgattttataactcgatgacaagttgagggaccttcggtgtactttttccttctaaaaactacctccaaccaaacgggccgatatagtttcagcccattacagtgcttgggccgacgaggctgtaattggagtatttccatttcctctctcttcgcggagacttatcgtctctcttccattctgcttgaactaccgcccgcgccgccgatggccgccgccgccg

SEQ ID NO: 11000 - DNA, 380 bp, Oryza sativa
aagataaagtactatttgttagaattttgtctttttttggttagggctaaaatatagtaatatatttgaagatgagacttaaaacatatatgcaataccattgaaagtacatgcatatttttttaagaaaaataatatcatatttgctagttggtatgtacgaagtatgcacatgattcgttccctatttggacatatgtttctacaagattgagcagttctcaaaaatcttgcgaagtttatgctccaatcagcctagagtgtaactcagacacggagagtagcacaaaaagaaaagtagaaacatattttttttaccagtttttatatgaatatacacatttagaaggaatttgcaaaagtatatcattgtcgcgaaa

SEQ ID NO: 11001 - DNA, 1501 bp, Oryza sativa
gaccgcttacgagcggtcatgcaggcgtgcacgaggagccggaatgaggaggagcgatgggtaaaccatccagatagccaaaaaaaatcaagaaaatgagaaaaacggtggggttaggggagttattgattgatgattagaggcaaacaagagctatctaatttcagccttgtaacctaatttaatttctcttggtcttgaggcctacagcgatggatgcatccatgcaaatgcatgtgccgcaaaggatgtccctatgctgatgggtatgaatattgtttcttgttaagctgtcttattaatttgttcgttgttagtcgatacaggctaacactgagctggctgaccacaaccgctagaagatgattagtttccctgctacagtgtacattttgttcccatgatcaaactttgtgagtaatttatccaagtatgacaggaccagagcacactacactctttcgttttgttcgtaaacagataagaaaagccgtgttgaaatcataaatatatccgctccaacaataatatcattggcgtttaattatctcggctgaattatttgatatcatgatttcggctgaattatttgatatcatgatttatcgcatatgttcgtatgtatacgttaattaaacagtcaagcaggtacatagcgctctccaacaccactaagatcaattaacctcggtcacttcaggagtcccagttgattaacacggcttattctgaagatacttagaggcatcgatcaatacagtttgtgctactaattcaggtaattagggccaaagattatgcgtacctgtgttgttatggaaacatacgtgcgtgcatgattagttattacaggtcgtcattgattgagaccacgatagtaatattgatgtcgttccgtatatatactacatctttccagaattccagtccctcagcactgcactgcagaaggagaacatgcatgcatgcagcaggacaagctaactaaccagttgctgccacagagcccgagggccacagagccttggggttttctgttcacgagccgtacaataattagcatgtaaagacaagtgcttaatactacctccatcttaaatgtttgacggcgttaacttttttaaatatgttttactgttcgtcttatttaaaaacttttacgaaatatataaaactatatgtatatatacttttaacaatgaattaaatgataaaaaaatcattaataattatttaatttttttaataagacgaacggtcaaacatgtttaaaaaagtcaacagcgttaaacatttagggacgaagggagtagctagctataagctgagctctcgagggctttgtcaagtgactctgtggctatatatatacgtgactgtgggtgtgcattgccaatgcaggtaattaagcagtacagcaccaattaagcaaagccacagcaacgagagagagcttgtgaagttgtgatatttcattttgaccatatgggttactcctact

SEQ ID NO: 11002 - DNA, 1501 bp, Oryza sativa
ctgcatgtaataagttaatgtagcaaccatgcccgtggaaatattatcacatttgacttgagaacaaatgaatgaaatatatttggattatgtttattttttaagaaaatagattaaacctgcctctacaaccatagtggatgtacacaaccaaggattatatgtttctatgtctgtcgtttcacttttctgaatataagctagtataaaatgcaggtgtggttcaatgtgtagtaaaatgcacctgaggtaccaaaacttatgctgccgattagttactaatcctgcaaacaatttagagtttagatgagttacaggcatgggcagaaaatgacatactggtctactactacatcgatatcaccttgactaatctacgctcacttctaaatgctccctccgattcatgttaagacgttataactttcaaaagttaaacttatttaagattacgagaaatatagcaacctttttaatacaaaacaaaataaaacatgttatcaacttctactttcttatttttcacgtgcacacttttcaaactgttaaatattataaatttttttaaggacaacgcagacactcacaacacgcgcacgctaaccaaaggcacacgctaaccttctaagagcacattcagaagactagatatatctatgagcacatccgaaaggctaggcatatcttaagattaatgaagttaccacggacgtctcgttgtcgatgattgtattgtctatcactgaaaaaaaattagccgtaaatgtgaatacccgtgctaaatttagaattttgaaggcccacttcgcagtgtcacagttttaaaaacatattaatcaatttttaagtttttataactaatacttaattactgatctgttaatgagccattcgttttaatgtgcacgttagagaagtttctaatcttcgcttctgaacccacactgatcctgatactgtaatgcaaaagagagagtacattttaagtatctcttttcattttttttttcagaaaaaacttttaagtatctcacagaaattggagccatcaaatcatcaatatagtttactcatttatgaaagcttcaaatgtccggcgtccagagtttcagaaaattcactcaggagtatgctagactattctcttctccatgattccgcaaaaagctttttcgttaaaacctaaataaacctcgtcaaaaaaaaaaagccggcgacaaatccaagtcctccacgtcatcccatccccgacagcgacacgctccactcactcgagccttctgggcggtggaacctacaccaaccactgatgggccgacggcccagcccagccagctcgcgctgaaaccctagccccatcacaggaggggggctatataagccctccgcgccgcccctcgccaacccttgcaccccctcgcgcctccaccacacactcccacccaggtaaggagagggaggaggaagggaacctcgaaggcggcggcggcggcggcggaga

SEQ ID NO: 11003 - DNA, 1501 bp, Oryza sativa
tttatgaatttttacacagacacctaccttatgtgcatattttaagattaaccaagtaaacgcagaggtttcactgtcgacggatatgacctatacccgagtggccaggttccactgaggaacctaaacagttgagatatgctcacttcacttggtgtttgcaattctgaaatctagccaagtgagatgacaaattttgaaatgcttgggatcttgaatagaatttgtcgctgaccgagtggtctgagaaggctctaaaatttagcaatgaaattcaaccaagcatacttttttgggttaattggacacatgacattgcaaatttatcatattagaaaaataccactactattcacgatattggctggatgccactgaaattttacaaaattggatccatgccattgtcgtcacgttctcttcttcctttaattcttttcttcttccacgccggtcggccgcgcccccttctcctcccccacatctggaacatgcggtggtgcaccaccgtgctagctccacgctcccggccttgaaccacgctccacgctctcccgcatgatccgcatctcaccgttggccatgatccccaccagcttcaactccatccccttcctaaggcagctgatggcataggcggagtcagggacggaggcagatggcgcaagcagagtcaggagcggagtcagatggcataggcggagctagggggcatcgccggagatagggcatggggcgcggaacaggatggcgagccaggcggtggctggccacgccggggagcatgaggacattgcaggtacttgttggcaaggatggtgacccccgcagccatgccgcatgcctctagcatggggtcggcatcggaggaggaggtggcgatggcagtggcggcgtagtacttgtcgactccaaggttgacgacttcggcgacggacaagttggcgcggtcgcacggaggtgcgcaacgacaacgtccttgagcggatggttgaaggcgttggcaaccgcgaagatcttgaagcggtggtcgacggcggctgccatgggggatttgagctaggagagagatagggaagaggggaggatggagaaggaagatgaaactgatatgtaggtccaatgtctaagggtattttggtctatatgaagatggaaaacgtgacaccaatggcatggatctaattttacaaaattgtactagtacccagtcaatattgcaaatagttttggtatttttctaatatgacaaatttgcaatggcatggatccaattaaccctacttttttggatggaacattgaagattccataactaaatgctacgcttatatcgcgtgccaccaaatcatccacataactgtgggcgcatacttcacccatactcttctcatgcggatgtacgtgatacaagttgtgttaggccttttttttatagtgagccacatgtcatatgcgctggcctagttttatttttctttttaccaatttgattgtaatc

SEQ ID NO: 11004 - DNA, 417 bp, Oryza sativa
catcaaaacttttctacacacaaactttcaactttttcgtcagatcgttccaatttcaaccaaacttctaattagttcatgaactaaacacacccttatacatgtgtaacatgtccaatttgcgggtcttctcaaaggtcgtcagaactggagcaattactatacatgtgtgccaacttggggggtattctgcagttatcatgtactacacgtcttccattcccactacaatgtttaggcaacagccagcagccctttcaaccaatgatacatgaccccagtccttctgacagtcgtctaaaattcaagaaatctaccaccctctactgatttcaccgtgtcgtgtctttttaagtggataaagcacagcacttgcgaaaataccttcaccaccatgtcgtcgttctccaagagagt

SEQ ID NO: 11005 - DNA, 1501 bp, Oryza sativa
taatgtggtgctatagtaaatatttggtaatgacggattaattggtttaataaattcatcttgcagtttcctagcggaatctgtaatttgttttgttattagattacgtttaatacttcaaatatgtgtccgtatatccgatgtgataaccaaacatacactttttcaccaactaaacaagccctatgtttctctaaaatccttttggcacagacaacgagaaaaaaatgatacacgtaatgtaggatgatacaaatcacatattatatgtactatcattttctttttagggtacccacatatatactcgtaaggtaggatggataccaagcataaaaaaatgtattatacatacttattatcttcttttcagcacgcccaatcagatacatgtaaggtaggatggataccaagcacctaaaaactgtattatacgtacttatcattttcttttcattgcacccacaccgatatatgtaaggtaggatggataccaagcacctaaaaactgtattatacatacttattattttcttttcagcacgcccacatagatacatgtaaggtaggatggatatcaagcacctaaaaactatattatacgtattaatcattttgttttcatcgcgcccacacatatatatgtaaggtataggatggataccaagcacctaaaaacggtattatacgtatttatttattagtttctttttagcgcccctacataggtacacgtaaggtcagatggataccaagcaccttgtattatacgtacttattgatgtgaccattaagtatatgcatataaccaagcatgagaaatatagaacattgccaaagaatgcatcagatgaatggaggatctacaagatattaaagtacaatgagttttggaatccagttcggtctccggagacagcattgactttaaacagatttagcgttttcatgccaactctgattcgggtgatcttggacttgatggatagtttatctcattacctttcaaacgcatctggtctcatatccaaattcatcttgagtcaatggaaatcatcaaaacaagacatgatattgctgaaatcgaacttgggccttgtaataaactagactcatctcagaagtgtctccctccacctccacgaattagcacttaaccctaaatctatttttctctataaatgtctatgtacacccactagaacaattgggatttggtttaggtataagtttgccaagtgctattcaacttgtctatagtcctcgctcgattagtcggtgactataaattcagatccctcaatagtttgtgcgttgatttgccaggtcgattagatctaccacttcaatcacaactatttctttgtgcttaattacctattcgcaatatttagattgtattttatcttgttcttgcagtgttctcttgtttgcatttaagggatcatcaaccgcgcatcccggttggtacgacatcgtttgtggtgtagcgattgcacga

SEQ ID NO: 11006 - DNA, 1332 bp, Oryza sativa
cattttgggacaaaaaatgacttaaaataaaaaaaaatcaactacaaagttgtagattgcgtcgatggctacaagtttcatataaagtttgtcttcattagagttcacatgaaaaagttatgaattatttttaatgtaaagtctttagaccatcctatttgacccagatcatattcaaatccaagtttagggaccggggtgacacagctgaacaagttggaggacctaaacgagtgatatgcaagtttagggaccgggataacacaatcgaacaagtttaaggacctgaacggtcgatttgagagtttaaggaccgggatgacacagcggtacaagtttagggaccggtgatggactttactcttaagtatttttaacttactatgaccatgaagtgctaattgtaaactgaatacaaatgtgaagaaaaaggatgatttctgctgatgttcttgtcagttcttccacccaaactagccaaatcttcaccagatgaactgataacttcacatgagattggcagcgaaaacaatgcagcaaacatcacaaactagtagcaataatcccctcctttatcagacacaaaacggattccaaataaaatctctcctatagacaaaacatcaaacggttcgtgggcgctgtcaaaagctgaaaaattcttccgcagaacgcactgaacaagtgaaccccatcccaatccccgtcgtttcgacagtgaattcgtgatcaatcaactcactactcacctcgagaagaaatcgagccctccggtaatacccgagccccgcccacatctcgttcacctcctgcaacaatcggcggcaaccacaaatcaagaactcgattaccactctcccacacacagcatcaaactttacatttccttttccagcgatggtggaggagagataatttctcttgtctcacctcctgcgtggcagcggcgaggctgtccacggtgggccagcgggccatccaccgggagtagtagtcgaccaccacgggcacccgcgtctgctgcagcatcacctccgacacccacaccgcgtacgccctcttctcctcgccgcgcccgctcccgctcccgctccccgccggctccgcggcgcgccgccatggcaggtcgcgccggttggcgtcgtaccaccgcagcagctccgcgcgcaccgccgcggcggccgtggtgagccccactgctgccctgcacccggacggcggcgccaggtcctcgatgtccgcggaggcggaggcggtggcggcggcggcggcggcgcgaggtctccgcgtcgtggggcggcggttcttggccgccttggggttcttggccat

SEQ ID NO: 11007 - DNA, 1501 bp, Oryza sativa
acaaatgattacctttgaggttcaaaatcatcagctcaacaaacatcgtcaggcgaatgtgagagaaaatgtgaacatgttggccaacatcttccctgaggatcacactggatctccttttaacatctatgctaaggacctgcttcaaatatttgtccatctcttttctcctattcagcacatcagtcttctcttcgctcacaagaacagatgggaactcccagagcccagcgagcaggccctcttctggcctcttgatcaatagaaagagattatcattgatttgaacaacacaaacagcagcaaaatcagaccgtggcttggcttttggaaccactcgtgggtagtctgtaacttttacggaagcactttggttggaaagtgtgagtgcttggcagtggttggagacagggcactgggagcaaccgggcttcgtctttctgcagagtgttgctcctagttccataattgcttggttgaagtctcctggcctagaagggtcgaccagttcaccagtgagctgcctgtgatcaaggaaatgatgttcaaagtctatgcaatttggaagttttcagatcaatataaagcttctaattctgaaaaagctgtatgggaaaacggtatcatatggaagttcaaaatacagccatttacagataaggtttgcacttgaatggggatcagggaactgtaaattgagcttgtaaatcgtagtgctgttagaatttcaatggttactctcattgagaagaggatggcactcgagatgggggcgattttctggttttctttattcactaaacacaaaagtcatacctacccgagagaggttggatacatatatatatatagccatagctggctgctagcctattgctgcaccctcctagtctaaaattcgaaatttgaatgggatgctgtcctagagggcatccaaactgaataaagcataaaggaggcataaaggagatgctaactgctgctgtcctactaaccgcagctgtcctagcaactgaaaaatatgctaaagggtagatgctgtcctgaaaaaggtgaaactacccaaaagcaaaaagaagaatcatgaccaaggaccacaaagacttatccaacattctccccctaagtcttgtgcgtcgtcttgtggggaaagttgggccatcccgatcctggagcagagctcgaggaacttgatcctcccaagaggctttggtgagcaagtccgcaagctggtccttggtgttgatgtagctcgccttgatgctcccttcctccaagtagcttcggatgaagtggtacctcacccggatgtgcttgctccgttcgtgaaaacggggttttttgccagggctagagcagacttgctatccaccctgagctccaccgttccagtgtctctgccgaggagatcactaagcagtcgagcaagccagagcgcctgggtcgaagcggcggaggccgccatgtactcggcctcgcagctggacagggccaccacctg

SEQ ID NO: 11008 - DNA, 1501 bp, Oryza sativa
tttactttctagaagtctcaccaactatcagaggctctgccattatactcctgtacgacccgcccactgcctctaatttttattgtcattgagactttaaaaatcaaatatgattattattggggtttattttttttttactttctacaagtcccaccaaccgccttaaccaattgcttcacaacctacccgtcgtcctttcttttaatcatcattaagactctatttggtgttttattaatagtttttagatatcccatcaactgctagcactctacttatttataggtctgttacttaattaatctcgccatgtgttttacatagtatttttttcaatagtctttatttttttatcaccaatttaattggttatttacaaattgtatttctagatgaaatcttatttttcttttcctaatttcagaatttattttattttttgttttgaattttaactaatatcatattatgttcttttaatatttttattttttattttcaatttaagttgtttcaaaattgtattcctatttgaactctctttttaatttgtataattttagattttattttttttatttcaaattttaattaatctcgtattggattcttatatgtactcttatttcttatttcaatattgcttatatttaattctgaattttagttttcttttctttttctattctcgaattatttttatttttattccgaattttaataatctcgtattgggtttttatatggaatctttttcaatattgcttaattttaattccgaattttagttaattttaaattatatttctactcgaactcttctttttatttttttctaatttcgaattttattttattttttatttggaatattaattagtctcgtattgggttcacccttctgtcaatagtgcttgtttttaatttcgaatttcaattatttttcaattgtatttctagttggactcttcttttctttttctccgattaatgtgggagtttctagccccacagtgagcgtggtgcctactttcaaaattgttttaataatataatattaattagtctcgtattgggttcttataagtactcttctttcaatagtccttgtttttaattctgaatttcagttattctgaattcctcgcaacagaagttgtaagtttaccaggttgagtacctatatgggagcaggtgcgaagtcgatcacgaacaagtggaagacgtgggtggtgtccggtctgaggcaagtctgttcttaggcagtagcagccttgttcaaattgtgtgcggggctggtggtaagttcgctgttgcttttcacaacttgcctggtgtaacatgtaaggccattcacaatgcacatatatgtcattcattctcaaccctccacgtcaaagattccatgccatatgtgctactcccgtgaccaagtgaagaacagggagccaaaactgggcatgagttcctcgtcagaaatacgtcagagcgtgggaga

SEQ ID NO: 11009 - DNA, 431 bp, Oryza sativa
tgcggaaatatgaactgaaatagttgctattgttagggctatgttcatcagggtaacctgaattttgtggagtgtagtgatggtggcacctcagtgcagctaagtagaaactggagaagatattattttactattggaaaaagtacgaattaacccaccccaccccccaccccaaaaaaaaaactatcacggtcgatcgaattatccctcagaaccgcaaaaccggacatcctttacccccgaactatgtaaatcggacaaataaccccctggctcaatccgcagtggttttggtcctacgtggcaatccagtcagaaatttctttttttttaaaaaaaaatcaatgggccaaacatgtcatttcaccctctctacctctctctatcctatctctttcccaaatcccccctctcttctccctcccctcagc

SEQ ID NO: 11010 - DNA, 1501 bp, Oryza sativa
gtccaacttctttattgataaacgaataatgttcgtcaatcccctgatatatgaaatgagaatcaaaataagagcctttttcctgtctctgccattctaatctcagttttgcaaatcagtatctggaagacgataacagaaaagaaacatttcatatctatgtataaatacaaccttgatgagtttggacagaatgaaaaaaaagtaaatacaattagagaaagttataagttttcataaatatcattagaacattacaaattgatacaacataatcaattaaccatgattggcacttggtcaaaagaaaaacttgagtatatttgctctttgtaaggaaaacacattgtcatcggatcatttcttccccaaaaaaggtatagagcagaaaacactaaaataatcaaatgatggatggactttccagatttctagatatcagtcaaacataagtatgccttaaactaaatcgaggggggatacagcacctcagttcagggtcgctgacacattgtgtaaaaaaccatccctgcttgcaggtataccctgcgtaaattaactgtcataaaatcagccaatcagtaatttagttagcaaaaaattcactgttgaaatattatttatcatattcatcaacagaacagaaggcttatcatgacaaagttcaaacgtcaattatgtacccgatcaactgacaattagaacttataagaaccatcattcaataaataacgtgcttcaacccatgtatcaaaccctatttgatgtatatatgtttacagtgagaatatgtggaagcctatgttacttacatcagatcaaaattaatagcttgcgagttgcgataagtgttgaaaaaggtaatgtcatgtgcggccagacctacggccggcatgtggaagtcagaagcagcacaccacgttccaattacatcccaattgaaaccctttgcttaggattgaagccatttaatgtatcatccatgatatatttatatttattatggttcattgtctttgtacttaaaattttatttattagggcctctcatttagggcgatgctcctattcaatagtttaaagaaaaggaaaaagttatccaatctcctattcccctgtgtcccttgccagtctcctatacgcccctcctgcacggacattcttcttgttaatcagtcacagactcacagtacaagctggtcttgtcaggaattgcttttagctagcagaaaatacactggatacccaaaagaaaacaattcattaatataatgggcccactgttcttcagctgtcctccccttatcttttcttttaaataatttgtaccatttaacattgcgtctatagacggcaatcttgatcccattcaagggtcaactttatgattatacaaagaacaggagacagataatgagcacatgctaattcaatatcatgagtttgggctgaaaagcttttgaattgccataaatgatggaaatctcatccctgagtgcat

SEQ ID NO: 11011 - DNA, 1501 bp, Oryza sativa
cattgtctctgatgggttgagtaggcttctatcattaggggggtttccctgggattgaaggaatgacaatttttttttaaattccccttcccaatcatttctaaaactcctatgtttaccaaccaaacaaaacgcgtcatcatcattcctcaaactctcattccttcttaacaattctctccaatcaaacgcgccgtgagagtcaaaggcagggcagatcacggactatttgactctcattcatttttttcttaaaacaaactccttccgtgattacatgtagttgtttcaactggattttttggggggccgggttttgacgtcttctgaaattgaaaggagctgtgttcgtgattgcaatcacgggagatcgagttggacatttaattacatatcgttgttgtttgcagctaaccatcaacctcttcgatctgcctgtgctgcaagccacatcaccgtcgagttgactaaaaaccaaagatatttttgccatctggtattcccacaagtacatacacaaagcctctgattattttcattgtaacacaagttctcttgcattaatgaaatgtatctgctacattttgctctctttttaatttttttatggttttctacttaaagatgcatattatggacaaaatatgcacactgcatttatagaaacacactcaaaccccccccccccaccccccccaactcccaaataaaaaaaaaccttatatccacctaataataaaactaggaactagacacatactgatgaatattgcaaatcttgaagccaaacatctcaaccattttccttcacaaaataagtaaatgtgtgcaccacgcaaattaaaatatcatgtatatatccttcctctaacttcaaatacaagtcatgttatgtaaaacagtacaattaaggaaacgactcaaataattttatcgccctaatacattaaaaagtgacttatttatttatttatttatttgtaagagtgacaccatttatttggtaagaacaaaccaaagcaaaatgatgaaagattgaaggttctatttttttatgagaggttgtaaaactaattaacttaaattttggaaaataagacgtaaagtaggattaaaaattacatttataagcaaagaaaatactacacaattacacattaccacaaaacagaggacagtactaaatcctctatttctatttaaagagaaaatgaaaaataactggtcgatccgctctaaagaatttctctctacaatacaaaaatcatggctcttattacaactaatagtaatgctacacatacttaaaacttccttacaaacttataacaaaaatctcattatagaagattcaaccataatgtgacaaatccgtatttgtaaaaagtttataaaaaaaatagtacacgtatatcgtttccctactgctaattaaccctctataaatgcatgcctctcaccactctccctccattgccatttcccctactctctctctctc

SEQ ID NO: 11012 - DNA, 289 bp, Oryza sativa
ttttttttcgttgttgcttcctgttgtgccttttggttagagcattggacggtccgtccaatcaacagtatgcttaagaaaaagaatgcagtaatctagtgggtattttactagaggttgcacttatacgggttaatattttgttattagacaattcattcatttttagagacacaaggcaattatactatagcccttacatccaagtaatcaaacaaatagagtttcaaccaaaccaaatagtcaattaatcatctaaatggctaaatgttcagatgtgttacttagt

SEQ ID NO: 11013 - DNA, 1501 bp, Oryza sativa
caaacaatctatttgttgactcaggaattccatatacctaattatgttatttgttatatcttttttatgcacacaagaagatatttggttgcatcggttagattatatgccatttggcaaaaagaacaactctaaaaatagtcttataaatggattgtggtgcgtcacttagggcaagccatactaagtaccacgatgagctacaatgagagacaataactagcacacaattaaaaaaattcctttattcattagatagttaagtattgagctttttgtgatatccattaaataatttaacttttacatatataatagaatattgatggtaagaaacaaaaaaaataacatattagtttgatagtgaaaaagggttagatcttattaatttgggttacaaatgtgtcaaaatactaatgatccccgaaaattaccttcattttccgaaccgtttattactgattaaaattaatttataagtaaaacttttatagacatatccttagtgattcaaaagcaaatgttgtaagataaactacgttaaaaaaccaacataatcaataactacaaaattactactactccatccgtccaaaaataaatcaacttaatttgaatttgtcctaaaataaatcaacagttaccttcttatctaccatcggtccgcaaatcaaaaaattttattccatcaatacccctcaactacctattcaccaccaatgtaacttttctaccatcggtccgcaaatcaaaaaattttattccatcaatacccctcaactacctattcaccaccaatgtaacttttctattaattagagacattttggctcattatcttcttccttaattccaattggcaacctaaggtttaatttatttgtggggacaaagagggtatattttatattataagtcatattgattttaagtcaaacttctttacgtttgactagattcatagaaaaatataataatatttttaacacaaaaaactatcaaaatatattcaatgttagatgtaatgaaactaatttagtgcctctttttaattgaaatataagtatgtttgattttaatttgttgggtagaagattaggaaaagagaaggaatacaagttctaatgctaatggaattactgttggcaaaccgttaaaatgcacatgacacctttagacttatttcttagtttcctttttcgaagctgtctctgtatctttctccgaggctttctgcatttgtatgacaataggaatcgtgagcttaagcactgatatagaaaacaaagtattaaactatagtgcagttcaacatatatgatttaacatgaaatacattatcagtcttgacggggaaaacatgccgtagaaggccataaacttgttatttcaataacacatattacagcactagaccaaatgttacttggcatgcatctatttatatactgactatatatttgaatatttgatgactacagataaggctaaaccataaata

SEQ ID NO: 11014 - DNA, 1501 bp, Oryza sativa
gaataactatcatactttaaaatagcacaaactatttgatttcagaaatgggaatccatttggatgtgatggcctgtttactgcttattacgagaaaccctaactgaaagtctgatagtaattcttctagttccactattgccctgtttatgatgccaaaattcagagttggagttacactaatttcaggcttccagcagcttcacattatattccatactattattactactacattattataattaaaaaattaatagaatatcaagatcaatcaatgttgcttatctcaatgcggtgtgatcctaagggatgcatggagacaagaaggaaacaagaagactgcattccatgcttatcctttggcacgtttcaatgattcagtaaaggcttcatttcttctaaccatctaggctctaaatcctaactgaatttaactatgttcatggcagttggtttgcaatgtacaggtggtaacactagcttcatctgccacatgacctgcctgaagctagagttcttgacttgagagcataagttcatctttctgcgatacccataaacctacgcagagttcagagtacttactgttcttcgtgatctgtgcactcctaatctctcctaaacccacatgtagctctaaatatatagtgccattttgaatgcattttctcgcatccaccgtttagatttattgagtcgcatgcatcaaccagttcaacttaaaaactcaagaaaacaagacgattcaattgtacttcgacaacgctacaggagtaaggttggtgattttacccctaacagactgggacactactgtttcatgtactcatagacttgtttgtacaggaaaggaccaagaccacatccattgaatttgaggcaaattacaccgtacttaccgtcgaaataactaattttgctataatcaaccactttgccataaaattcacaatttcccgaaattaagctgtgtaatagcaccaaaaattataatctttaaatcaaactaattagttaatgtagattatctataacaaagataacccaaaacaatgattattttgcagagaacagttaggagacagaaatccatgtcccagagaacaaaaaagaggacatatatatgcatggatgacacagaagtttagcaaaaagcacaacaaatcattccatgcacctttctgcatgcattcatgcaatgcagaaacaaaaaggccatgcatgcatctccaaagtaccaatagaccagaacaagagccggtatgtgtgtcatgctctttcagcagcatcagcaatcaaaggtcaaaccatatccgtactattttaatgcactcttcatctgctcctataaatcccagcaccatgaccaaacccatcacaactcatctcatcacattccatacacacatccatagcagcttcaagctaaggtgatactactacattcagagagaagaagcagaaagagataagaggttctgagagagactgagagaga

SEQ ID NO: 11015 - DNA, 1501 bp, Oryza sativa
gttcaaccattattttctagtttttttctcaaacatacaggaggagagctgtgtattttctttatagtaaagagagaagagaataaaactcttctcatgttttgatttttgttgtgtaggccatacagatgatcaaatctagcatgtgcatctttaatggagtgcttgtgcagatattttacttgtcgaaattgatcctattgtactaacttttgacctcattgtcgaaattgatcctatttactaacttttgacctcatgtgaccagaatgaccgttgacaaaatgtcatctcacccaccatgcttatatagttatatttatggtttagccttatctgtagtcatcaaatattcaaatatatagtcagtatataaatagatgcatgccaagtaacatttggtctagtgctgtaatatgtgttattgaaataacaagtttatggccttctacggcatgttttccccgtcaagactgataatgtatttcatgttaaatcatatatgttgaactgcactatagtttaatactttgttttctatatcagtgcttaagctcacgattcctattgtcatacaaatgcagaaagcctcggagaaagatacagagacagcttcgaaaaaggaaactaagaaataagtctaaaggtgtcatgtgcattttaacggtttgccaacagtaattccattagcattagaacttgtattccttctcttttcctaatcttctacccaacaaattaaaatcaaacatacttatatttcaattaaaaagaggcactaaattagtttcattacatctaacattgaatatattttgatagttttttgtgttaaaaatattattatatttttctatgaatctagtcaaacgtaaagaagtttgacttaaaatcaatatgacttataatataaaatataccctctttgtccccacaaataaattaaaccttaggttgccaattggaattaaggaagaagataatgagccaaaatgtctctaattaatagaaaagttacattggtggtgaataggtagttgaggggtattgatggaataaaattttttgatttgcggaccgatggtagaaaagttacattggtggtgaataggtagttgaggggtattgatggaataaaattttttgatttgcggaccgatggtagataagaaggtaactgttgatttattttaggacaaattcaaattaagttgatttatttttggacggatggagtagtagtaattttgtagttattgattatgttggttttttaacgtagtttatcttacaacatttgcttttgaatcactaaggatatgtctataaaagttttacttataaattaattttaatcagtaataaacggttcggaaaatgaaggtaattttcggggatcattagtattttgacacatttgtaacccaaattaataagatctaaccctttttcactatcaaactaatatgttattttttttgtttcttaccatcaatattct

SEQ ID NO: 11016 - DNA, 1501 bp, Oryza sativa
ttacacatctgggaactagcactagcagtcagcatgctttcctaggccttatggcggcccaagatctaatcacattcaaaattttctgttttgcagatcacaatagatgttgacagtgatccgagagctgcatattttagacaggccaaaaacggcctctacatcagaatggcgttgctcaaacttctgcttgttggtcgctgacagctttcttagtgcgtggcgctgtggtgttgatgggggtcaaaaaatgtttgtcttaatcaatggctccaaatcaactgattagtattgtactaggcaccataagttagatccttgcaaggatttaaccatgtctagaactctagatgcataattttcgatgtaacaaaatattctgaaacagagatttgttgctctcatatgttcttgtgaatcattatcaccgaggactgcactaattttcctacagtgttgttgcaaggactgcagtgatttaccgagtagctctttctgccctcttttgttgaccaaggacaaagaactcaatgtaactggctggctatcagtaccagacgagctctggtattttccccatatcctgttttaaccctaggcgctgacacgttgattgtttttctcttgtcatgtgtaggtatatgatctattgatctatatgattggcacttgccaaggaatagcatggttgtcacctttcagagtatgacagattcctgactgaagcataatcccattggcatcgctttctgcaattccaagtttccatatcatgactgcaggtgaaaatgactatcatgacttccaggggtgacacattcagggtttgtgatgtatactggtaaattgtcatgagagagaggtgatggtgagcccacaccagcaatctcaaatggttggccagacagaagaaggtttcaaagcccttcatgtcagcaatatgacacaatgcataaccggccggctcacacatttcatgccttgggaccccggtacggcttcaagatgttgacctagaacctgctgcattctaaagcctctgagaagtgaattagttagcttgattaattggcttgaattcagcatcactctcactctcatgatgtgtagtgttggcatctccgaatcaaaaccatggtaatttgcagtcaattagggtccacagacagtgactggtccgatacatgacagtggaaatatacatggctgattggcaacattccctgaccatcttgttctaattagattaacattgtgtttaggctcaagagaagcttctttctcagtcatgagttgcgtcagagtttcatgattgtaacaccagggaatattgtcgcagaggccatgcatgaaagtgactattgtgaggatataaagtcctttttcttcttccagtgaaagccaccttgcatttttatctgagctcatcagtcctatctgatctttgacagaatggtgccaagattacatcatctcttggacctggtatatatatttttta

SEQ ID NO: 11017 - DNA, 1501 bp, Oryza sativa
gaagatcgcctcatggagcttcagtgacgagatgctctcctcctcatagggctgtcaacgagctcgctcgtctgtctaggtttgagctcgatcaagctcgagctcgactaccgatcttgatttttaattagaaggataatctttaaaaagtaattaatttatggttcatcatattaatagaagaggaaaaagaataaaataaatatatgatgccactacaagacatacaaataatatatttaatctcctaatttataaaataacaacaaaaaaaatatgtatatctagtctcgttagaagcttgagctcgagccgagctcgaatcaagctaggacgagtcgagcttgagcagctctcaagcctcgagctttttcgacagccttacctcctcatccacatccctaatgccacctcctcgcttccatacccaccgccggagccaccacatccatctccccagatccatctaagctgatttattacttcttaatagttgatacttggggttttcattatctgcattttatttaactagtttttttttaaaaaaagttgcaattgaaatacaatgcaccactaacaacaggcaaaaaaaatgtaaatttgcaggggggaattttgggggaaaaaaagacaaaataacaaatttaataaactgctgatctcttcgcgtcttttactctactctgacggtctctccgcgcatcatcagtctctcagccaattatcccggtgcgcccgtcgtcccctcacgccgtcgccgtcgccggctcgccgccgccaccgccaacacaagatccggacgccattcttcgcgtgctgcttagctcctccctttccttgcctccggtttccttccctcgggtcagttagttgctcaggcgcggcgcggcgcggcgctacccggaggttgctgcgagctccgtcggcgcacgcatggcacgccgcgtccccgcccgagcacgatccgtcggcggcggccctcgctccgagggtgcgcgacccggaccaaagaccggagcagcaggcgccagcgggggtggcgccgaggacgcactccacgtgttcgacgaattgctccggcaaggcaggggcgggggcgggggcgcctcgatcatccgcagcttgaaccgcgccctcgccgccgtcgcgcgcgacagccccgcggccgccgtgtccggcttcaaccgcatggcacgatccagcgacggcgcggtgactcccaccttgcacacctatggcatcctcatcggctgctgctgccgcgcgggccgtttggacctcggtttcgcgggattgggcaatgttattaagaagggatatagagtggaacccatcatctttactcctctgctcaagagcctctgtgccgagaagaggacgagcaacgcaatgaacatagtgctccgcagaatgacagagcttggctgcgcgccgcatgtcttctcctacaacattcttctcaagggactctgtcatgagagcagaagccaagaagctc

SEQ ID NO: 11018 - DNA, 1179 bp, Oryza sativa
aggggtggggcccacgggttaagtgctagccccaccccggaggagcatgcaagaggcactagcgcattggggtggtggggggttggcgccagtatggcaggtggagccctattggatgacaacaccagccactctggcacacaaaaaatgattatttctggaataagttttttaagggatgtatttgtaaattaagtttttggaaggaccaaattgtaaaaaaaatccaggatctcaaacaccgtaccaaaatccaaatatacttatactttagagagtgagtattgatctataaatatctaacaaatagcttaaaaataatcaatgtcgataaagaatatttttcaaaaaaaatgtacgattattaaaggtacaattttcgatagataacaccattgaattttcggtacacgttcgacaatttatttaaattaaaaataaataattattatttattttgttgtgacttggtttataactttattaagcataacttacatttccacatgtttgcataaaaacgttaaataagacaaatggtcaaacacgtgtaaaaaacatacttacccacgcgaatgtgcgggttaccttattagttttattataaaaaataattgttggtcaaagtacctaacaaaacataataggccttatattttgaaacaaactgagcaataattagctatacacccttttcattcggaaattcttgcagtcagaatttttgaaatccttagcatgcacacattcttccatgctgcattaattgtattatgatggaatccgtgtctatgcggaggttacatgatgatcaatttgagaaattttgaattctatcatatgatgatcaatttgggaaggagggaataatttttttctggattgctgcagcaatgtagtgggggaatcgtctagtttatttatttccattgaccatcattaaatgagttaagaataggaaatttacaaaataaaaggtgtcaccataaaagtgtctttcatgagtgggatatggtccccctgttactactacttgttctacctagtgagtataactctgttccactggtgcagacttctacaccaccatatgtctatatatgctgacttggtttttgctcccaagtgttatcaccagactgcaacctctcaacctccttactctaaccatggcaatca

SEQ ID NO: 11019 - DNA, 1501 bp, Oryza sativa
acgtactattagcccctcttactgttgtcatttcgcaaatttgtttctgattctgagatcgtgcaaagatcatgccacaagacttgtcacttgcgtagcttttgcttcccgcaagtggaaaactcatgtgcacttcaacgtcttgtaaatgctagctcaatgtgtgcaatgatccccttttttccccaatgttcttattaaaaacgcttagtgatgaccttacgggtcacttttcaaaaatgtgcagtttgcactactgaatgcaatatgtatcttatgagaatcaccttgccaaggaatataggcttgaactgaagcatcccggcgatagtgaggaacacggtggggtcatctggcacaagcgacgagctaggaaggatcttgtggccacgggcagcatagaaatcaaggaaacgtcggcgtatggcgtccccgctccactcccccgaactcgctgcgcccacctcctgggttgccgattcgactgaggctgtggattacattcaatttcaccacaattacaaaccgaaccatacataccaagcagaaacttactactccatccatccgtttcatattaaaagtcgtttgacttttttactattaagtactaattttatagaaaaagctagcaacatttaaaatatcaaattagtttcattaaatctcacattgcatatattttgataatatgtttcttgtgttgaaaatagtaatatatttttctataaatccggtcaaatttgaagaaatttgactaggaaaaaagtcaaacgagttataatataaaacggaagaagtactaatcatcaatcagactaaagggattataaattactaaacctgatgagctgctggtcttcacgagcaccccgcgctcacgagacgaacccatactcctcacgacgcaatctcccgcacagcccaacgaccctgcagcgcagcatcacgcatcaaattctgcaccgcctcagaagcccgcggtccgcggattcgaacagcagtgaggagtgagttaccgcggggtcgaggagaggagcggaggcacaggcggcggcggcggccggagagaggcaggagaacgtggaggcggtgggcggcgggcgcggtggagaggagggggagaggggagcgagaggtggcggtgggggataggagtgcggccgcctccatggctgagagctccgcggcctccgcgtccgcgcgcgtatggtgtttgtggttttggcttgctgggcgtcgcgggggttatcgcgattgaagtgtggggtggagacgatgggttgagcatccgccgtccgattatcctctcacacaagtataataaggctgtgtgtgtggagtggatttaagaagaacatttccggtgaaaacgaattcactgttgaaactcgtgaacatcatacaaattttataaatttatgagcaaattactataaagatatgtgttagatatgaaatgcattctcaccaaaccaaatagaaactcaattttatttgc

SEQ ID NO: 11020 - DNA, 1501 bp, Oryza sativa
gtaaaacatttacacgtgaaaaagaaaacatttcgtaagaaaaagtttagtgtatcatttttccatcagtgacttcacgagaaagagccgaagcatgagttgtttaagatagcgtttgattaagcaagacgggtgagaaattttatcctatttagtataggcttctcgaattgttaaatagggtggtttttttaaaaaatatatagaaaaattagtctattattttaagtttaaaataattaatacttaattattatatgctaatagtttatctttattttacatatactctcattcttcttaaaataaaatatcctataaaaacgggctagaactagtgtagatatatgaaatacattcttaccaaatcttaagtcaaaactcaaattaatttgtaagaaataaatggcaaatttaatggtaacagtgtcatcacccgaaaattgtcttttttttactcgcaaataaaattgagtttctatttggtttggtgagaatgcatttcatatctaacacatatctttatagtaatttgctcataaatttataaaatttgtatgatgttcacgagtttcaacagtgaattcgttttcaccggaaatgttcttcttaaatccactccacacacacagccttattatacttgtgtgagaggataatcggacggcggatgctcaacccatcgtctccaccccacacttcaatcgcgataacccccgcgacgcccagcaagccaaaaccacaaacaccatacgcgcgcggacgcggaggccgcggagctctcagccatggaggcggccgcactcctatcccccaccgccacctctcgctcccctctccccctcctctccaccgcgcccgccgcccaccgcctccacgttctcctgcctctctccggccgccgccgccgcctgtgcctccgctcctctcctcgaccccgcggtaactcactcctcactgctgttcgaatccgcggaccgcgggcttctgaggcggtgcagaatttgatgcgtgatgctgcgctgcagggtcgttgggctgtgcgggagattgcgtcgtgaggagtatgggttcgtctcgtgagcgcggggtgctcgtgaagaccagcagctcatcaggtttagtaatttataatccctttagtctgattgatgattagtacttcttccgttttatattataactcgtttgacttttttcctagtcaaatttcttcaaatttgaccggatttatagaaaaatatattactattttcaacacaagaaacatattatcaaaatatatgcaatgtgagatttaatgaaactaatttgatattttaaatgttgctagctttttctataaaattagtacttaatagtaaaaaagtcaaacgacttttaatatgaaacggatggatggagtagtaagtttctgcttggtatgtatggttcggtttgtaattgtggtgaaattgaatgtaatccacagcctcagtcgaatcggcaacccaggaggtgg

SEQ ID NO: 11021 - DNA, 1501 bp, Oryza sativa
ctagcagaaaatgctggatgctttaaccagttgacaaggcaatcatttggtagaaaagatcaaagatcaattgcacaagatatgatttaacttgccacctttgctgaggtttaatgctggacttatattagtaacacatcaatttcagcaaactgttttgagtggaatttcaagtgacaggtgtatttcatttgcagcttaagaccaaaattattgttcaggtttatcgttcatgcttacaactcaacatacaaaatcgatttaataaatctcctattcaatttaacatccgcaaatgtagattctctagtatagttacaagctagtatacacagtcatttacaagtaagtatatgtatttgtagaggaaaaattcagacaagttcaacactgaggagaggaaggggaacagaaagtcaggtggtgggggaggggggaggagtggacacctgaggatttcaccgcgccgccgcttgccggtgcttgcgtcggacagatgcgacgcgccgcgccaccggccgcgacgccgcttgccgggaggactagctgccggccgcgccgccgcctgccggtgcctgcctccgacctgatgccacgcgcggtaggaagacgacggaggaggcaagggcactgaagggggaggagacgccaacggtgccggaggtggagagggcggggccaacggacggcgacggagagggcaggggaaacgtacggggacggagggagcggagaaggcagcgagggcgggggaggcagacggcgactgaggaggcggacaaggcggcgactgagaggacgggggatacggacggcgacggagggggtggacaaggcggcgacgccgggggaggaatagcgacgagactgcgtgcaacggagtcggacctgatgcgatgcgatgcggagtccgacctgatgcgatcgaacagaagaaaataatccatgccaaaattacccctaaacaatattaggagattacttacctgccctttaaaataaacggtcgagatcaattctacttggagtagaatactgcaagtagattgcaccggagcattcctctgcaaccacaagcatattccactataccaaggtattttacacatctattatgatagctggattcaattacatgcggtagatccataaaaggtgagttgaattgaaatttaaagcgagaagatacaatagatattaagttgatcgtaggtttggtttgattatatagcacgccgacggtggtacaccgggctcacagcttcatggaaaacagtgggcagcaccgcagcagcaaaggaagaaagcccccaaacgaaacgggtgaggggcattttcgtcattccatacaggtcacctccaaactcgccaagcgaaccacactgcgtcactgtgataaaagccgctctgcacccactccgtccacttcctctctctctctcctaccgtcgccttccactttcccctctctctctctctccgccgccgccgacgccgacga

SEQ ID NO: 11022 - DNA, 870 bp, Oryza sativa
gccttccatcacggaggtgacgttgcgactggtgaccgttgacgaggcgccgccgtgcgacgagtggcacgacgtgccggtgatcgtgtactccaacggcggttactgcagcaactagccaactactaccaccacctcgcctccctccgagcggcagcagctaccttgtctccctccgtgctcgcccgtcaccgcccgcctgtggcctgctccacccgccgtcctctcaggttcggggggaagaagagaagagaagagagaacaaataaaagagaagaagaaaataaaaagaaaagaggagaggagaggacactgacatgtggatcccactatatgccatgtcagccaaaccaggaaaaaaatagatcaatactgcctaacgaacttttttttttttttacggttttgtataatttaggggcggagatttttggttttgtggttaaaagacctcaaaaaatctcgttaagttgagggaccttcggtgatcttattccttctcataaacaaattaggcccacaagtgaatttggcccacttcattctcgtcaacaaaaagtggcccacgagtgaatacatttgaccgccgctgatcagagaattcaacccataaatgaatttggcctacttaattctcatcgatgaattccgcccacacataaatctgggccaccttatttcgataaccaatttcggcccatagttgtattcggcccacttaattccccgaactgttctctccggcacgcggcggagcgggttgctgccgacagctcgacaggtgttcgatcaaattcgcgcccggagaccgagactctgagagcgacggctcgctgccggcgaacgggacgccgccatgtgccccccggg

SEQ ID NO: 11023 - DNA, 264 bp, Oryza sativa
tggaggaggcggggcagggcggcgcagaggcaggagcgagcggcggcgagctcctcatcccccgccgctgccgagggaggggggaagccgcgcctcgtgggtgacgggaggaggggaagccgtgcctcgtgagtgagagagagaagagagagagagtaagagagagaagagagagtagtgtatgacaggtaggtcccataatttttttataaagagaatgctgactggactgccacgtgtacgccacgtagaccaaaaccacca

SEQ ID NO: 11024 - DNA, 1501 bp, Oryza sativa
ttaaatatggatagacacgagaaaactattagcatatgattaattgagttttagttattttagatttaagaaaatgatttatctgtgtttgagggagaggggattgagaagataaacaaaacgaggtgagccattagtgtatgattaattgagtattatctattttaaactttaaaaatagattaatatatttttttaaagcaaatttcatatagaaattttttttttaaaaaaacacaccgtttagtagtttggaaagcgtgtgcgcggaaaacgaaacaaacaaactctctgttctccaaacgaacgcaaagcaacttttatatcgaaagttctcatataaaacgtatttatccgttttataatgtaagactttctaacattatccacatttatatagatgttaatgaatctagaaatataatatgggcaatgctagaaaatctcacattatgaaacggaggaagtaccgttgaacagtttgaaaaacgagctaatgaaaatcagcgtagagtctgcatcttaggttgtgttggagaggaggccagggttaggaacctctcctctgcagcacgtaaaacaaaacatgcattcgtaaaccctggtagtgactagtgagctttgtcctgttcgtgaccaagaaaagaaaaaaaaaaggcggaggcggcgccggtgagacacggtacgttgttcgctgcgtccccacggccacggtggtcggcggccacgagatcgatgcatgggttgtttttttttttttattttatttttatttgatcgatcgatcgtcaaactgtttacacgtacgagcgcgtttcgatcgggttcgcggggagcttgatgtgctggcgtcagcatgacgccagcggtggcagtgggccccaccctagtttgacactcatcagtagtgctaggagtaggtcagtactatgcgctagccaatctggaacggggaccgtctacgtacattcagttgagcggtagagactagagaggaggttatccataccatacattttcttttagaaaaagaatacacgtacgagttgaagtgggagaatgtacgggatcgagtacagtacgctacaaatactacttcccgtgtcagattatagcaacataatatactccaatatagatagatttttgtttatatttatagtactaaggctgcgttcgtttcagtgtgttcccaatccctatctctcgttttccacgcgcacgcttttcaaactgctaaacggtacttttttgcaaaaaaaatttctatgtgaaagttgcttaaaaattcaaattaatccatttataaaaaaatagctaatacttaattaatcacacgttaataaactgttctgttttccgtgcgaaggagatgtgttccaaaccctatgtatcgaacacaacctaagttgtgtctaattttggtatgttaggttgttatattttataatggagcgagtagatgactacaactacaactacaagcactcctaggtgtagt

SEQ ID NO: 11025 - DNA, 1501 bp, Oryza sativa
agacccatctcggaagtgtctccctccacctccacgaattagcacttaaccctagctttattttcctctataaatagctttgtacatcctcaaaaacaattgggttttgtttagttgaattttgccaagtgacattcaccttgtctctagtcctcgttcgattagtcggcgactttagattcagagccctcaatagttggtgtcttgatttgccgggtcgattagatctaccacttcaatcgcaactattccttgtgcttaatcacctattcacaatatttagattgcatcttatcttgttcttgtagtgttttctcgtttacattgcagggatcatcaaccccgcgtcacggttagtacgacatcgtttgtggtgtagcaattgcacggcgtcctggacttgttttggttggtagccacgtcgcaaacgtcgcactcgatcaaagctagagttatcccctcacccaaaagatcgggccacgagagagagcgtcatcagttggtatcacagcttcagttgcctggtgaggattttagttttatagatttattatttttcctacccatcacccacaaaattgccgcaccactttttccatctccaaacattagttttgagccttgcaattttcattcaattttgctttattgagttttggtccgctgtcgtgtcggagtgctcactggtggagaaaccatctttcgtcgtacggctgatttccacaatagtcccggatgcaataaaaaccggggctaaagatgatctttagtcccggttcaaaagggtaacgggcatatttgatctttagtcccgattcgaatgctatcagggcatgtcaggcccccccgggaaagatcgtaactttagtcccagttggtattaccaaccggggctaaagatcctggtgatctttagccccggttggtgctaccaaccgggactaaagtcccacccctatatatatgtcttcttcctcctccagctgcccgagcaagcttcaaaatttcttcaaaaaagaggagaggtcatgccaaaatttttattgaatttattttggtgattacatacaaatcggaggtgcctaaaaggtttgcaacttcatcgtccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcatataattattgtatgactgtcattattgtaagaataattatttgtgtatggttttttttgactcatgtaga

SEQ ID NO: 11026 - DNA, 1501 bp, Oryza sativa
ccccttcaccaggcacagaccacaccggccagagccggccatgggaggctagatccggccaaagaagcacaggatccaccgcctgtccacgcgcctcccgtgcggacgccgcccatcgggggagcggagggggatggggacgctgcccatctttgtggtggaagggggagggggaggggagggcgtggaggataatgtgaaggagcaggggggccggaggggaggcggaggagaggagcccaccgccactctgcctcccacactggctgcgggagccagcccgtcgccaccctgcctccgccactggctgcgggagcccgcccgccaccaccctacctacgccaggcagccgctgcgagagagagggggagagagacgcgatatgcgcgagagagagaaggggatggagtagataaggacgcggtgggtgcggtacgcagtgcacgcatggatggtctcggctcgtcggcttggctcaaagctataggtgccggtttttaaaaacaaccggttcctgtccgttctttaattaaccgatacagaaccaacacctataatatattataggtgccagttcttttaaaaaactggcacctatattataggtgctggctctagcatggttaaaggtgccggttctatatttccccccagttgggaaaagttctatatgtgccagttttaaatgaaccggcaccaataagccggtcccaatgaggatttttatagtagtgacctatagttgttcaaaggtgtcgattctctattgtttatcccgctgaaggtaggaaaatatcaataggtgctggttttaaataaaatggcacctataagccagtccctatgacggattttccaatcactagtacagatcctttcatctgtgacggcccataacaagactagaatttgcgggccgtcacaaggaagtaatctcaatcgggccgatatggccgcacaaccatggtatatcggcataaaactaaagcccgttacggatgacacttatccgtgacgggctatagttgaggcccgattgagatgagggttccatatctcaatcgggccctaaaagaagcccgtcacagatgagggtcatctgtgatgggctccaactagaggcccgattgagataagtttaatgcccgtcacagatgacactctttttttacgggcttttattaaggcccgatagagattacttgtatgcccgtcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatgaatcaatcaagtgagtaatattattcattaattgagcaatttcatcatgtcttacttttgcaatactgatcttacaatatgtgcctctaatttgttttttttattttgtagc

SEQ ID NO: 11027 - DNA, 1501 bp, Oryza sativa
taattacaaactctttcaacagtcatacaataatgacatatctttattcatacaaaaatcataaaatattataccaaataattcttatttactatttctaaagttttaaactaatattaattaatgtgttttacttcttttaattttcattttagtttgttttctattatttaagattaactttcactatattttccttctcaactattttataaaaccttctttagcaaatcaactaaattgctatatattctttcttctccacacaaattttctctctcatcaacttacagctaaattttggagacaaaaaagtgtgcaaaacatagctccaaatgtaatatgacaaaaaaaacattggaggatgaagttgctaaccttttagtcacctctgatttgtatataatcaccaaaataaattcacttgaaattttggcatgacctcccctcttttttgaagaaattttgaagcttgcttgggcagctggaggaggaagaagacatatatataggggtgacactttagtcccggttggatccccgggatctttagtcccggttggtaattacgatctttagtcccggttggtaacaccaaccgcgactaaagatcccgggggggcctgacaagacctgacagcatttgaaccgggactaaagatcaaatatgcccgttaccctttttaaccgggactaaagatcatctttagccccggtttttattgcaaccgggactattttggaattcggccgaccgacgaaagatggtttctctaccagtggtcccgggtgaaaataccgggggtaaaaatccatttttagtcccggttggtgttaccaaccgagactaaagaggctaatctggttgctctttccggttcctttttattattttcttttcttcattatttttaaatatattgatttcactccatcctgtccccaaaatcctaaatcaatcatcctcaaattgcctccaaatccacagatcgatcatctcaaatactcaaatacatcacaaaatcttaaaaaaaattacatcacaacttctacaaaattcatcacatattcacatcacacacaaatcaaatacagcacacaataatctcagatccaatcaaacacatcacacaacaatctcagattcttcaaaaaaaaaaagggagaaagcgttgcctcgccgcgcgcagccgccgcgccggccctccgcgccccgcctccagccgccgcctcaccgcgcgccgcgccggctggccctccgcgacccgccgccctcgcgatccgcggccctcgcgcccctgccagtagggaggagaaggaggagaatagagataaggatgagaggaggagataaggttgaggagaggagttaaagatgagaggaggagataaggttgaggagaggagttaaaggagaggaggaggtaccggcctcgatccgatcgcgcacacttctctgatctccgcgtcaatctttactcccgattggttttaccaaccg

SEQ ID NO: 11028 - DNA, 1501 bp, Oryza sativa
aatctatgcttcctataaagatacaacccactaattctaaagcttaacatacaaccatgccacatcatcatccactagcaataattacattttcaacctcatacaagtaatatcatctacaatctatttaattctacaaatcaacatgcaaacatattcaatcatcacccctcaaatcatttccacaatatttttacaaatatatgtatcatttttatagtaatatttaacataaacttatcaatatgttccacattaaagcgcgagattcaattgtttgtttcatgataaatactgataagccttgatattttatttgttttccttttacctttagcttgattgtcaaaaaaaaaatattgaaaagtacttagtaatccccgcagcaagacacacagggaatcacctagtatatcaattaaaaactatggatgttcataaatactatatgttggcatgcagaacagggatgtatttagtatagaaaaacagccagcacagtgtaatagaagctacaaacgaaatctccaccgtgaatataattttgaagagaaaggaagtgtatttagtttctagtaagagctagcgtgtagttgtgctgatcagtgtgtatcggtatcccaattacaccatataatgctatagggctttggaggcatggggaatttgacatgcacacctctagcttctttgacatccgcctccttgattgcgagagtacaggcttcccagtgtgttgccggcacagatgctctcacagtcacgtcggtgtcaagctaattttcttctctactccccaaagccaatgcttttgccgggctctatgttttctacggactatatatatatattccttctagacaaggggactcatttgctctgtaggacagctagcttcgagttaatcactaatatgcatgagatagttttttcacgaaaacgacttcgttcattggagggtttttctcgccccttttctttttctgtaagatattgggagagtgatcgtcatcgacaacctagctagcttggcttcataaattattgggcgtgttatatttgtgagtgcaaatgtgtaaaaacaggctagctagttaaatacataaattaaactttgttggatcgtatttgtaaatgcggagaacttaaaatgaacaaaataatttctcaatgaatcatgcttgttgtttttgtagtaaaagaactgaagagtacataggctaaatatataatgctcatgaggacatttgtactggtgtcaagcactatctcggccatctctggtcccacagccagggaagctatctctgctggtagccttcagtgctagttcataaacatattacacaaaggaatatatatagagaggggtgtatcaatggaaaatggacactcaacactacatgcataagttggcaatattaacctgaaacctaaggaaatgtcatctaggagctagttaggcttccgaggcatcaggaaccggtcaggcgtgaaaata

SEQ ID NO: 11029 - DNA, 1501 bp, Oryza sativa
acctcctcctctcctttaactcctctcctcaaccttatctcctcctctcatctttaactcctctcctcaaccttatctcctcctctcatccttatctctattctcctccttctcctccctactggcaggggcgcgagggccgcggatcgcgagggcggcgggtcgcggagggccagccggcgcggcgcgcggtgaggcggcggctggaggcggggcgcggagggccggcgcggcggctgcgcgcggcgaggcaacgctttctccctttttttttttgaagaatctgagattgttgtgtgatgtgtttgattggatctgagattattgtgtgctgtatttgatttgtgtgtgatgtgaatatgtgatgaattttgtagaagttgtgatgtaattttttttaagattttgtgatgtatttgagtatttgagatgatcgatctgtggatttggaggcaatttgaggatgattgatttaggattttggggacaggatggagtgaaatcaatatatttaaaaataatgaagaaaagaaaataataaaaaggaaccggaaagagcaaccagattagcctctttagtctcggttggtaacaccaaccgggactaaaaatggatttttacccccggtattttcacccgggaccactggtagagaaaccatctttcgtcggtcggccgaattccaaaatagtcccggttgcaataaaaaccggggctaaagatgatctttagtcccggttaaaaagggtaacgggcatatttgatctttagtcccggttcaaatgctgtcaggtcttgtcaggcccccccgggatctttagtcgcggttggtgttaccaaccgggactaaagatcgtaattaccaaccgggactaaagatcccggggatccaaccgggactaaagtgtcacccctatatatatgtcttcttcctcctccagctgcccaagcaagcttcaaaatttcttcaaaaaagaggggaggtcatgccaaaatttcaagtgaatttattttggtgattatatacaaatcagaggtgactaaaaggttagcaacttcatcctccaatgttttttttgtcatattacatttggagctatgttttgcacacttttttgtctccaaaatttagctgtaagttgatgagagagaaaatttgtgtggagaagaaagaatatatagcaatttagttgatttgctaaagaaggttttataaaatagttgagaaggaaaatatagtgaaagttaatcttaaataatagaaaacaaactaaaatgaaaattaaaagaagtaaaacacattaattaatattagtttaaaactttagaaatagtaaataagaattatttggtataatattttatgatttttgtatgaataaagatatgtcattattgtatgactgttgaaagagtttgtaattattttataattattgtatgactgtcattattgtaagaataattttttgtgtacgattttttttcatgtcatgtaga

SEQ ID NO: 11030 - DNA, 1010 bp, Oryza sativa
agcaaacttattcctctttgacatcttaacaagctcaggctgttagtttgcgttgggcttaccttacgccggcctagccaaaatatttgtcactattaagtcacccgatacgatggtttgggcttcagagatcatactccatctgttccaaatactatcactatcgatcgatgttgtttcaactttgactactaatataaagcattttaaatggttagactacaatgaataaaagcataatgcttatgtttaggatgcaacacactttgataaaagtttaatgctgtttagggtgaaaacacactttgataatacaatttcttttaactttttatatatattctaccttcttccacaaatatttgacggtttgaactaactaacgttaaacataaaatgacagaggaagtatattttataaaaattcatttggtcaagttttaaatataaatagcgtctggtgatagaagaatttaggaataaaggaagtaagcaataagaatctacgcccatccaaatggctttatatgtactccctctgtttcatattataagggcctgtttagttcgcaaacgaaaattttaaccgtatcacatcggatatacggacacacatttaaagtattaaacatagattaataacaaaacaaattacagattacacctggaaactgcaacgtgaatttgttaagcctaattgatccatcattaacaaatgtttactgtagcaccacattgtcaaatcatgacgcaattaggcttaaaagattcgactcgcaatttacatggaatctgtgtaattagtttttttgtctatattaatactccatgaatatgtccaaatatttaatgtgatagggtgaaaaatttttgtttgggaactaaacagggcctaagtcgtttatgtaaaatcaaaggtgtttttttattattattctgtgatgaacaattgggcattggagattactggttttgttatttggaatttatttacgaagtggttttggaga

SEQ ID NO: 11031 - DNA, 432 bp, Oryza sativa
catccgtttcacaatataaatcattctagcatttttcacatttattttgatgttaataaatgtagacatatatatctatttaaattcattaatattaatatgaatgtgaaaaatgttaaaatgacttacatcgtaaaatggagaaagtatatactaagatattagtttattttaagataggagaggattccttttcctgccatctcctataaataagcatgcagaagtgcacaactcgacctccacatcacagctaatataagctgcagcaacacacgtactgtcttacttgcgcgcgcttagcttagcttagcttagtttagcttaattctctctcgatcgagctgatcgatcacaggttattcaattggagtagttaattaagtttagctactttgctagctgcattacactggtgtctctgatcgatga

SEQ ID NO: 11032 - DNA, 1501 bp, Oryza sativa
tatcgggttttcttcacagggccggtcagaccgcaggtatgtgggcggtctgaccggctaatagggccggtctgaccgcaggtatgtaggcggtcagaccggcagggtctgagtccaagtctgttttcgtcaggtctcgagtttccttactcgggaaggcatgtttcgtgtttcctttggtttctatcctgagttgggcatggagaagggcctgtagagggcaagaccaacccctatttaagggacaaggccggttcattgtaaaaccctcaaatacaatctatttgaatcgttcttttactatgttttctattttaccctagtttagtccatctttatcggtttacgccgtaaaccgtccgccgccgctgcgagagtgcgacacctctttgtaggtttgtcctgaaaaccttccgttttgcccacgagatgagtagttatcctcgtatcgatctaaatcggcctagaggctgattttgatctctaaatcggctccgctagccggtttagttgtttttcctcaaaacccatcttgatttggccgtttggctagattgaggtggttggcgactccatatcaccgcaaggtgtttaggtgttgtgatcgtgcttgtcgacttgtcaaaaaagttgccaacatgatttttggcgactccgctgggaaacgatctaatcgaccatatcacggccgaatttcgtttaatctagtcactttttcgtttcggcgagtcaagaatttcggccaaacggccgaaatcaatctacccaaaattcgtcactgctgccacgtatttttgattggatcaatctatttggcagcgatactgttcggtcatcaagctgattgctgccatcgattcatcgatttcccatctaatcgagtgtttcggctatacagccggaatcgatttttattctcgcgtggaaacagcaacaagcgaccggtagtgtcctcgctgtacacggtctgaaaaatcagaaatccaatcctatttatagtttgctgtttaacgtgtgctgaaaagaaaacgatcaggctgtacaaagccgatctatctagagccagcagcagtagtattgatttctgtatattttttgctgtgcacagaaaccgagtgaattattaaaaaagaaaaaattaaagccgattcaatttgcatcggctatcactgggaagtttcagtttttgtaaatttttgctacaaacacacagtagtatgcaacgaaaattacgagaccgtatattaatctattcggtcaaaaatttcgactatgagctatatggccgaaattaatcaaggaatttcttcatcaactatgacgagtgggaacgggttcaacaatattactcaaggcgtcgtgagaggaaatgtcccgctacctcaagttgtagtttcaccaaaggtaacctccgattcgcccaacccatactttgctattcaaaaggttaatgatcattgtatagatgcatatgctacttctagttttgctcctatacaat

SEQ ID NO: 11033 - DNA, 1501 bp, Oryza sativa
aaaacatgagctcggctcagctcgttttctggctcgagctagctcgagctgacttgcgagccttccattgaagctatataatttgtaatcattaagaaaagcaataacaaatcatcaacatgtaaaattaaaataactttatatattaaattcattaaaatatagatgataaattacatattgacaaataataacttcactagaaaaaaaatcatccatataaatacatgatggcctaggctaggctcatgagccaaatcaagcggctcgcaagccagctcaggctcggctcgtttcagaaccaagctaaaaaggaagcttgggcttgctcgtttggcattcaagccgagccaggctaagcgagctcgagccaagcccgagctgctcacgagcccaaattttttttccacccctacaagtaacactgttttttttttcatagaatgagttcgagttgaattcattacattaataatattgaacgagactggatgctatatatggcttggcgcacatttaagttagaaaaaatttggactgcgcgtgcgcgggttggggtggtgggggagggttgataaggcaatttcaacctatgttagtgttgggtgagtaggtttttgaaacaaaataagtaatggattaaatcacaaaacaagagtgataattgagatggtttacataattttgccactatactacttgcaggcgtgcgttatccatccacgtgtgcacgtggctaaggttgctcaatttggcgtgcacttcattttttttttttcacatgcatgccctggcactgcacgtctccggattccacgtagtgctgctgcctctagttagtagttactgatcaggatgacaaatcacgagtacaaaaatatgaattgggcttttgcacgtaccagtacatgcccacccgttgatccaagctaatataacgacttctcatttggcacgcatgcctgcaaaataagaagaagaaaaaatattagtcagtacgtagatagcgtgcaatgtttttttcaaatatttattatacttttgttcctaaatacaggcaagcagaattgtagtagtgtacaactgttcatcgatcttctgtcacacgttgatgtcttgatgatcggtgctcatccagctcttatgcgtcagatagacgaaacagatcgaatacacgcatttcctgccttaaatcaaataggaattggcctgcgtgtaatctgtagctgtagctttgcggtgccccgtttgaccttttctttctctaatagaatgggtggtttgttattaatcatactataaaatcaaaatcagcgcacgtgttggtgtgcctgctttttttttagaatgatatgctcaaaaaccaaaaaacttagtagaaccatatgtttttctgttggactttatggttgagtataaataatatggttttgataaatctttaactaaatcttatatggatgatgtactttccaaggcaatatattagcaccgcacaact

SEQ ID NO: 11034 - DNA, 1324 bp, Oryza sativa
ccttttctgctttatttaaatttggatttgaccatgcattgatcctacccctttgtcttctttaaatggctgagcacccccccaaccaccacggaaaaggcatggatgattttgtgacaaaattggctcccatgacactggtggtgggctaccccaacgcgccagaatactcgactgttccaccgctcattggcgagtttcctcaccgtgttcgcttagaggtccatggctatgtgggtacctgcctcgctaacatggtggttgaggcatccggaggcaccgcagaccacgcctcgctaacatggtggttgaggcatccggaggcaccgcagaccacgcctgtcaggaggcagcatatctgatgatggccaggcttcgtgatcggcacagctacaccttctgcaacacggcgtaccgcttccaccctcgtcgagcaagtggctatgatatcagcaccttccgcccgatagccggcgagaacgacaccaccttcggccacatgtgcgccatgatgaggggaatggacaggatgtactcggatctgcacaaggcatccaaggccttgaatgatgggaatctcgtgaggatcatagctctgaaggatgagatagcgcgcctgaagaagaagaatgctcagttgaagggtctcctagcgccaggaggagtccggatccgcaccacgccccgcaagtcaacaacggcacccgtgcgcattcaacttgcgcccaggaacccacctccgcctgcagctcccgcagctcctccagctccgcccgcagttcccgcagctccagcgccagttccagctcctgttccagtgtcagctcccgcgtccgctctctccttcactccagcatcagccgtcaggggcccagccagtggcaacggaggttggttgcctgctactcccagtggcagccgtgaccacagcagcagcagttccagtggcaccgagccaggcagatgcgagacgtatctgccagattccaggagccgctcagagggacctggtgacgagcaggaggacgccttcgactccaccgaccgcaggagccgttccgagcattaggctcgctttccattagtttatcgactatttagcatttgcctgttagtttgtgtgtttaggtctgctcgcttgtgggtcagttgacggtcgatatcatgtgcctataatatggctgtcttaataaagatttttgcttgctgttttaagtgttttaatttagatcagaacaattgcagtttaaattcctatataataaagcttagttcttgagcatctgtttttcttcttttcccccccgtctgcttttcctccaga

SEQ ID NO: 11035 - DNA, 1501 bp, Oryza sativa
tctacatggagtacccaaaaagatagtatctgatcaagggagccaattcacttcaaagttctggcagaaattgcaagaggaattgggaacccggttgaatttcagtacagcctaccatccgcagaccgatggtcagaccgagcgagtcaatcaaatattggaggacatgttaagggcttgtgcacttgattttggtggagcttgggacaaaagcttgccgtatgcggagttctcttacaaccacagttaccaggctagtcttcaaatggcaccgttcgaagcattatacggctggaagtgccgcacacctctcttctgggatcagacaggcgaacgtcaactgttcggaacagaggtgttaacggaagcagaagagaaagtcagaaccatcagagaaaggttgagaattgcccagtctcgacagaagagctacgcggacaaccgccgaagggagctcacttttgaagcaggggataacgtgtaccttcgtgttactccgctccggggagtacaccgttttcaaaccaaaggcaagttggcaccacgcttcgtgggaccataaaaaatcttggaacgaagaggagaagttgcttatcagctagagcttccatccaatatgatcggtatccaagacgtgttccacgtgtcccaattaaagaagtgcttgagggtacccgaagaacaggccgattcggagcacatcgatatccaggaggatctgacctacatggagaagccagttcgcatccttgagaccagcgaaaggaggactagaaacaaggtcaccaggttttgccgggttcagtggagccaccattcagaggaggaagcaacctgggaaagggaagatgagttgaaggccgcccatacgcacctcttcgccagctcttccgaatctcggggtcgagattccgtttaaggggggtaggtttgtcacaccctgaagttctttcccaagcctaaattgaagttataaatggtctcaagaaaataccagtgcaaagcaagactaaaccttaataaattaatgcaaataataatcagaattggcatgtggaatttttcttgagttctacatgtcgaaattcgctaacaagatttttagtggaattttcagagctctcgaaataattttaaccaattaaaattgagcacatgcaattttaaatcaaagggaaaatcttttcctccttttctttttcttttccctccttttcctcttcttgggccgtcggcccagtccaccccgccgccgcgcgcgccctcctccttgtgggccggcccaagccgcccctccctctccccccaggacgccgataggtgggccccacctgttgaggtcgtccccttcctccggccgcccgccccacgtcggcaaccgccgccgaaaccgccgcgcccacctccgccgctcctcccgcgcccacgcggcgtcgcccacgcgtcctccccacatcgccgccctctccccgcgtctcccggcccgcgcgtgcgctcgaaa

SEQ ID NO: 11036 - DNA, 1501 bp, Oryza sativa
aacgagtgcaagaaagccaaatggtaaggcctaagcatcttggcataatcgcggagaaatattccagagtctcatctcggtgtcatcactgaattcctggctgattggagcattccctctgaagctttcaacgcattggatgaaacatttagcatgtataagcggccggcatgcgtatgtaagcctgatcggcgacaaaagagaatcagatggagcagcctgaaacaatattccctatatctgttggagagtgcggactactaggtaagaagtgtggcaccgtgcttccctcctccctcctcgtcaatgctccggcgccggctgtgaacgccgtgcccgtgacgcctttctccatgatgccggcgacccgcgcttcgcgctgcacctccgatccgcgccaccccggccggatctggacggctggcgtcatggtggcggctggacggtggtggctggacgggggtgtccgtggcggtggcggtggcggtggcgatggtggctgacggtggcggctggcgacggtggtggctgtgatagtggcggtggtggctgtcgacgatggtacctatggcggcgatggttgaaggccatcatccggctgacggtgcgtcgtcgtcagcggcggtatgtggaggctgggaaggggtctggcggcggggaaggaggagtccaggtgcgggcacgccgtcgacggtgggaacaactgtgggcggtggccttggccgaatcgctgaagggacaatgttgttgaccgacgacgatccttcttgtgcggattggtggtgtaggtttggacagggaattgcgggcgaaagccttgccgagccatttggctggctgacaacggcgacgccgtttggcgtcgttcccctccttggaggagttgttttagcatacccctttcctttccctaccatattctccaggtgaaaaccttgcttcggttgtgaacgagcggtggcggcgatccacgtcgcatcctccttgggggcactgctttggagaaacctcttcgtgcaaggatattgtcattggtctatgcattggcttcgaacttcagtcctaggccttgacgaggccttctagctccacattttgttttacttttctcagtttgggtcctctcttctcttgtttggtgtgttcaacttgtcttgaactacactctcttctagagtggatttttgtaataattggctgtagttctttttgagcaaaggccaggatattatattccattatcttaaaagagaagtgtggcacagctgtggcatgataatgattttgatcgtgcattgaactaccccacaacagcacccctaccccacaaacagcacacacagttacaataatggataatttcgtttctacccctgttttaatgtcaaatattgattttgctcctactttttagggttttcgttttttcctcacttttttgaaccgaaagaggcgtttacccctagtttagatagaagtgagtgagaccgggcttatggaa

SEQ ID NO: 11037 - DNA, 1501 bp, Oryza sativa
aaccccacggcggccaccaatgtcggccggagtcggaggggagagaggactcaccggcgacgcgaggaaaatagggcctcggtgggattccggcaacgcaaggcagcggccgggaaagatttgtggcggtgaagctaatggtagcggcggcttagcacggcggcggctctagcggcggcggcatgcggccggagatgggcggcagcggcggcggcgaagctcgggtgtggcgtggggacagcggcggagtgcacgggcgagcgcggccagagcggaaaaaggttgagggggctcggaggagcgatttataggtgcgggagggggcagacgtggacgggaaacctccctattttgctggcgacgtgggagagtggggaggaagagagagagggggattcaaattgaatcccgccccttgcaagcgcgcgcgtggacgagagtggggcggcagagggcggtgacccggcgcgtgtgtggagtgggggcaccaggtggaccgaagaaggcgggcggcgtggggaggtgggggcgccggcggttggagcttggctccaaccggctggaggtaggggaagggctgataggtggaccccacctgtcagcacctgagagtgagggggaggccgggtggacttcgggaggggaagagggaaccggccagcccggtaggagggggagggcgcgggaggagatgggccggcggcccataagagaaaaagaaggaaaagaaaaaagaaaaagaagaaaggatttttcctgggattaaatattgcacttgctcatttttaattggttaaaattatttccaaggctctgaaaattccactaaaaatcttgttaatcaattgcgacatgtggaacccaagaaaaatcccacaatgccatttccaattattaattgcatttattaattagggaattagctctaggttaatttgaaccatctctttggacgatttatttaacaaatttttaaagaaagaagaagggggaaacttcagggcgtgacaatagtatacatacatattatacatacatcctagtcatatcattatagctaatatcctctttccgatgccctccttgtggttggagaagccaccctgattgccgagttccttacgacaatccgtcatgaccatccaaccgaggataaatactaaggagtaccctctccaggaaattaacttaggactatatacacgtgcggaggaataaccgtactgagctgttagcatcagtagcccacctcgcttccacagcatataaccctaaataatgatatccaataatctaaacactgttggtatttcttaacgacattgctagaaatataattcccagcaatgacgcagaaatatttctggtatattatggttacagagttcatccgcaagcgtacggatataccattatagcatttcacccgagagtattccaagggtatcgtatttattttatctcataggaagatcatgtagagagaactcaactaataatt

SEQ ID NO: 11038 - DNA, 1501 bp, Oryza sativa
ggtcgttagcgatcagtttcgcacgtcaatattaccaaaataaagtagaactaagttttgcttgcaaagcatattatgtcaaaataagatatattccactagcactaggctttctaacctcttgcagagaataaacataaaatggaggcgattcgacagtaaaatggacgatcaatcaatcggacgctgtcgaggatcagacttagaggaagatgggccaagaattcagaaagaacacaaccaatgggacaaaactcgcaagtctgcagaaaccaacagaagaggaggccgccagccgaaattggactaattttggcccagcccatggttcggccgaacccccttgagctccgttggatgcaggggttggtttggacggtgtggattagctccgaatgatagttggagggtatttccgaccattccaacagtcacaaccgtcattggagagctatataaggccttcacctcctcacctcttccacacatctcaagcaagaagcttcatacattctctcaagtttaatatagtttctagagtatagtggaatagaaatagaatataatcttcagtccgcagagtttttggaagagttcgggtaagactctagtagcttttccttcttttgtaagacttgtactatttatagaatattcttctcaatatattctcatttttgggggttatatgctgcggatacgtcgaggagggctactgatggagacagctcagtatgggtattcctctgcgcgtgtatataatcctaagttatttttttagggagggtactcctccgtatttagccccagttggatgggcttgacgggttgttgtaagaaactcggcaaccaagggtggtctctcgaaacaccaggagggcatcataagggggtattggctatacggttatatagtagataatattgactaaagtgtatgtatgtatattagaagtataggaaatgatccttttcttattctttccacttagcatagaattagtaagtatgagaatagtgaatgcttcagctttgtgtcaccctaccctttgaattgaactaaccccttcttagactttgattattacaagtaacatataagtattagcttggttctctctattataattttcccacgggattaaaaaaatacgatacccttggaatactctcgggtgaaatgctacaattatccatgtgcttgcggatgaaatctgtaaccataatataccacgagtggttttgcaccattgctgggaattatatttctagtaatatcgttaagaaataccaacaagcatttctagcgccgttgccggggaagatttataaaagagattactaatattttatatttatctctgtataatcactgtccttttgcaggctaaccttggttattttcgcttttgctgtgaaaatagggcagtgtatgactagtttcaacttgccggaaaatttcaaagaaaatcaaaaagttttcttctggagtgttaagccg
